United States Patent 11,098,302 (IDENTIFICATION OF POLYNUCLEOTIDES ASSOCIATED WITH A SAMPLE) - sequence listing, part 33

SEQ ID NO: 111150 - DNA, 578 bp, Homo sapiens
  misc_feature: GYAE6OF01D2KWT.52.6.A06.1.454.CMB.1.raw
  modified_base (328)..(328): a, c, t, g, unknown or other
  misc_feature (328)..(328): n is a, c, g, or t
  modified_base (430)..(430): a, c, t, g, unknown or other
  misc_feature (430)..(430): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtccccaaactcatgatctttgagtcagtgatcggcccgcaggggtttcncatcgcttctccggctccaagtctggcagcacggcctccctgaccatcctctggggctccaggctggagacggggagctgattagtactgcagctcatatanaagacagaaactcgttgggtgttcgggcggacgggaaccctaaacgtcggacccgttaccgtacgtacccgaacggccccgaaacgggcttaccccggtcccccgttacggttaccctaccgtttcccgtccggtttaaccccccccg

SEQ ID NO: 111151 - DNA, 589 bp, Homo sapiens
  misc_feature: GYAE6OF01DQ9SO.52.6.A06.1.454.CMB.1.raw
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttatattctgtctctggtaccaacaataccccggcaaacgtcccaaactcatgatctttgaggtcagtgatcggccgcaggggtttctcatcgcttctccggctccaagtctggcagcacggccctcccgtgaccatctcgtcgggcctccgaggtctggacgggacgacggctaggtactttagttactgacgagtcctactaataactaacaagtacaagtaaacctacggttggggtcgttcgggcgggtacgggaaccctaaacgtcgacccgtccgtacgtaccgacgtcccgaacggcccgtaccgtcccccgttacggtacctaccgtccgttccgttccccccg

SEQ ID NO: 111152 - DNA, 532 bp, Homo sapiens
  misc_feature: GYAE6OF01A51M5.52.6.A06.1.454.CMB.1.raw
  modified_base (519)..(519): a, c, t, g, unknown or other
  misc_feature (519)..(519): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaaatgacattggtacttataattctgtctcctggtaccaacaataccccggcaaagtccccaaaactcatgatctttgaggtcagtgatcggcccgcaggggtttctcatcgcttcctccggctccaagtctggcagcacggcctccctgacccatcctcgtcgggcctcaggcctgaggacgaggctgattattactgcagctcatatacaagcaagaactacgttagggtgttccgggcggacgggaccaaacgtcgaccgtctacgtcacgcccaaggcctcgcccctcgtacnctcgtcgtccccg

SEQ ID NO: 111153 - DNA, 548 bp, Homo sapiens
  misc_feature: GYAE6OF01EL2NQ.52.6.A06.1.454.CMB.1.raw
  modified_base (532)..(532): a, c, t, g, unknown or other
  misc_feature (532)..(532): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgcgaggggtttctcatcgcttctccggctccaagtctggcagcacggcctccctgacccatcctctcgggctccgaggctggacgggacgaggctagtattacttacgtgcagcctcatatacaagcaagaacgtagttgggtagttcggacgggacggaaccaacgtcgaccgtccgtacgtcacgcccgaaggcctaccgcccccgtcgtaccnctccgtcgttcccccg

SEQ ID NO: 111154 - DNA, 650 bp, Homo sapiens
  misc_feature: GYAE6OF01B1PAY.52.6.A06.1.454.CMB.1.raw
  modified_base (219)..(219): a, c, t, g, unknown or other
  misc_feature (219)..(219): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccggaacngcaatgacattgtacttatattctgtctctggtaccaacaatacccggacaaacgtcccaaactcatgatctttgagtcagtgatcggccgcgtagggtttctctactcgcttcgtccggtctccgaagtcgtcggcacgccacggccctccctacgacctatcctcgtcggcctccgacggtctaggaggacgacggtctagtatttacttacgtcgcgtacgtctacaacttaactaacgaagacgaaacgtaaaccgtacggtttaggggttcggttaccggggaccgggtaaccgggtaaaccccgtaaaacgtccggtaaaccccggttaccgttaaccggtaccgaacggtaccccggaaacggtcccgtacccggtcccccgttacggtacccttacccgttccgttccccggtttaccccccg

SEQ ID NO: 111155 - DNA, 713 bp, Homo sapiens
  misc_feature: GYAE6OF01E0L1J.52.6.A06.1.454.CMB.1.raw
  modified_base (204)..(204): a, c, t, g, unknown or other
  misc_feature (204)..(204): n is a, c, g, or t
  modified_base (274)..(274): a, c, t, g, unknown or other
  misc_feature (274)..(274): n is a, c, g, or t
tcagcgcagtacgacacgaccggtgctcgatttagatctactgacaggggggggtctcaggaggcagcgctcgtcgggacgtctccaccagtggcctgggctctgctattcctcaccctcctcactcagggcacagggtcctgggcccagtctgccctgactcagcctgcctccgtgtctgggtctcgtggacagtcgatcacntctctgcaccggacagcaatgactagttgtacttatatctgtctccgtagtaaccaacaactacccgganaaacgtccccaaatcatgattcgtttggagtcagtgacgtccggccgtgtagggtttcacgtatccgtcttcgtccggactacctaagtcgtacggctacgcccgtacggtcccttcccgtacggaacctacgtccgtccggtcgggtcctcccgaacgggtcgtacgggaccgggtacggacgggtacttaggtaatttacgttaacgtcggacgtacgtccttactaacgttaacctaacgaacgtaacaaacggtaacgttacggtttacggggttcgttacggggacccgggtaaccggtaaacccgtaaaccgtacccggtaaccgtttaccccgtaacggttacccgacccggtaaccccggaacggtccccgtacccccggtacccccggttcgtaacccttcccggttacccgttccccggttaccccccg

SEQ ID NO: 111156 - DNA, 717 bp, Homo sapiens
  misc_feature: GYAE6OF01BVP4O.52.6.A06.1.454.CMB.1.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (273)..(273): a, c, t, g, unknown or other
  misc_feature (273)..(273): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgacctcagcctgcctccgtgtctgggtctccgtggacagtcgatcaccatcctctgacaccggaacngcaatgacattgtacttatattcngtctcctggtaccaacaatacccggnaaacgtcccaaatcatgattctttgagtcagtgactcggcccgacggtaggggtttcctcactccggtcctttccgtccgggctccgaagttccgtggctacggccctaccggcccttacccgtagaaccctattcccgtcgttcggggaccctttccgacgggtcgtacgggaacgggtaacggtaagggtccgtaaaggtaacgttttaacgttaacgttcgggaacacgtacccttacgtaacttaacgttaacgaaacggacaaacggttaaaccgtacggtttcgggttgggttacccgggacgggtaacccgggaaccgtaaaccggtcgtaacccggttacccgttaaccgggtcaaccgggtacccgaacggttcccgtaccccggttccccctaccgggttacctacccgttccgttcccggtttacccccccgg

SEQ ID NO: 111157 - DNA, 618 bp, Homo sapiens
  misc_feature: GYAE6OF01D01RP.52.6.A06.1.454.CMB.1.raw
  modified_base (211)..(211): a, c, t, g, unknown or other
  misc_feature (211)..(211): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (376)..(376): a, c, t, g, unknown or other
  misc_feature (376)..(376): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctggggtcctcctggaccagtcgatcacatctccngcaccggacagcaatgactattgtacttatattctgtctctggtaccaacaactacccggacaaacgtcccaaactcatgattcttgagtcagtgactcggccncgtagggttcnctatcgcttcgccggctccaagtctgcacgcacgcctctcgacatctcgnggctcgagctggacggacgaggctaggtattactctcgcacgtctactagtacaacgaacgacaacgtaaacgtcggttcggggttacggttccgggaccgggtaaccgggaaacccgtaaacgtccggtaaccccgttcccgtaaccggtacccgaaccggacccccgtaaagggtccccgtacccggtaaccccccgttcgggtacccttaacccttcccgttacccggttccccccccg

SEQ ID NO: 111158 - DNA, 637 bp, Homo sapiens
  misc_feature: GYAE6OF01AVAPS.52.6.A06.1.454.CMB.1.raw
  modified_base (190)..(190): a, c, t, g, unknown or other
  misc_feature (190)..(190): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (370)..(370): a, c, t, g, unknown or other
  misc_feature (370)..(370): n is a, c, g, or t
  modified_base (455)..(455): a, c, t, g, unknown or other
  misc_feature (455)..(455): n is a, c, g, or t
  modified_base (504)..(504): a, c, t, g, unknown or other
  misc_feature (504)..(504): n is a, c, g, or t
  modified_base (561)..(561): a, c, t, g, unknown or other
  misc_feature (561)..(561): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacgagggtcctgggcccagtctgccctgactcagcctgcctcgtgtctggtctctggacngtcatcacntcnctgcaccggacagcaatgactattggtacttatattcngtctccgtaggtaaccaacacgtaccccggacaaacgtcccaaaatcatgtacttacgtttggacgtnaggtgacgtccggccgngttacgggttctcagtccgtctccgtcgtcgtactacgtagtcgngaccgcgaccgtctcccgtcacgcctacgttcgacgggtccgtcctacgggtacgtcggtaacgggaacgggtacgaccgggttnttaaacggttcttacgtaccgtgacgtaccgttcaacggtataccgaanacggaacgtaacgtaacgtttcgggtacggtcgggaccggaccggtaacggtaaccnccgtaccggtaccgttcgacgtaccgcggaccaccggtccctcccggtaccgttacaccgttcgtcccggtccccg

SEQ ID NO: 111159 - DNA, 654 bp, Homo sapiens
  misc_feature: GYAE6OF01CAMKT.52.6.A06.1.454.CMB.1.raw
  modified_base (471)..(471): a, c, t, g, unknown or other
  misc_feature (471)..(471): n is a, c, g, or t
tcagcgcagtacgacacgaccggtgctcgatttagatctactgacaggggggggtctcaggaggcagcgctctcgggacgtctccaccatggcctgggctctgctattcctcaccctctcactcagggcacagggtcctggcccagtctgccctgactcagcctgcctccgtgtctgggtctcctggacagtcgatcacatctcctgcacggacagcaatgacagttgtacttataattctgtctcctggtaaccaacaactacccggacaaacgtccccaaaatcatgtactctttgaggttcagtcgacgtcggcccgacgtaggggtttctactagtcgtcttcgtccggctacccgaagtcctggcacgcctacggccctccgtcgacctatcctcgtcgggccttccgaggtcctaggacggacggaggtctaggtaactttagttactgactagctactattaanaacaagacgaaacgtaaacgtacgttcggggtacggttaccgggacggggtaccgggtaaacctaaacgtaccggtaccccgtaccgtaaccgtaccggaaccggccccgaaacgggtcccgttacccggtaccccccgttaggttacccctaacctttcccgtcccggttttaccccccccg

SEQ ID NO: 111160 - DNA, 892 bp, Homo sapiens
  misc_feature: GYAE6OF01APTG7.52.6.A06.1.454.CMB.1.raw
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaactaccccggacaaacgtccccaaactccatgactctttgacggtcagtgagtcggcccggcgtacggggtttcctccgtacgtaccgccttttaccgtcccgggtccttacccgaaacggttccgttacgggtacccaaccggtacccggtaacccgggtccccctttacccccgttaccgggtaaccccctaacgtttcccgttccggttccgggggacccctttaccccggaccggggtaccgtttacgggaaaccgggggtaaacccggtaacgggtacccggttacgggtaaacttttaacggtttaacccgttacggtacccgtacggtacccttaacctaacttaaccgttaaacgaacggtaacccgtaaaacgggtaaaacccttacgggttttaccggggggttacggtttacccggggggacccgggtaacccggggtaaaaccccgtaaaacccggtttaccggaaccccccggggtttaccccgttaaacccgggtacccgtaaacccgggtacccccggtaaaccggggtcccttacccccccggggttcccccccggttaaccgggttacccctacccggtttccccgttaccccgggttttacccccccccc

SEQ ID NO: 111161 - DNA, 753 bp, Homo sapiens
  misc_feature: GYAE6OF01EU3IP.52.6.A06.1.454.CMB.1.raw
tcagcgcagtacgacacgaccggtgctcgatttagatctactgacaggggggggtctcagggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgccaccggaaccagcaatgactattggtacttatattctgtctctggtaccaacaactacccggacaaaccgtaccccaaactccatacgtattctttggacggtcaggtcgacgtaccggcccgtcgtacgggtttcctactactccgtcttccgtccggtaccttaccgaacgtctaggcctacgaccgtacccggtcccttacccgtacgtaccctacttccgttcgtcgggtacctccgacggtcgtacggacggtacggtacggtcttagtaactttacttacgtcgtacgacggtacctacgtaataacgtaacgtaacgaacctaaacggtaaccgttacgggtttacgggggttaccggtaacccggggaccgggtaaacccgggtaaaccgttaaacccgttccgggaaaccccgtttacccggtaaccggtaccggaacccgggtaccccggtaaacggtccccgtaccccggttaccccccggttaccgggtacccttacccgtttcccggtacccccgtttaaccccccg

SEQ ID NO: 111162 - DNA, 731 bp, Homo sapiens
  misc_feature: GYAE6OF01BC5AB.52.6.A06.1.454.CMB.1.raw
  modified_base (550)..(550): a, c, t, g, unknown or other
  misc_feature (550)..(550): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcaccggaccagaccaatgactagttggtaacttataattctgtctctggtaaccaacaactaccccggacaaaccgtacccaaactcatcgattctttgacgtctaggtgtacgtcggcccgtacgtaggggtttctcgtacttccggtcctttcccgtccgggtaccttacccgtaacggttaccttcgggaccaacggtcccgtacccgggtaccccgttccccgtacggtaacccctaacgttcccgttccggtacggggtaccctaccggaacgggtcgttacgggacggggacgtacgggtcgttagttacttagttaccgtgtccgtacgtactnacgtaaactaacgtaacgacgtaacggtaaacgttacgggttacgggttcggtacccgggaccgggtaacccggaaacctaccggttaccgaaccgttcccgtaacgttccgaaaccggttcccgaacggtcccgtacccggtccctaccggtactacccttcggttaaccccgtcccccg

SEQ ID NO: 111163 - DNA, 721 bp, Homo sapiens
  misc_feature: GYAE6OF01AYEOC.52.6.A06.1.454.CMB.1.raw
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaactaccccggcaaacgtccccaaactcatgatcgtttgaggtcagtgatcggcccgcgtagggtttctcgtatcgtcttcctccggctcctaagtctggctacgccaccggccctccccgtcgaccctactcctcgtcggggccctccgacggtcgtacggaacgggacgaacggtctagtaactttacgttactgtaccagtcctacgtaattactaacgaaacgaccaaacggtaaaccgttaccgtttggggttaccggtttccggggaccggggtacccggggtaaacccgtaaaccggttccggtaaacccccgggttacccgttaacccgggtaccgtaacccgggtacccccgtaaaaccggggtcccccgttaccccgggtacccccccggtttacccggggttaccccttaacccgtttccccgttcccccgggtttaccccccccgg

SEQ ID NO: 111164 - DNA, 718 bp, Homo sapiens
  misc_feature: GYAE6OF01DZNCB.52.6.A06.1.454.CMB.1.raw
  modified_base (210)..(210): a, c, t, g, unknown or other
  misc_feature (210)..(210): n is a, c, g, or t
  modified_base (292)..(292): a, c, t, g, unknown or other
  misc_feature (292)..(292): n is a, c, g, or t
  modified_base (682)..(682): a, c, t, g, unknown or other
  misc_feature (682)..(682): n is a, c, g, or t
tcagcgcagtacgacacgaccggtgctcgatttagatctactgacgagggggggggtctcaggaggcagcgctctcgggacgtctccaccatggcctgggctctgctattcctcaccctcctcactcgagggcacgagggtcctgggcccagtctgccctgactcagcctgcctccgtgtcgtgggtctccgtggacagtcgatcaaccntcctctgccaaccggaacagcaatgactagttggtacttaataattcgtgttctcgtaggtaaccaaacaacgtacccgganaaaaccgtacccaaaatcatgtacttcgtttaggacggttacaggtcgtacgtccggacccgtacggttaacgggttttcacgtactcggtcccttacggttccggacttaccgaaggttccgaggacacggacctaccggcctaccctacggaacctagttcgtcggtacggggtcctaccggacgggtccgtagggaaaccggtacgggtaaccggtacgttacggttaaacgttttacgttaacgtcccggatacggtactaacgtaactaacgtaaacaacgtaaccgaaacgtaaacgttacgggttacgggttcggtaccgggacgggtaccggtaaacctaacgtaccgtaccgtaccgtcgtaacgacgacccgacggtccnccgtacccgtgaccctacgttctacccggttacccc

SEQ ID NO: 111165 - DNA, 710 bp, Homo sapiens
  misc_feature: GYAE6OF01CMT4A.52.6.A06.1.454.CMB.1.raw
  modified_base (225)..(225): a, c, t, g, unknown or other
  misc_feature (225)..(225): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
tcagcgcagtacgacacgaccggtgctcgatttagatctactgacgaggggggggtctcaggaggcagcgctctcgggacgtctccaccatggcctgggctctgctattcctcaccctcctcactcagggcacagggtcctgggcccagtctcgccctgactcagcctgcctccgtgtctgggtctccgtggacagtcgatcaccatctcctgccaccggaaccngacaatgactattgtacttatattctgtctctaggaccaacaactacccggacaaacgtacccaaatcatntatctttgagtcagtnacgtcggccgcggtagggtttccncgtatccgtcttccgccggtctacctaagtcgtgaccacgccgaccgtcccttccacgtaccctatccgtcgtacggggtcctacccgaggtaccgtacgggaacgggacgtaagggtccttaaggttatttaacgtacgtgacgtagaccttaactaattaacgaaccgtaacgaaccgtaacggttaaaaccggtacgggtttacgggggttaccggtaccggggacgggtaaacccggaaacctaaaccgggttccggtaacccgttaccggtacccggtaacgaccggtaacccggtaaccggtcccgttaccccggaccccccgttacgggttacccctaccgttaccccgttacccgttacccccccg

SEQ ID NO: 111166 - DNA, 855 bp, Homo sapiens
  misc_feature: GYAE6OF01B65R3.52.6.A06.1.454.CMB.1.raw
  modified_base (191)..(191): a, c, t, g, unknown or other
  misc_feature (191)..(191): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctcgtgtctgggtctcccgganagtcgactcaccatcctcctgacgaccggaaccagacaatcgactattaggtacttataattctcgttctccgtacggtaacctaaacaaccgtaaccccggacctaaaccgtacccaaacctacactagtacttcgttagtacggtacgtagtcggaacgtccggacccggtcggtaacgggggttttcctaccgacgttaccggtcctttacccgttcccgggtaccttaccgtaaacggttccgttacgggaccgtaacggtacccggtacccggtccccttaccccgtcgtaaccctaacgttccgtcggtccgggtacctccggaacggttcggacggtacggaaccggggtcggtacgtacgttaacgtttaaacgttacgtcgtaccctacgtaccttaaccgtaacttaaacccgaaaccgaaaaaccgtaacggaaaacctttacgggttaacggggtttcgggttaccggggaccggggtaacccggggtaaacccgtaaaaccggttccggtaaccccggttaacccgttaaccgtacccgggtaaaccggtaccccgtaaccggggtaaccccttcccgggacccccccgtttcggtaaccccgttacccgtacccggtttccccggttccccccgtacccgtttacccccg

SEQ ID NO: 111167 - DNA, 744 bp, Homo sapiens
  misc_feature: GYAE6OF01BL6MG.52.6.A06.1.454.CMB.1.raw
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
tcagcgcagtacgacacgaccggtgctcgatttagatctactgacgaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccgaacngcaatgacattgtacttataattctgtctcctgtaccaacaactacccgganaaacgtacccaaactcatgacttctttgacggtcagtgacgtccggcccgcggtacgggttttcacgtacttccgtctttccgtaccggtccttaccgaacgttcctcgggacacggccgaaccggtcccctcccgtacgacctacgttccgtaccgtcgggtaccctaccggacggtacgtacgggtacgggtaaccggacggtacgttaacggtaagtttaacgttaccgtacgtccgaacgttccgtaactaattaacgtaaccgaagtaacccgtaaacggtaaaccgtacgggttttcggggttacggttacccgggggaccgggtaacccgggtaaacctaaaccggtaccggtaaccccggttccgtaaccggttacccgaaccggtaccccggtaaccgggtccccttacccggtccccccgtacggttacccctaccgtttccccgttacccgttacccccccg

SEQ ID NO: 111168 - DNA, 758 bp, Homo sapiens
  misc_feature: GYAE6OF01CHHQR.52.6.A06.1.454.CMB.1.raw
  modified_base (191)..(191): a, c, t, g, unknown or other
  misc_feature (191)..(191): n is a, c, g, or t
  modified_base (578)..(578): a, c, t, g, unknown or other
  misc_feature (578)..(578): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcaggcacagggtcctgggccagtctcgccctgactcagcctgcctccgtgtctgggtctccgtgacngtcgactcaccatctcctcgacgaaccggacacgacaatgactagttggtacttataacttctagtctacgtacgacctaaacaacgtacccgactaaaccgtacccaactcgtatacgtacttcgtttagagtctagtcgaacggtccggtaccgtacggttacgggtttctacgtacgtcgttcccgttcgtacccggtccttaccggtaacgttccgtacggaccgtacggtacccgtaccggtcccctacccgggaccgtaacccgtcgttaccgtccggttcggggacccttaccggacggtaccggacgttaaccggggcggtaacggttacgttacgttaaactttacccgggttaagtccggtactacgttacccgtanaacttaccgaaacgaaacgtaccgtaaacgtaaccggttacggtttacggggtacggttcccggaccgggtaaccgaacccgttaccgttccgaccgtttacccgtacggaccctacggaccccgcggtaacccgccccggtccccgtacgtaccctccgttccgttccggtaccccccg

SEQ ID NO: 111169 - DNA, 847 bp, Homo sapiens
  misc_feature: GYAE6OF01A9ZLN.52.6.A06.1.454.CMB.1.raw
  modified_base (214)..(214): a, c, t, g, unknown or other
  misc_feature (214)..(214): n is a, c, g, or t
tcagcgcagtacgacacgaccggtgctcgatttagatctactgacgaggggggggtctcaggaggcagcgctctcgggacgtctccaccatggcctgggctctgctattcctcaccctcctcactcagggcacgagggtcctgggcccagtctcgccctgactcacgcctgcctccggtgtcgtgggtcctccgtggaccagtcgatccacctntcctcctgaccaccggaaccagtcaagtcgactagttcggttaacttattaacttctgtcctaccgtacggtaccaacactaccccggacaaaccgtaccccaaactcatacgtacttcgtttggacggttcgaacgtgacgtcccgggccgtacggttagggtttacctcgtacgttccgttccgttccgtccggtcctacccgtaaggttccgtacggacgtaccggccgaaccccggtcccgttaaccccgtaccggtaaccctaccgttcccgttccgggttccgggtccccgttacggtacggtcgttacgggaacgggtacggtagtccgtttaagttacggtttaactacggttacgaccttacgtaccacgttaactaacgtaacgacgtaaccgtaagtaaacccgttggggtttaaccgggttcgggttaaccgggacccggggtaaaccccgggtaaaccgttaaccggttcccgggtaaccccgtttacccgggtaaccccgtaaccggacccccgggtaaaccggttacccggcccccccggtttaacccgtacccccccggtttaccgggtacccctaccccggtttccccggtttccccccgggtttaccccccccgg

SEQ ID NO: 111170 - DNA, 786 bp, Homo sapiens
  misc_feature: GYAE6OF01DP4EJ.52.6.A06.1.454.CMB.1.raw
  modified_base (199)..(199): a, c, t, g, unknown or other
  misc_feature (199)..(199): n is a, c, g, or t
  modified_base (470)..(470): a, c, t, g, unknown or other
  misc_feature (470)..(470): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcgagggcacgacgggtcctcgggcccagtctcgccctgactcacgcctgcctccgtgtcgtggtctccgtggacngtcgtatccaccactccgtcgtacgaccgaaccgacacgactacgtacgacgttacgttacgttaacttaagttacttcgtcggttcctacgtaaaccgaaacctaaaacgtaccccggtaaacccaaccgtaaaccctaacctaactacgtagttcgttactttcggagtacgtagtacgtacggaccggtccggccggttagggtttacgtccagttcccggtcttcccgttcgtccgtacgtacgtacgtcgcgcccaacggtacccnccgttacccacggtacctacggttcttaccgggcgtccgaccgtacgggtcggtaacggtcggaacggcggtagtacccgtttaagttgtaccttacgggactaccgtacgttaccgtaaactacgggtaactaacccggtaacgtaccggtaaaacggttccgggttttcgggggtacccgggtttaacggggaaccgggttaaccggaacccgttaaaacccggtccggtaccgtccgtacggtaacccgaccgtacggaccgtacccgtccgtcccgtacgtacccgtacttcccggttccctcccgtacccg

SEQ ID NO: 111171 - DNA, 518 bp, Homo sapiens
  misc_feature: GYAE6OF02IRPGD.52.6.A06.1.454.CMB.1.raw
  modified_base (221)..(221): a, c, t, g, unknown or other
  misc_feature (221)..(221): n is a, c, g, or t
  modified_base (377)..(377): a, c, t, g, unknown or other
  misc_feature (377)..(377): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccngcaatgacattggtacttataattctgtctcctggtaccaacaataccccggcaaagtccccaaactcatgatctttgaggtcagtgatcggcccgcaggggtttctcatcgcttctccggctccaagtctggcagcacggcctcctgaccatctntgggctccaggctgaggacgagctgattattactgcacgctcatataacaaacagaaacacttgggtgttcgcggcggaccaatcgacgtcctacgtcagcccaaggctcgccccgtcggtccactctcgttccctacccg

SEQ ID NO: 111172 - DNA, 510 bp, Homo sapiens
  misc_feature: GYAE6OF02GWEAE.52.6.A06.1.454.CMB.1.raw
  modified_base (499)..(499): a, c, t, g, unknown or other
  misc_feature (499)..(499): n is a, c, g, or t
tcagcgcagtacgacacgaccggtgctcgatttagatctactgacaggggggggtctcaggaggcagcgctctcgggacgtctccaccatggcctgggctctgctattcctcacccttctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggccgcagggtttctcatcgcttctccggctccaagtctggcagcacggcctccctgaccatctcgtgggctccgaggctgaggacgaggctgattattactgcagctcatatacaagcagaactgttggtgttcggcggcggaccaacgtcgaccgtcgtacgtcacgcccaagctcgcccctgtcnctctcgtcccc

SEQ ID NO: 111173 - DNA, 786 bp, Homo sapiens
  misc_feature: GYAE6OF02HIRWU.52.6.A06.1.454.CMB.1.raw
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaacagcaatgacattggtacttataattctgtctcctggtaccaacaatacccggcaaacgtccccaaactcatgatcttgaggtcagtgatcggcccgcgtagggtttctcgtatccgtcttccgtccggctacccgaagtcgtaggcacggccgaccggtcctccctcgaaccacttccgtccgtcgggccttccgaacgggtccttacgggaacggtaaccgggacggtcgttacggtaacttttaaagttaccgttacgggcctaacggtacccttacaacgtttaaccgttaaacgaaaaccggtacctaaaacgggtaaaacccgtaccggtttttacggggggttacgttttacccggggggacccgggtaacccggggtaaacccgttaaaaccggttaccgggtaacccccggtttaccccgttaaacccgggttccggtaaacccgggtaaccccccggttaaacggggtccccgtttaccccgggttacccccccggttacccgggtttaacccgttaaccccgttccccggtttacccggttttaccccccccccgg

SEQ ID NO: 111174 - DNA, 572 bp, Homo sapiens
  misc_feature: GYAE6OF02IEA3Y.52.6.A06.1.454.CMB.1.raw
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgcgaggggtttctcatcgcttctccggctccaagtctggcagcacggcctcctgacctatctcgtgggtcctccgaggtctggacggacggaggtctaggtattattacgtgcagtcctacgtatacttacaaagacaacgaaactacgttgggttacgttcgggacggccgggtaaccaacgtcggacccgtccgtaacgtcgacgcccgaaggcctaccggccccgtccggtcctacgtcctcggttaccccc

SEQ ID NO: 111175 - DNA, 527 bp, Homo sapiens
  misc_feature: GYAE6OF02IQEL5.52.6.A06.1.454.CMB.1.raw
  modified_base (416)..(416): a, c, t, g, unknown or other
  misc_feature (416)..(416): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgagtcagtgatcggccgcagggtttctcatcgcttctcggctcaagtctggcagcacggcctcctgaccatctcgtacgggcctccaggcgtcgaggacgaggctgtattacttacngtcagctacgatactacaagacaagaaactcgttgggtcgttcggcggcggaacaagtcgaccgtccgtacgtcacgcccgaaggcctcgccctcggcactcctctacccc

SEQ ID NO: 111176 - DNA, 530 bp, Homo sapiens
  misc_feature: GYAE6OF02JDPOC.52.6.A06.1.454.CMB.1.raw
  modified_base (248)..(248): a, c, t, g, unknown or other
  misc_feature (248)..(248): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (443)..(443): a, c, t, g, unknown or other
  misc_feature (443)..(443): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattcngtctcctggtaccaacaataccccggcaaagtccccaaactcatgatctttgaggtcagtgatcggcccgnaggggtttcncatcgcttctccggctccaagtctggcagcacggcctccctgaccatctctgggcctccgaggctggaggacgaggctgattattactgcagctcatactacaagcaagaaacngttgggtgttcggcggaccgggaaccaacgtcgaccgtccgtacgtcacgcccgaaggcctcgcccctggtccactcctcgttcccc

SEQ ID NO: 111177 - DNA, 540 bp, Homo sapiens
  misc_feature: GYAE6OF02HUTGM.52.6.A06.1.454.CMB.1.raw
  modified_base (330)..(330): a, c, t, g, unknown or other
  misc_feature (330)..(330): n is a, c, g, or t
  modified_base (425)..(425): a, c, t, g, unknown or other
  misc_feature (425)..(425): n is a, c, g, or t
tcagcgcagtacgacacgaccggtgctcgatttagatctactgacaggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtccccaaactcatgatcttgaggtcagtgatcggccgcgtagggtttcncatcgcttctccggctccaagtctggcagcacggcctcctgaccatctcgtcgggctccgaggctgagggacgaggctgtattatactgcagctnatatacaagacaagaactagttgggtcgttcgggcggacggaacaacgtcgaccgtccgtacgtccacgcccgacgccgtccgccccgtcgtcctaccttccgtccgttcccccg

SEQ ID NO: 111178 - DNA, 548 bp, Homo sapiens
  misc_feature: GYAE6OF02HZNZM.52.6.A06.1.454.CMB.1.raw
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgcaggggttttctcatcgcttctccggctccaagtctggcagcacggcctccctgaccatctctcgggctccgaggctgacggacgaggctgatttattactgcagctcatatacaagcaagaaactacgttagggtgttcgggcggcgggaaccaacgtgacccgtctaacgtcgacgcccgaaggcctccgcccccgttcggtaccctacgttcccgtcgttcccccgg

SEQ ID NO: 111179 - DNA, 743 bp, Homo sapiens
  misc_feature: GYAE6OF02HU9DJ.52.6.A06.1.454.CMB.1.raw
tcagcgcagtacgacacgaccggtgctcgatttagatctactgacagggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcaccggaaccagcaatgacatttggtacttataattctgtctcctggtaccaacaactaccccgacaaacgtaccccaaactcaatgtaactctttagaggtcagtgagtccggcccgcgtacggggtttactctaatccgtacttccgtccggtactccgtaaacgttcgtacggtcacgccgaaccgggtccctcccgtcgaaccctactcctccgttacggggcctcccggaggtccgttaggaacgggaccgtaacgggtcttaaggtaatttaactttaacgtgtacgtaccgacttacgaataacttaaacgaaacggtaccaaacgtaaaacgtaccgttttacgggggttacgtttacccgggggaccgggtaaccggggtaaacccgtaaaacccggttacggtaaccccgggttacccgtaaacccggttccgttaaaccggacccccgaaacgggtcccgtaccccggtacccccgtcgggttacccctaacccgtttcccgttacccggtttcccccccgg

SEQ ID NO: 111180 - DNA, 514 bp, Homo sapiens
  misc_feature: GYAE6OF02I22D9.52.6.A06.1.454.CMB.1.raw
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtccccaaactcatgatctttgaggtcagtgatcggccgcaggggtttctcatcgcttctccgctccaagtctgcagcacgcctcctgaccatctctgggctccgaggctgaggacgaggctgattattactgcagctcatatacaagacaagaactacgttgggtgttcggcggcggaaccaacgtcgaccgtcgtacgcacgccagctcgcccctgtccacgtctcgtccccg

SEQ ID NO: 111181 - DNA, 555 bp, Homo sapiens
  misc_feature: GYAE6OF02IK3UJ.52.6.A06.1.454.CMB.1.raw
  modified_base (331)..(331): a, c, t, g, unknown or other
  misc_feature (331)..(331): n is a, c, g, or t
tcagcgcagtacgacacgaccggtgctcgatttagatctactgacaggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaacagcaatgacattggtacttataattctgtctcctggtaccaacaactaccccggcaaacgtccccaaactcatgatctttgaggtcagtgatcggcccgcaggggtttcncatcgcttctccggctccaagtctggcagcacggcctccctcgaccatctcgtcgggcctccgaggcgtgaggacgagctgattatctgcagctcatatacaagacaagaaactacgtttgggtacgttcgggacggtaccgggaacctaacgtcgaccgtccgtaacgtccgacgacccgaaggcctccggtccccttcggtaccacgttcctcgttcccccg

SEQ ID NO: 111182 - DNA, 561 bp, Homo sapiens
  misc_feature: GYAE6OF02GM4V6.52.6.A06.1.454.CMB.1.raw
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgcccctgactcagcctgcctccgtgtctgggtctctggacagtcgatcaccatctcctgcaccggaaccagcaatgacattggtacttataattctgtctcctggtaccaacaataccccggcaaagtccccaaactcatgatctttgaggtcagtgatcggcccgcgaggggtttctcatcgcttctccggctcaagtctggcacgcacggcctccctgaccatctctgggctccgaggctgacgggacgaggctaggacttaacgttctgtcagtctcataatacaagtcaacgtaaactacgttgggtcgttcgggccggacgggaacctaacgtcgaccgttccgtaacgtcacgacccgaaggtccctacggccccctcggtacctacgttcctcgttaccccc

SEQ ID NO: 111183 - DNA, 829 bp, Homo sapiens
  misc_feature: GYAE6OF02GH91J.52.6.A06.1.454.CMB.1.raw
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaccagcaatgacattggtacttataattctgtctcctggtaccaacaataccccggcaaacgtccccaaactcatgatctttgaggtcagtgagtccggcccgcgtaggggtttcctcgtacttcggtactttccgtcccggccttacccaaaggttccgtacgggcctaacggccgtaaccgggtccccttaccccgtgaacccctactttacccgttccgttacggggtacccttacccggacgggtaccttacggggaacgggaaccggtacgggtaccgttacggttaactttaacgtttaaccgtaggtacccgtacggccttaacgtacttaaacgtaaaccgaaacggtaacccgaaacggtaaaacccgttaccgggttttacgggggtttaccggttttacccgggggaccgggttaacccgggggtaaacccttaaaaccggttcccggggttaaacccccggttcccgttaaacccgggttaaccggtaaacccgggtacccccggtaaaacgggtccccgttacccgggtaccccccccggtttaccgggttaccccgttacccgtttaccccggtttccccggttttaaccccccccgg

SEQ ID NO: 111184 - DNA, 613 bp, Homo sapiens
  misc_feature: GYAE6OF02H04W2.52.6.A06.1.454.CMB.1.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (324)..(324): a, c, t, g, unknown or other
  misc_feature (324)..(324): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcaccggacngcaatgacattgtacttatatctntctcctggtaccaacactacccgcaaacgtccccaaactcatgatctttgaggtcagtgactcggcccgtcgtagggtttcnctatcgtcttccgtccggctccgaagtctggcagccgaccggcctccctagacctatctcgtcggcctccgaggcgtacggacgggacgaggtaccttgtaattttacgttacgtgtacctacgccttacaactaacttaacgaacgtacaaacggtaacctacggtttgggttacgtccgggacgggaccgggtaaccaacgtaccgaacccgttccgtaacggttccgacgtacccgaaggtcccgtaccgccccgtacggtaccctacgtccgttccgttcccccg

SEQ ID NO: 111185 - DNA, 789 bp, Homo sapiens
  misc_feature: GYAE6OF02F9VOF.52.6.A06.1.454.CMB.1.raw
  modified_base (220)..(220): a, c, t, g, unknown or other
  misc_feature (220)..(220): n is a, c, g, or t
tcagcgcagtacgacacgaccggtgctcgatttagatctactgacgaggggggggggtctcaggaggcagccgctctcgggacgtctccacccatggcctggggctctgctattcctcaccctcctcactcagggcacagggtcctgggacccagtctgccctgacctcagcctgccctccgtgtctgggtctcctggacagtcgactccaccatctccngccaaccggaccagcaatcgacattggtacttatacttctgtctctcggtaaccaacaacgtaccccggacaaaccgtaccccaaactccatacgtacttcgttggaggtacaggtacgacgtccgggcccggtccgtaacgggggtttctccgtaacgtcccgtccgttaccgtcccggggtcctacccggtaacggttccgtcgggtcggtacggaccggtacccggtcccgttacccgtacggaccctacttccgtccgtacggggcctcccggacggtccgtacggtaacggggacgtaggtccgttagtaactttacgttacgtcgtacgtacgtcgtactaataacgtaacgtaaagtaccgaaaagtaaacccgttacggtttaccggggttacggttacccggggtaccgggtaacccggggaacccgtaaccggttacgggtaaccccgtttaccggtaaccggtacccgaaccggtaaccccggtaacgggtaccccgttacccggttacccccggttaccggttacccgtaacccgttccgttcccggtttccccccg

SEQ ID NO: 111186 - DNA, 516 bp, Homo sapiens
  misc_feature: GYAE6OF02GC0MJ.52.6.A06.1.454.CMB.1.raw
  modified_base (324)..(324): a, c, t, g, unknown or other
  misc_feature (324)..(324): n is a, c, g, or t
  modified_base (412)..(412): a, c, t, g, unknown or other
  misc_feature (412)..(412): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctctggtaccaacaataccccgcaaagtccccaaactcatgatcttgagtcagtgatcggccgcaggggtttcncatcgcttctccggctccaagtctggcagcacggcctcctgaccatctcgtggactccaggctgacggacgagctgattatactgacngctcatatacaagacaacgaaactcgttagggtcgttcggcggtacggaccaacgtcgaccgtcctacgtcacgaccagcctcgccctcgtcactctcgtcccg

SEQ ID NO: 111187 - DNA, 694 bp, Homo sapiens
  misc_feature: GYAE6OF02GTX48.52.6.A06.1.454.CMB.1.raw
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgccaccggaaccagcaatgactattggtacttataattctgtctcctggtaccaacaactaccccggacaaacgtccccaaactcatgattcttgaggtcagtgacgtccggcccgcgtaggggtttctcgtactcgtcttcgtccggcctcctaagtcgtggcagcgaccggcctcccgtcgacctactcctcgtcggcctccgacggtctggacggacggaggtcgtagtaacttacgttactcgacgtagcctactactaacaacgaacgaactaacggtaaaccgttacggtttacggggttacggttaccggggaccgggtaaccgggtaacccgtaaaccggttaccggtaccccggttacccgttaaccggttaccggaacccggtacccgtaaaccgggttcccgtacccggttaccccccggttccgggttaacccgttacccggtttacccgtccccggtttaaccccccccg

SEQ ID NO: 111188 - DNA, 652 bp, Homo sapiens
  misc_feature: GYAE6OF02GG7OA.52.6.A06.1.454.CMB.1.raw
  modified_base (327)..(327): a, c, t, g, unknown or other
  misc_feature (327)..(327): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgccaccggacagcaatgactattggtacttataattctgtctctgtacaacaactacccgacaaacgtcccaaactcatgattcttggagtcagtgacgtccggccgcgtagggtttcncagtccgtcttcgtccggctaccgtaagtccgtggcacgccgtaaccggccctcccgtcgaacctacttccgtcgtcgggtcctccgaaggtcgtaggacggacgagggtctaggttaatttacgttaacgtcgtacgtacgtactactaagtaataacgaaacgactaaacgtaaaacttcggtttaggggttacgttccggggaccggtaaccgggtaacctaaacgtccgtaacccgttacccgttaacggtaccgaaccgtacccgaacggtcctacccgtccccgtcggtacctaccgttcccgttcccggttacccccg

SEQ ID NO: 111189 - DNA, 693 bp, Homo sapiens
  misc_feature: GYAE6OF02F73MB.52.6.A06.1.454.CMB.1.raw
  modified_base (338)..(338): a, c, t, g, unknown or other
  misc_feature (338)..(338): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgccaccggaccagcaatgacattggtacttataattctgtctcctggtaccaacaactaccccggacaaacgtccccaaactcatgattctttgaggtcagtgactccggacccgcgtacggggtttcnctatcgtcttcgtccggtctaccaacgtctggctagcgacggtcctcctgacctatctcgtgggccttcgacggtctaggacggtacgacggtcttaggtaactttacgttactcgtactacggtacctaacgtataacgtaaacgaacgtaccgtaacgaaaccgttacggttttacgggggttacggtttccggggaacccggggtaccgggtaaacccgtaaaaccgttccgggtaaacccgtttacccggttaacggtaccggtaacccggaacccgttaaccgggtaccttccccgggtccccccgttacggtacccaccgttttacccgtacccggtttaacccccccg

SEQ ID NO: 111190 - DNA, 683 bp, Homo sapiens
  misc_feature: GYAE6OF02HW22E.52.6.A06.1.454.CMB.1.raw
  modified_base (358)..(358): a, c, t, g, unknown or other
  misc_feature (358)..(358): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagtctgcctccgtgtctgggtcctcctggacagtcgatcaccatctcctgcacgtggaaccagcaaatcgaactagtttggtaacttataattctgttcctctcggtaaccaacaactaccccggacaaaaccgtacccaaactcatacgacttcgtttgacggtcagtcgacgtcggccgtacgtacgggtttcncgtacgttcgtccgttcgtcccggtctaccgtaacgtcgtcggacacgtccgaaccggtccctacccgacggtacccacttccgttacgtcgggtcccttacgacgggtccgtacgggtacgggaaccggtacgggtccttaggttaacgtttaacttaacgttcgaactcgactagaaacttagtaacaaactaacgaaacgtacgttagggtcggttccgggcggaaccggtaccaacgtacgtacccgtacgtaccgacgcggtaccaaccggttccgtcccgtccccggtacgttacccacgtttcccgtaccggtccccc

SEQ ID NO: 111191 - DNA, 705 bp, Homo sapiens
  misc_feature: GYAE6OF02JUW41.52.6.A06.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
tcagcgcagtacgacacgaccggtgctcgatttagatctactgacaggggggtcgtcgaggaggcagcgctctcgggacgtctccaccatgcctggctctgctattcctcaccctcctcactcaggcacagggtcctgggcccagtctgccctgactcagcctgcctccgtgtcctgggtctccgtgaacngtcgatcactctcctgcaccggacngctaatgactattggtactataattctgtctctcgtactacaactaccgaccaacgtacccaactcacgtacacttacttgacgtcagtcgactccggccgtacgtagggttctacgacgttcaccttcttcccggctccgtaacgttcgtcgtcctacgtccgaaccgtcccgtacccgtaccgaccgtaacttcctcgttccgggtccttcccggaacggtcgtacggtacggtaacccggagggtcctaggtaacctttcgttaaacttggtacccaaggttccaacgtataaccgtaacgtaaacaagtaaacccgtagtttaacgggttccggtttaccgggaccggggtaccggtaaccgtaaggtacccgttagtacccgtaccgttaaccggttacccgaaccgtaacccggttaaccggcccgttacccgtacccggttcccggtacctaacccggtttcccgtacccgtttaccccccg

SEQ ID NO: 111192 - DNA, 588 bp, Homo sapiens
  misc_feature: GYAE6OF02FW7KE.52.6.A06.1.454.CMB.1.raw
  modified_base (204)..(204): a, c, t, g, unknown or other
  misc_feature (204)..(204): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntcctcctgccaccggaacagcaatgacattggtacttataattctgtctcctggtaccaacaataccccggacaaacgtccccaaaactcatgattctttgaggtcagtgatcggcccgcacggggttttctcatcgcttctccggctccaagtcctggcagcacggcctccncgaccatcctcgtggcctccgaggctggaggacgnggctgattattactgcagctcataactacaacgacaagtaaaccacggtttggggttacgttacgggccgggacggggaacccaacgtcgtacccggtaccgtacggtacaccggacccgaacggccgtaccggccccccgttacgggtacctaccgtccttcccggttacccccc

SEQ ID NO: 111193 - DNA, 807 bp, Homo sapiens
  misc_feature: GYAE6OF02H6TO2.52.6.A06.1.454.CMB.1.raw
  modified_base (153)..(153): a, c, t, g, unknown or other
  misc_feature (153)..(153): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagcgcagtacgacacgaccggtgctcgatttagatctactgacagggggggggtcgtcgaggaggcagcgctctcgggacgtctccaccatggcctgggctctgctattcctcaccctctcactcagggcacagggtcctgggcccagtcncgcctgactcacgctcgcctcgtgtcgtcggtctcgagctagtcactcaacntcctcncgaccgaaccggaacgacagtcgacttagttgtaacttaatacttcgtctctccgtacgtaaccaaactaccgtaacccggaacctaaaccgtaacccctaaactacctataacggtacttacgttacggtaacgtcgtagtcgtacgtcccggtccgtacgggttacgggtttcctacgtacgttccggtacgtttcccggtccggttacctaacccgtaaacggttccggttaacggaccgtacggacccgaacccgggttccctacccgtaacggacccttaccgtttaccggtccggttccgggtacccgtaccggtacgggttaccggtacgggaacgggtaacggtaccgggtacgttaacgttaacgtttaacttaccgttacggaccgtacgtaccgtacgtaactaacgtaaacgtaaccgtaacaaacgtaacgtacggttacgggttcggtacgggtaccgggtaaccgtaacgtaaccgtaccggtacccgttaccgtaccgttaaccgaccggtaaccggaaccgtccggtacccgtaccccggttcggttacccgtaccgttacccgtacccgttacccccg

SEQ ID NO: 111194 - DNA, 775 bp, Homo sapiens
  misc_feature: GYAE6OF02FTBOC.52.6.A06.1.454.CMB.1.raw
tcagcgcagtacgacacgaccggtgctcgatttagatctactgacaggggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgccaccggaccagcaatgactattggtacttataattctgtctcctgtaaccaacaactaccccgacaaacgtccccaaactcatgattctttgaggtctaggtgacgtccgggccccgtcggtacggggttttcctacgtacgttccgtccttccgtcccgggtacctacccgtaaggttcctcgggccgaacggacccgaacccgggtccccttaccccgtacgacccgtacttccgtccggttcgggtccctacccggtacggtccgttacgggaacgggtaaccggtaacgggtccttaaacggttaacgtttaaccgtttaaccgtcgtaccggtacgtaccgttaacgtacgttaaaactaacggaaacgtaaccgtaaacgtaaaccgtttacggggtttacggggtttccggggttaacgggaccgggtaaccgggtaaaccctaacggtacccggtacccggttaacccgttacggaccggacccgtaaccggaacgtcccgttacccggtccccggttacgtacccgtccgttacccggtccccgttacccccgg

SEQ ID NO: 111195 - DNA, 662 bp, Homo sapiens
  misc_feature: GYAE6OF02JF7SB.52.6.A06.1.454.CMB.1.raw
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacatctcctncaccggaacagcaatgacattggtaacttataattctgtctcctaggtaccaacaactaccccggacaaacgtaccccaaactcatgaacttcttgagtcagtgactccggccgtacgtacggggtttctcgactcgtccttcgtccgctacctaacgtcgtcggctacgccgtaccggtccctcccgtagaccctacgtctcgtcgggcctccgaggtccgtaggacggtacggaggtacgtcgtaacttacgtttaacgcggtaacctacggtcctaacgtacgtaactaaccgaagtaccaaacgtaaactacggttgggttacgttccgggacggtaccgggaacctaacgtcgtacccgtaccgtacgtaccgacgtacccgtaacggtccctacccgggtaccccgttacggttacccgacccgttccgttacccggttacccccg

SEQ ID NO: 111196 - DNA, 600 bp, Homo sapiens
  misc_feature: GYAE6OF02GKKQK.52.6.A06.1.454.CMB.1.raw
  modified_base (344)..(344): a, c, t, g, unknown or other
  misc_feature (344)..(344): n is a, c, g, or t
  modified_base (442)..(442): a, c, t, g, unknown or other
  misc_feature (442)..(442): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatctcctgccaaccggaaccagcaatgactattggtacttataattctgtctcctggtaccaacaactaccccggacaaacgtcccccaaactcatgatctttggaggttcagtgagtccggcccgcgtaggggtttccnctatcgcttcgtccggctccgaagtctggcagccgacgtccctcctgaccatcctcgtggcctcgaggctggacggacgagtcgtgtaattagttacncgcagtctctaatactacaagacaagaacgtacgttgggtcgttacgggcggaacggaaccaacgtcggaccgtaccgttacgtaccacggacccgtaacgggtcctaccccggtccccgtaccggtccgtaacccgttccgttcccggttacccccc

SEQ ID NO: 111197 - DNA, 564 bp, Homo sapiens
  misc_feature: GYAE6OF02F444M.52.6.A06.1.454.CMB.1.raw
  modified_base (220)..(220): a, c, t, g, unknown or other
  misc_feature (220)..(220): n is a, c, g, or t
  modified_base (547)..(547): a, c, t, g, unknown or other
  misc_feature (547)..(547): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcagggcacagggtcctggcccagtctgccctgactcagcctgcctccgtgtctgggtctcctggacagtcgatcaccatctcctgcaccggaacngcaatgactattggtacttataattctgtctccgtgtaccaacactaccccggacaaacgtccccaaactcatgattcttagaggtcagtgactccggccgcgtagggttctcatcgcttcgccgtctccgaagtctggcagcaccggcctccctcgacctacgtctcgtcgggcctcccgaggctggacggacgagctagattactactgctacgctacatatacgaagacaacgtaaacctggttcggtgtacggcggacgggtaccaacgtcgtaccctacgtaacgccgacgtcccgaacggcctaccgccccgttcggtacnccgttctcccgttaccc

SEQ ID NO: 111198 - DNA, 715 bp, Homo sapiens
  misc_feature: GYAE6OF02HPB31.52.6.A06.1.454.CMB.1.raw
  modified_base (329)..(329): a, c, t, g, unknown or other
  misc_feature (329)..(329): n is a, c, g, or t
  modified_base (511)..(511): a, c, t, g, unknown or other
  misc_feature (511)..(511): n is a, c, g, or t
  modified_base (551)..(551): a, c, t, g, unknown or other
  misc_feature (551)..(551): n is a, c, g, or t
  modified_base (644)..(644): a, c, t, g, unknown or other
  misc_feature (644)..(644): n is a, c, g, or t
tcagcgcagtacgacacgaccggtgctcgatttagatctactgacaggggggggggtctcaggaggcagcgctctcgggacgtctccaccatggcctgggctctgctattcctcaccctcctcactcagggcacgagggtcctgggcccagttctgcccctgactcagcctgcctccgtgtcgtgggtcctcgtggacaggtcgactcacctagtctccgtgccaaccgggaaccagtacaattcgaacgtagtttacggtaacttataacttctcgtccttcctaggtaaccaactaaccgtaaccccggacaaaccgtacccaaacnctatacgtattcgttagacggtctaggtacgacggttccgggccccggtcggtttacggggttcctaccgtacgttccggtaccgtttccgtcccggtaccgttaccgtaacgttccggtacggccgaacgtcccgtaccggtcccctccgtacgtacctcgtcgtccgtcggtccgtacgngtcggtacggaggtccgaggtactagttaacgttctacgngtaccgagtactactaatacaacgaacgtaacgaaacgtacgtcggttcgggtaccggttcgggaccgtacggtaactaccggtcggttaacnccgttaacgaccgtacggtccctaacggccctacccggtcccgtcggacttacctccgttacccgttaccc

SEQ ID NO: 111199 - DNA, 641 bp, Homo sapiens
  misc_feature: GYAE6OF02JFQ81.52.6.A06.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (301)..(301): a, c, t, g, unknown or other
  misc_feature (301)..(301): n is a, c, g, or t
  modified_base (494)..(494): a, c, t, g, unknown or other
  misc_feature (494)..(494): n is a, c, g, or t
tcagcgcagtacgacacgaccggtgctcgatttagatctactgacagggggggggtcgtcgaggaggcagcgctctcgggacgtctccaccatggcctgggctctgctattcctcaccctcctcactcacgggcacagggtcctgggcccagtctcggccctgactcagcctgcctccgtgtctgggtacctccgtggacncggtcatccaccatcctcctgcaccggaacngcaatcgacagttgacttatattctgtctctcgtacaacaacgtacccgactaactacccaactcactntacttcttcgacgtactacgtagtactcggaccgtacgtacgggttcctactagtccgtccttcgtccgactaccgtaacgttcgtcgtacacgtccgacgtcctccgtacgactcttcgtcgtcggtacctcgacggtctacggagaccggagtacgtgtacgttatcgtcgactacgtctacgtatactanacgaacacgtaacgtcggttacgggttgtaccgggacggaccgggaaccgtaaccgtacgtaccggtaccttaccggtaccgaaccgtaccggttaacggaccgtccccggtacccgtcggtaccctcggttaccgtccttaccccg

SEQ ID NO: 111200 - DNA, 733 bp, Homo sapiens
  misc_feature: GYAE6OF02HRL2X.52.6.A06.1.454.CMB.1.raw
  modified_base (192)..(192): a, c, t, g, unknown or other
  misc_feature (192)..(192): n is a, c, g, or t
  modified_base (314)..(314): a, c, t, g, unknown or other
  misc_feature (314)..(314): n is a, c, g, or t
  modified_base (467)..(467): a, c, t, g, unknown or other
  misc_feature (467)..(467): n is a, c, g, or t
  modified_base (572)..(572): a, c, t, g, unknown or other
  misc_feature (572)..(572): n is a, c, g, or t
tcagcgcagtacgacacgaccggtgctcgatttagatctactgacgagggggggggtctcaggaggcagcgctctcgggacgtctccaccatggcctgggctctgctattcctcaccctcctcactcgaggcacagggtcctgggcccagtctgccctgactcagcctgcctccgtgtctggtctcgtgacngtcatcactatctccgtgccgaaccggaacctgactaaagtagacctaagtttcggttaactttaattaacttcgttcgtaccttccgttacgggtaaacccaaactaaccgtaaccccggntaaaaccggttcccccaaaacgtcctaattcgtaactttcgtttacggtaacggtcctaaggtaccgtacggtccccggacccggtacgggttacgggtttccacgtacgtccgttccgttccgtacccggtactacccgtaaaggttcccgnggtacacggccgtaaccggtcctacccggtacgtacctacgttcgtaccggtcggtcctacggcgtaacgtggacgtaacggtcgtaacgttgtaacttacgttnacggtccacgttctagtaactacgtaacgacggtactaacgaacgttcggttcgggtcttacggggcggtaaaccgataccgtcgaccgttaccgtagtccgacggtaaccgtacgtcgtacccggaccgttcctaacggtcttacccggtccttaccccg

SEQ ID NO: 111201 - DNA, 696 bp, Homo sapiens
  misc_feature: GYAE6OF02IYTOE.52.6.A06.1.454.CMB.1.raw
  modified_base (296)..(296): a, c, t, g, unknown or other
  misc_feature (296)..(296): n is a, c, g, or t
tcagcgcagtacgacacgaccggtgctcgatttagatctactgacagggggggggtctcaggaggcagcgctctcgggacgtctccaccatggcctgggctctgctattcctcaccctcctcactcgaggcacagggtcctggcccagtctgccctgactcagcctgcctccgtgtcgtgggtctccgtggacagtcgatcacctatctctgccaaccggaccagcaatgactagttacgtacttataattctgttctcctagtaccaacaactacccgacaaacgtacccaaacncatagtattcttagagtcagtgactcggaccgcgtagggttctcgactcgtacgttcgccggtctacctaagtctcggacacgcgtaccggtcctacccgtacgacctacttccgtacgtcggtcctaccggacggtaccgtaggaacgggtacggtacggtcgttaacgttaattaacgttaccgtcgtacgtacgtacttacgaacttaacgaactaacgtactaaacgtaaacgttacggttggggttaccgttccgggaccgggtaaccggtaaccgtaaaccgttccggacccgttaaccggtaaccgtaccgtaacgtaaaccccgtacggttacccgtacccggtccccgttaccggttaccgtacccgtttccgtaccccgtttacccccgg

SEQ ID NO: 111202 - DNA, 754 bp, Homo sapiens
  misc_feature: GYAE6OF02JPMZK.52.6.A06.1.454.CMB.1.raw
  modified_base (304)..(304): a, c, t, g, unknown or other
  misc_feature (304)..(304): n is a, c, g, or t
  modified_base (472)..(472): a, c, t, g, unknown or other
  misc_feature (472)..(472): n is a, c, g, or t
tcagcgcagtacgacacgaccggtgctcgatttagatctactgacagggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtccgatcaccatctcctgcaccggaaccagcaatgacattggtaacttataattctgtctcctggtaccaacaactaccccggacaaacgtaccccaaactcatgactntttgaggtcagtgacgtcggcccgcgtaggggtttctcacgttccgctttccgtccggacctccgaacgttctcggacgtacgccgaccggtcccctcccgttacggaccctacttccgtaccggttcgggcctttaccggaacggtcgtacgggacgggaacccggnggtccgttaggtaaacttttaacgttaccggtacgtccgtacgtaccgtactaaacctaccaaaccgaaaacaaaccggtaaaacgttccgggtttaagggggttaccggttacccggggtaccggggtacccgggtaaaaccccgttaaacgtccgggttaccccgtaccgttaccggtacccggttaaccgaccccgggtaaacgtcccgttaccccgggccccccggtttacggttacccgtaccgtttcccgtttacccggtccccccggttaccccc

SEQ ID NO: 111203 - DNA, 957 bp, Homo sapiens
  misc_feature: GYAE6OF02FO5AS.52.6.A06.1.454.CMB.1.raw
tcagcgcagtacgacacgaccggtgctcgatttagatctactgacaggggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatctcctgccgaccggaaccagacaatgactagttgtacttatacttctgtctccgtacggtaccaacaacgtaccccgacaaaccgtaccccaaactcatacgtacttcgtttacggaggtaccaggtacgacgtcccgggtcccgtcggttacggggtttctacgtacgttccggttacctttccgtacccgggtccttacccgtaacggttcgtacgggtaccaacggcctacccgggttaccccgtccccgtaggtaacccctcgtttacccggtcggttaccggcccggttacccgacggggtaccgttaggggaaaccggggttaccgggaacgggttacccgttaaggtttaaccgttttaaaccgtttaccggttaacgggtaacccggttaccggttaccttaaccgggtttaaaacttaaccggttaaaaccctaaacgggggaaaccttaaaacccgggttaaaacgtttacccgggggtttttaggggggtttaaccgggtttaacccggggggaccccgggggtaaaacccgggggttaaaccccttaaacccggggttacccgggtaaacccccgggttttccgggtaaacccccccgttagggaaacccccggtaacccccgggtaaacccggggtttcccccggttaccccccgggtttcccccccggggtttaaacgggttaccccccgttaacccggttttcccccggtttacccccggtttaaccccccccc

SEQ ID NO: 111204 - DNA, 703 bp, Homo sapiens
  misc_feature: GYAE6OF02FQBWB.52.6.A06.1.454.CMB.1.raw
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
tcagcgcagtacgacacgaccggtgctcgatttagatctactgacaggggggggggtctcaggaggcagcgctctcgggacgtctccaccatggcctgggctctgctattcctcaccctcctcactcagggcacagggtcctgggccctagtctgccctgacctcacgcctgccttccgtgtctgggtcctcctggacagtcgatcaccatcctcngcacggaccngacaatcgacagttcgtaacttatattctgtctccgngtaccaacactaccccgganaaacgtccccaactcatnactnttaggagtctagtgaagtcggcccngtacgggtttcacntcgtacttctccgctaccgtaacgtctcggacacgccgtaaaccggtccctccgtacgtacctaacgttcctacggtcgggtcctaccgtacggtacgacggtacgggtacgaaggtccgttaggttaacttaaccgtttaacgttcggaccttaggccttaacgaacgtttaacaaacgtaacggtaactaaacggaaaccttaacgggtttcggtaccgggtttaaccgggacgggtaaccggtaaaccgtaaccgttaccgaccggttaacccgttaccggttaaccgaccgtaacccgtacggtccgtaccggtcccccttacgggaccctaccgtttccgtccctttacccccg

SEQ ID NO: 111205 - DNA, 590 bp, Homo sapiens
  misc_feature: GYAE6OF02ID5ST.52.6.A06.1.454.CMB.1.raw
tcagcgcagtacgacacgaccggtgctcgatttagatctactgacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaaatgacattggtacttataattctgtctcctggtaccaacaataccccggcaaaacgtccccaaactcatgatcctttgaggtcagtgatcggcccgctaggggtttctcatcgcttctccggctccagtctgcagcacggcctcctcgaccatcctctcggctccaggctgaggacgaggctgattattactgcagctacatatactaagacaacgaaactacgttgggttgttcgggtcgggaccgggaccgtaaacgtacgtaaccccggttaccgtaaccggtccgtaacggcccgtaaaccggtccgtacccgtcccccgtacccgggttacctaaccgttccgtccgtttacccccccg

SEQ ID NO: 111206 - DNA, 360 bp, Homo sapiens
  misc_feature: GYAE6OF01CYMLP.40.20.B09.1.454.CMB.1.raw
  modified_base (357)..(360): a, c, t, g, unknown or other
  misc_feature (357)..(360): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggcgccctgctccaggagcacctctgggggcacagcggccctgggctgcctggtcaaggactacttccagtcgctagactgagcgggctggcaaggcgcatagnnnn

SEQ ID NO: 111207 - DNA, 364 bp, Homo sapiens
  misc_feature: GYAE6OF01B5V0Z.40.20.B09.1.454.CMB.1.raw
  modified_base (359)..(364): a, c, t, g, unknown or other
  misc_feature (359)..(364): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggccccatcggtcttccccctggcgccctgctccaggagcacctctgggggcacagcggccctgggctgcctgggtcaaggactacttccagtcgctagactgagcgggctggcaaggcgcatagnnnnnn

SEQ ID NO: 111208 - DNA, 364 bp, Homo sapiens
  misc_feature: GYAE6OF01BIELD.40.20.B09.1.454.CMB.1.raw
  modified_base (357)..(364): a, c, t, g, unknown or other
  misc_feature (357)..(364): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggcgccctgctccaggagcacctctgggggcacagcggccctgggctgcctggtcaaggactacttccagtcgctagactgagcgggctggcaaggcgcatagnnnnnnnn

SEQ ID NO: 111209 - DNA, 361 bp, Homo sapiens
  misc_feature: GYAE6OF01A02XH.40.20.B09.1.454.CMB.1.raw
  modified_base (354)..(361): a, c, t, g, unknown or other
  misc_feature (354)..(361): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttcccctggcgccctgctccaggagcacctctggggcacagcggcctgggctgcctggtcaaggactacttccagtcgctagactgagcgggctggcaaggcgcatagnnnnnnnn

SEQ ID NO: 111210 - DNA, 442 bp, Homo sapiens
  misc_feature: GYAE6OF01EA065.40.20.B09.1.454.CMB.1.raw
  modified_base (436)..(442): a, c, t, g, unknown or other
  misc_feature (436)..(442): n is a, c, g, or t
tcagtctagcgactcacgaccggtgctcgatttagtgtagtgtgaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaagagggactttgggagtactactacggtatggacgtcgtgggccaagggaccgccgtcaccgtctcctcagcttccaccaacggcccatcggtccttccccctggccgccctgcctccaggacgcacctcgtggggcacgacgccggcccgtgggctgccgtggtcaacggactacttccagtccgactagactgacgcgggctggcaaggcgcatagnnnnnnn

SEQ ID NO: 111211 - DNA, 363 bp, Homo sapiens
  misc_feature: GYAE6OF01BCMMP.40.20.B09.1.454.CMB.1.raw
  modified_base (356)..(363): a, c, t, g, unknown or other
  misc_feature (356)..(363): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggcgccctgctccaggagcacctctgggggcacagcggccctgggctgcctggtcaaggactactccagtcgctagactgagcgggctggcaaggcgcatagnnnnnnnn

SEQ ID NO: 111212 - DNA, 574 bp, Homo sapiens
  misc_feature: GYAE6OF01CB7PA.40.20.B09.1.454.CMB.1.raw
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (538)..(541): a, c, t, g, unknown or other
  misc_feature (538)..(541): n is a, c, g, or t
  modified_base (543)..(561): a, c, t, g, unknown or other
  misc_feature (543)..(561): n is a, c, g, or t
  modified_base (563)..(566): a, c, t, g, unknown or other
  misc_feature (563)..(566): n is a, c, g, or t
  modified_base (568)..(574): a, c, t, g, unknown or other
  misc_feature (568)..(574): n is a, c, g, or t
tcagtctagcgactcacgaccggtgctcgatttagtgtagtgtgaaggggctggagtgggtctcatccatcagcagtggtagcacttacatacactatgcagactcagtgaagggccattcaccatctccagagacaacgccgggaactccctgtatctgcaaatgaagagcctgcgagcgaggacacgggtgttattattgtaactaaaaggacaaggagggtactttggggatactactacggtatggacgttcgngggccaagggaccnccgtcaccggtctccctacacgccttacccaccgaaacggggcccctaacgtccgggttacccttccccccgttcggcccgtaccccgtgccttcccgaagggacgccctaacccgtcggtcgggggaccaaccgacggccgggtcccgttaggggcctcggccccgtaggtaccgaagggtacccttaccgtttccgagttccgtactacggactaggacgggcggcgtacgggaccgaaagggtccgacgaagtacgntgngannnnannnnnnnnnnnnnnnnnnncnnnncnnnnnnn

SEQ ID NO: 111213 - DNA, 867 bp, Homo sapiens
  misc_feature: GYAE6OF01AE5OF.40.20.B09.1.454.CMB.1.raw
tcagtctagcgactcacgaccggtgctcgatttagtgtagtgtgaagggagctctgagagaggagcccagccctgggattttcaggtgttttcatttggtgatcaggactgaacagagagaactcaccatggtagtttgggctgagctggtctttttcttgtggcttaagttttaaaggtgtccagtgtgaggtgcagctgttggagtcgtgggggaggtcttggcacgacggccggttcggggggtccctgacgtaccttcctccgtggtgccacgtccttcgtggtactttccctaaccgtttagcctaaccttagtcggctagtcggacgtcggtccggggtcccgccgggtctacccgggaggggacgggtcgtagggtacgttcgggtcctacgtaaactttagttagtaggttaggttacgcgtaccgttaactaacgttaaacccgaacgttaggttacggtaaccgtacgtaaccggtaacccggttcccgggttaaggggtaacccggggggttacccgttaaccctaacccgtaccgttacccgtaacccgtaaaggtaaccgtaaacccgttaaaccgttacccggaaaccgggtaaccgtaaccggttaccgttaagtttaaccgtaacgttaaaccggaaacggtttacggtaaccttaacggttaccggtagggtaaccggacgggtaccccggaacgggtacccggtaacccggtttactttaacggtttaacgtttaacgttcgggtaaccggtaaacggttaaacggttacccggtaaacggttaacgggttcccgggtaacgggttaccgggtaacccgggtacggggtaacggggttccggtaaacgg

SEQ ID NO: 111214 - DNA, 422 bp, Homo sapiens
  misc_feature: GYAE6OF01EQFSH.40.20.B09.1.454.CMB.1.raw
  modified_base (368)..(368): a, c, t, g, unknown or other
  misc_feature (368)..(368): n is a, c, g, or t
  modified_base (393)..(422): a, c, t, g, unknown or other
  misc_feature (393)..(422): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtaactaaaggacaagagggactttgggagtactactacggtagtggacgtcgtggggccgaagggacccgccgtcaccgtctcctcagcttccaccaacggcccatccggtccttcccctggccgccctgcctccgaggacgccaccgtcggcggggcacgcggccggcccgtgggctgccgtgacgagtaccttacctcgaggtcgactagacgtggacggccgggtntcggacgtacgggccgacaagtcgnnnnnnnnnnnnnnnnnnnnnnnnnnnnnn

SEQ ID NO: 111215 - DNA, 359 bp, Homo sapiens
  misc_feature: GYAE6OF01B212Q.40.20.B09.1.454.CMB.1.raw
  modified_base (355)..(359): a, c, t, g, unknown or other
  misc_feature (355)..(359): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtctcccctggcgccctgcctccaggagcacctctgggggcacagcggccctgggctgcctggtcaaggactacttccagtcgctagactgagcgggctggcaggcgcatagnnnnn

SEQ ID NO: 111216 - DNA, 443 bp, Homo sapiens
  misc_feature: GYAE6OF01E038Z.40.20.B09.1.454.CMB.1.raw
  modified_base (280)..(280): a, c, t, g, unknown or other
  misc_feature (280)..(280): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (406)..(407): a, c, t, g, unknown or other
  misc_feature (406)..(407): n is a, c, g, or t
  modified_base (410)..(443): a, c, t, g, unknown or other
  misc_feature (410)..(443): n is a, c, g, or t
tcagtctagcgactcacgaccggtgctcgatttagtgtagtgtgaagggccgattcaccatctccagagacaacgccgggaactccctgtatcctagcaaatgaagagcctgccgagccgaggacacgggtgtttattattgtactaaaggacaagagggactttgggagtactactacggtatggacgtctggggccaagggacccgcccgtcaccgtctcctcagcttccacccaagggccccatccgtctccccctggcgccctgacctccgacggnaccgtccgtcggcgacggacgccggccgccggccgcggccgtcggtccgtacggtacgtaacctacngtccgtacgnttacgacgtggacgtacgggacgtcggacgacgggccgcgacgaggcgnnagnnnnnnnnnnnnnnnnnnnnnnnnnnnnnnnnnn

SEQ ID NO: 111217 - DNA, 497 bp, Homo sapiens
  misc_feature: GYAE6OF01C8QVZ.40.20.B09.1.454.CMB.1.raw
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (465)..(497): a, c, t, g, unknown or other
  misc_feature (465)..(497): n is a, c, g, or t
tcagtctagcgactcacgaccggtgctcgatttagtgtagtgtgaaggggctgggagtgggtctcatccatcagcagtggtagcacttacatacactatgcagactcagtgaagggccgattcaccatctccagagacaacgccgggaactccctgtatctgcaaaatgaagagcctgcgagccgaggacacgggtgtttatattgtaactaaaggacaagagggtactttgggatactactacgggtatggacgtcgtggggaccaaggggaccgccgtcaccgtctcctcagcttccaccaagggcccagtccgtctcccctggccgccctggctccaggacgccacccgtcgtcgggggcacgacggcggccctgggctcgcctggtacaacggctacttccgagtccgctaggaactggacggtaccgggcgtagggacaacgggcgaccagtagngcngnnnnnnnnnnnnnnnnnnnnnnnnnnnnnnnnn

SEQ ID NO: 111218 - DNA, 614 bp, Homo sapiens
  misc_feature: GYAE6OF01AI57X.40.20.B09.1.454.CMB.1.raw
  modified_base (201)..(201): a, c, t, g, unknown or other
  misc_feature (201)..(201): n is a, c, g, or t
  modified_base (569)..(569): a, c, t, g, unknown or other
  misc_feature (569)..(569): n is a, c, g, or t
  modified_base (576)..(576): a, c, t, g, unknown or other
  misc_feature (576)..(576): n is a, c, g, or t
  modified_base (589)..(612): a, c, t, g, unknown or other
  misc_feature (589)..(612): n is a, c, g, or t
  modified_base (614)..(614): a, c, t, g, unknown or other
  misc_feature (614)..(614): n is a, c, g, or t
tcagtctagcgactcacgaccggtgctcgatttagtgtagtgtgaaggggctggagtgggtctcatccatcagcagtggtagcacttacatacactatgcagactcagtgaagggccgattcaccatctccagagacaacgccgggaactccctgtactctgacaaatgaagcgcctagcgacgccgaggtccgagggttnttttattattaggtaacgtaaaggacaaggagggttatttaggggatacgtacgtaacgggtgtacggtacgtcggtacggggccaacggggaccgtccgtccgaccgtccgtccgtaccgtacgtcccttacccgaccgtaaccgggccctacgttcccggttcccttcccccgtcgggccgtccccgtgtacccgtcgtacgggacgccctaccgtcggacggggtcccacggcggttacccggtcccggcgggtacgtccggttcccgtacgggtccggaaacgttaccgtccttccgtacgtccggacgttaacgacgttcgacggtccgggtacggtcggaacgacggtccgagacgtagcgntcgatgnctgccagctatgnnnnnnnnnnnnnnnnnnnnnnnngn

SEQ ID NO: 111219 - DNA, 414 bp, Homo sapiens
  misc_feature: GYAE6OF01AJGU9.40.20.B09.1.454.CMB.1.raw
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (381)..(414): a, c, t, g, unknown or other
  misc_feature (381)..(414): n is a, c, g, or t
tcagtctagcgactcacgaccggtgctcgatttagtgtagtgtgaagggccggattcaccatctccagagacaacgccgggaactccctgtatctgcaaatgaagagcctgcgagccgaggacacgggtgtttattattgtactaaaggacaaagagggactttgggagtactactaaacggtatggacgtctggggccaagggaccgccgtcaccgtctacctcacgcttccaccaagggccccatccggtcttcccccnggccgccctgctccaggancacctcgtgggggcacaggccggcccgtgggctgccgtggcaaggactacttccagtcgctagactgacggcgggctcgggcaaggcgacataggcngngnnnnnnnnnnnnnnnnnnnnnnnnnnnnnnnnnn

SEQ ID NO: 111220 - DNA, 357 bp, Homo sapiens
  misc_feature: GYAE6OF02FFI4K.40.20.B09.1.454.CMB.1.raw
  modified_base (356)..(357): a, c, t, g, unknown or other
  misc_feature (356)..(357): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttcccctggcgccctgctccaggagcacctctgggggcacagcggccctgggctgcctggtcaaggactacttccagtcgctagactgagcgggctggcaaggcgcatagnn

SEQ ID NO: 111221 - DNA, 457 bp, Homo sapiens
  misc_feature: GYAE6OF02II4SW.40.20.B09.1.454.CMB.1.raw
  modified_base (428)..(428): a, c, t, g, unknown or other
  misc_feature (428)..(428): n is a, c, g, or t
  modified_base (441)..(457): a, c, t, g, unknown or other
  misc_feature (441)..(457): n is a, c, g, or t
tcagtctagcgactcacgaccggtgctcgatttagtgtagtgtgaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggttgtttattattgtactaaaggacaagagggactttgggagtactactacggtatggacgtcgtggggccaagggaccgccgtcaccgtctcctcagcttccaccaagggcccatccggtcttccccctggccgccctcgcctccaggacgcacctcgtgggggcacgaggccggcccgtggggcctggcccgtggtcaaggacttactccagtcgctagactgagcgggctggnaacggcgcatagnnnnnnnnnnnnnnnnn

SEQ ID NO: 111222 - DNA, 437 bp, Homo sapiens
  misc_feature: GYAE6OF02HHRI5.40.20.B09.1.454.CMB.1.raw
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (421)..(437): a, c, t, g, unknown or other
  misc_feature (421)..(437): n is a, c, g, or t
tcagtctagcgactcacgaccggtgctcgatttagtgtagtgtgaagggggcggtggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttatattgtactaaaggacaagagggactttgggagtactactacggtatggacgtcgtggggccaagggaccgccgtcaccgtctcctcagcttccaccaaggccatcgtcttcccctggcnccctgctcaggancacctcgtggggcacgagcggcctgggcctgcctggtcaaggactactccagtcgctagactgagcgggctgggcaggcgcgatgnnnnnnnnnnnnnnnnn

SEQ ID NO: 111223 - DNA, 437 bp, Homo sapiens
  misc_feature: GYAE6OF02HG5LW.40.20.B09.1.454.CMB.1.raw
  modified_base (427)..(437): a, c, t, g, unknown or other
  misc_feature (427)..(437): n is a, c, g, or t
tcagtctagcgactcacgaccggtgctcgatttagtgtagtgtgaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtaactaaaggacaagagggactttgggagtactactacggtatggacgtcgtggggccaagggaccgccgtcaccgtctcctcagcttccaccaagggcccatcggtcttccccctggccgccctgcctccaggagcacctctgggggcacagcggccctgggctgcctggtcaaggactactccagtcgctagactgagcgggctggcaaggcgcagtagnnnnnnnnnnn

SEQ ID NO: 111224 - DNA, 434 bp, Homo sapiens
  misc_feature: GYAE6OF02FYLUF.40.20.B09.1.454.CMB.1.raw
  modified_base (422)..(434): a, c, t, g, unknown or other
  misc_feature (422)..(434): n is a, c, g, or t
tcagtctagcgactcacgaccggtgctcgatttagtgtagtgtgaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaagagggactttgggatactactacggtatggacgtctggggccaagggaccgcgtcaccgtctcctcagcttccaccaagggcccatcggtcttccccctggccgccctgctccaggagcacctctgggggcacagcggccctgggctgcctggtcaaggactacttccagtcgctagactgagcgggctggcaaggcgcatagnnnnnnnnnnnnn

SEQ ID NO: 111225 - DNA, 364 bp, Homo sapiens
  misc_feature: GYAE6OF02JHEYP.40.20.B09.1.454.CMB.1.raw
  modified_base (359)..(364): a, c, t, g, unknown or other
  misc_feature (359)..(364): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggccgccctgctccaggacgcacctctgggggcacagcggccctgggctgcctggtcaaggactacttccagtcgctagactgagcgggctggcaaggcgcatagnnnnnn

SEQ ID NO: 111226 - DNA, 538 bp, Homo sapiens
  misc_feature: GYAE6OF02HKTDF.40.20.B09.1.454.CMB.1.raw
  modified_base (504)..(504): a, c, t, g, unknown or other
  misc_feature (504)..(504): n is a, c, g, or t
  modified_base (506)..(508): a, c, t, g, unknown or other
  misc_feature (506)..(508): n is a, c, g, or t
  modified_base (510)..(538): a, c, t, g, unknown or other
  misc_feature (510)..(538): n is a, c, g, or t
tcagtctagcgactcacgaccggtgctcgatttagtgtagtgtgaaggggctggagtgggtctcatccatcagcagtgggtagcacttacatacactatgcagactcagtgaagggccgattcaccatctccagagacaacgccgggaactccctgtatctgcaaatgaagagcctgcgagccgaggacacgggtgtttattattgtactaaaaggacaaggagggactttgggagtactacgtacggtatggacgtcgtggggccaagggaccgccgtcaccgtctcctcagcttccaccaaggcccatcggtcttcccctggcgccctgctccaggacgcacctcgtgggggccacacggccggccctggggccttcggccctcgggtaccgaacgggtaacgttaccctttcccgacggttaccgggtccgttaaggaaccgtttcggaacgggtaccgggggccgtgggtaccgtaaagggccgggacgaacgttaggcngnnngnnnnnnnnnnnnnnnnnnnnnnnnnnnnn

SEQ ID NO: 111227 - DNA, 369 bp, Homo sapiens
  misc_feature: GYAE6OF02HEJK0.40.20.B09.1.454.CMB.1.raw
  modified_base (268)..(268): a, c, t, g, unknown or other
  misc_feature (268)..(268): n is a, c, g, or t
  modified_base (354)..(369): a, c, t, g, unknown or other
  misc_feature (354)..(369): n is a, c, g, or t
tcagtctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttcaccaagggcccatcggtcttcccctggcgccctgctccaggngcacctctgggggcacagcggcctgggctgcctggtcaaggactacttccagtcgctagactgagcgggctggcaaggcgcatagnnnnnnnnnnnnnnnn

SEQ ID NO: 111228 - DNA, 706 bp, Homo sapiens
  misc_feature: GYAE6OF02I50X3.40.20.B09.1.454.CMB.1.raw
tcagtctagcgactcacgaccggtgctcgatttagtgtagtgtgaaggggctgggagtgggtctcatccatcagcagtggtagcacttacatacactatgcagactcagtgaagggccgattcaccatctccagagacaacggccgggaactcctgtatctgcaaatgaagagcctgcgagccgaggactcgggtagttttattattgtaactaaaggacaaggagggtactttaggggaataccgtacgtaggtatggacgttacgtgggaccgaagggaccgacgtcgaaccgttcctcctcgacgtcgttccaaccgaacgggcccagttaccggtccttcccccgtcggtaccggtcccctagtccgttacccgacggacgtccgaacccgtcggttcgggggtaccacggtacgtacggggtaccccgtcggggtacttccgggacccgttacgggtacgtaaacgggtccttaaccggttacccggtacgtccggtacgttaaccgtacgttacgacgggtacgggccgttacgggacgttaacgggacgaccgtaaggtacggcacggacacgtacggtatcgtacgtagacgtacgtgtacgtacgtacgtacgtacgtacgtacgacgtacgtagacgtacgtcgtaccgtacgacgtacgtcgtacgtacgtacgtacggtacgtacgtacgtacg

SEQ ID NO: 111229 - DNA, 522 bp, Homo sapiens
  misc_feature: GYAE6OF01CPDJM.23.88.H11.1.454.CMB.1.raw
  modified_base (336)..(336): a, c, t, g, unknown or other
  misc_feature (336)..(336): n is a, c, g, or t
  modified_base (478)..(478): a, c, t, g, unknown or other
  misc_feature (478)..(478): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccggccagactgttgacaacgacttagcctggtaccaacagaagcctggccaggctcccaggctcctcatctatgatacttccagtagggccactggcatccccagcccgnttcagtggcagtgggtctggggacagacttcactctcaccatcaccagccctagagcctgaagattttgctagtttatactgtcagcaccgtaagaagtggcctcaatattcactttcggccctagggaccaagtggaatanacaaacgaactggtaggctgacaccatctgtcttcattctcccg

SEQ ID NO: 111230 - DNA, 526 bp, Homo sapiens
  misc_feature: GYAE6OF01DCGCX.23.88.H11.1.454.CMB.1.raw
  modified_base (487)..(487): a, c, t, g, unknown or other
  misc_feature (487)..(487): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
tcagacgcgagtatcacgaccggtgctcgatttagcgacagcgagaacacacaaagggggaggaactgctcagttaggacccaggagggaaccatggaagccccagctcagcttctcttcctcctgctactctggctcccagattccaccggcgaaattgtgttgacacagtctccagcccaccctgtctttgtcgtccgggggaacagccaccctctcctgcagggccggccagactgtgacaacgcttagcctggtaccaacagaagcctggccaggcctcccaggcctcctcatctatgatactcaggtaggccactggcatccccagccccgcttcagtggctaggtgggtctggggacagtacttcactctcacatccaccagccctagacgcctagaagtattttgctagtttatactgtacagcaaccgtaagagtcggcctacaatacttcacgtttcggcctgggaaccagtggatanacaacgactgtgctgcaccatctntcttcnttcctcccg

SEQ ID NO: 111231 - DNA, 524 bp, Homo sapiens
  misc_feature: GYAE6OF01BXKPP.23.88.H11.1.454.CMB.1.raw
  modified_base (291)..(291): a, c, t, g, unknown or other
  misc_feature (291)..(291): n is a, c, g, or t
  modified_base (517)..(517): a, c, t, g, unknown or other
  misc_feature (517)..(517): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccgccagactgttgacaacgacttagcctggtaccaacagaagcctggccaggctcccaggctccncatctatgatacttccagtacgggccactggcactccccagccccgtcttcagtggcaggtgggtctggggacaggacttcactctcaccatccaccagcctagacgcctagaacgtattttgacttagtttattactgtacagcacgtaagagtcgcctcaatacttctacttcgcctggacaagtgatatacaaacgacgtgtagctgctacatctgtcttctntctcccg

SEQ ID NO: 111232 - DNA, 571 bp, Homo sapiens
  misc_feature: GYAE6OF01CC717.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtaggccactggcatccccagccccgtcttcgagtggcaggtcgggtctggggacagacttcactctcaccatccaccagcctagagcctgaagtattttgctagtttattactgtctacgctaccgtaagtaagtcggtacctactaatacttccaacgtttccggcccgtacgggtacctaaacggtggtataactacgaaaacgaacgttgtagggcttcgacctaccacgtccttagttccttctacttccctaccccg

SEQ ID NO: 111233 - DNA, 519 bp, Homo sapiens
  misc_feature: GYAE6OF01DLMYY.23.88.H11.1.454.CMB.1.raw
  modified_base (338)..(338): a, c, t, g, unknown or other
  misc_feature (338)..(338): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (511)..(511): a, c, t, g, unknown or other
  misc_feature (511)..(511): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagcccaccctgtctttgtctccgggggaacagccaccctctcctgcagggccggccagactgttgacaacgacttagcctggtaccaacagaagcctggccaggcctcccaggcctcctcatctatgatacttcagtacggccactggcactcccagccccgnttcagtggcagtgggtctgggacagacttcactctcaccatcaccagcctagacncctagaagtntttgctagtttatactgtcagcacgtagaagtgcctacaattatctacgttccggcctaggaccaagtgaatatacaaacgacgtgtgctgaccacatctcgtcttcntcctcccg

SEQ ID NO: 111234 - DNA, 548 bp, Homo sapiens
  misc_feature: GYAE6OF01B4FUA.23.88.H11.1.454.CMB.1.raw
  modified_base (537)..(537): a, c, t, g, unknown or other
  misc_feature (537)..(537): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtacgggccactggcatcccagcccgcttcagtggcaggtgggtctgggacagacttcactctcaccatcaccagcctagacgcctgaagtatttgctagtttattactgtcagtcaccgtaagaacgtcggacctacaatacttcacgtttccggcccttgggacctaagtggatacgtaccaaacgaacgttggtaggcttcggccacctactcttagttccttctnttcctaccccg

SEQ ID NO: 111235 - DNA, 602 bp, Homo sapiens
  misc_feature: GYAE6OF01CCUTI.23.88.H11.1.454.CMB.1.raw
  modified_base (264)..(264): a, c, t, g, unknown or other
  misc_feature (264)..(264): n is a, c, g, or t
  modified_base (346)..(346): a, c, t, g, unknown or other
  misc_feature (346)..(346): n is a, c, g, or t
  modified_base (400)..(400): a, c, t, g, unknown or other
  misc_feature (400)..(400): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctaggtaccaanagaagcctggccaggcctcccaggcctcctcatctatgactacttccgagtacgggccacgtggacactcccacgccccgtnttcgaggtggcctaggtcggggtctaggggacctaggtacttccactctcaccntaccaccagccctagacgtcctagaacgtatttgactagtttactacgtgtacagaccgtaaccgtaagtacgtcggtacctactaacttactcctacgtttccggcccgtacggaacctaaggtggaactacgtaccgaaacgtacgtggtacggtcgtcgacctactacgttcttcgttacttctacgttccctaccccg

SEQ ID NO: 111236 - DNA, 573 bp, Homo sapiens
  misc_feature: GYAE6OF01DRYFS.23.88.H11.1.454.CMB.1.raw
  modified_base (346)..(346): a, c, t, g, unknown or other
  misc_feature (346)..(346): n is a, c, g, or t
  modified_base (563)..(563): a, c, t, g, unknown or other
  misc_feature (563)..(563): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccggggggaacagccaccctctcctgcagggccggccagactgttgacaacgacttagcctggtaccaacagaacgcctggccaggcctcccgaggcctcctcatctatgataccttccagtacgggccacgtggcactccccagccccgtnttcgagtggctaggtgggtctgggacagtacttcactctcaccatccacagcctagacgcctagaagtattttgctagtttattacgtgtacagtcctaaccggtaagaacgtcggtaccctactaattacttcctaccgtttccggcccgttagggaacctaaggtgaattagaccgtaaacgtacgtggtgctcgaccactactcttgtacttcnttccgtcccg

SEQ ID NO: 111237 - DNA, 681 bp, Homo sapiens
  misc_feature: GYAE6OF01C9K7P.23.88.H11.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (348)..(348): a, c, t, g, unknown or other
  misc_feature (348)..(348): n is a, c, g, or t
  modified_base (614)..(614): a, c, t, g, unknown or other
  misc_feature (614)..(614): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgttactctggctcccagattccacggcgaaattgtgttgacacagtctccagccaccctgtctttgctccgggggaacngccctacctctcctgcacgggccgccagactgtnacaacgcttagcctggtaccaagagaacgcctggaccaggcctaccgaggcctcctgatcctatgtacttaccgtcaggttacggacctacgtggactctcccgagccctnttcgaggtcgactaggttcggtctagggacacgtacgtttcaaccgttcaccaccttactccgaccacggtacccgtaagtacgtccctaagtaacgttatttttcggactttaacggtttacttaacgtcgtacgtacggacccttaaacggtaagtcggttaaccggaccttaaccgtaattacgtttaccttaccggtttaccggtacccggtaacgggtaaccttaaagggtcgaactttaaccgacgtaaaccgttaacgngttacggtacctagtacccacggttatttaccgtacgttaccttaacgcctttccctccccggtaac

SEQ ID NO: 111238 - DNA, 538 bp, Homo sapiens
  misc_feature: GYAE6OF01A0YRR.23.88.H11.1.454.CMB.1.raw
  modified_base (526)..(526): a, c, t, g, unknown or other
  misc_feature (526)..(526): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggcctcctcatctatgatacttccagtaggccactggcatccccagcccgcttcagtggcaggtgggtctggggacagacttcactctcaccatccaccagcctagacgcctgaagtattttgctagtttacttactgtacagccacgtaagaagtcgcctacaatattcactttcggcctgggacctaaggtcgatactacaaacgtactgtaggctcgaccaccacttctcgttacttcncttccttccccg

SEQ ID NO: 111239 - DNA, 519 bp, Homo sapiens
  misc_feature: GYAE6OF01CFYX7.23.88.H11.1.454.CMB.1.raw
  modified_base (339)..(339): a, c, t, g, unknown or other
  misc_feature (339)..(339): n is a, c, g, or t
  modified_base (405)..(405): a, c, t, g, unknown or other
  misc_feature (405)..(405): n is a, c, g, or t
  modified_base (448)..(448): a, c, t, g, unknown or other
  misc_feature (448)..(448): n is a, c, g, or t
  modified_base (476)..(476): a, c, t, g, unknown or other
  misc_feature (476)..(476): n is a, c, g, or t
  modified_base (510)..(510): a, c, t, g, unknown or other
  misc_feature (510)..(510): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgatactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggcctcccgaggcctcctcatctatgactacttccagtaggccactggcactcccagccccgnttcagtggcaggtgggtctgggacagacttcactctcaccatccaccagcctagcgcctagaagtntttcgctagtttatactgtcagcacgtaagagtgcctcaattntactacttcggcctaggactagtgatanacaagtactgtagctgaccactatctcgtcttcnttcctcccg

SEQ ID NO: 111240 - DNA, 593 bp, Homo sapiens
  misc_feature: GYAE6OF01C5OZU.23.88.H11.1.454.CMB.1.raw
  modified_base (293)..(293): a, c, t, g, unknown or other
  misc_feature (293)..(293): n is a, c, g, or t
  modified_base (381)..(381): a, c, t, g, unknown or other
  misc_feature (381)..(381): n is a, c, g, or t
  modified_base (410)..(410): a, c, t, g, unknown or other
  misc_feature (410)..(410): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaacgcctggccaggcctcccaggctccncatctatgattaccttccaggtaggccacgtggcactccccagccccgtcttcaggtggcaggtgggtctgggacagtcttcacttcncaccatccaccagcctagacgcctgaatntttcgctagtttacttactgtcacgcctacgtaagaagtcgacctacaattacttacctacgtttccggacccgttagggaaccctaaggttacggaacttaacgtaaccgtaaaacgtaacgttcggtaggtccttcgaccctaaccgacttcgttctacctttacgcttcccgttaccccg

SEQ ID NO: 111241 - DNA, 603 bp, Homo sapiens
  misc_feature: GYAE6OF01DHJDR.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaacgcctggccaggcctcccaggcctcctcatctatgactacttcgaggtacgggccacgtggcactccccgagccccgtcttcaggtggctaggtgggtctgggaccagtaccttcactctcaccactccaccacgcctagacgcctagaagtatttgcttaagttttatacgtgtacacgtacgaaccgtaagtacggtcgtacctactaaattacttcctaaccgtttccggacccgtacgggaacctaaggtggtaacttaacgtaccgtaaacgtacgtcggtggtctcggacctaccacttccttacgttcttctacgttcccgttaccccg

SEQ ID NO: 111242 - DNA, 727 bp, Homo sapiens
  misc_feature: GYAE6OF01CWX06.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccggccagactgttgacaacgacttagcctggtaccaacagaagcctggccaggcctcccaggcctcctcatctatgactacttccgaggtacggccacgtggcactcccagcccgtcttcgagtcggctaggtgggtctggggacagtacttcactctacaccatcaccagcctagacgtcctaggtaacttagtttcgtacgttaagttttacttacgttcgtaccgtaacgtaccgtaaacccggtaaggtaaacggttccggtaccccttaacttaaaacgtttacgtttacccgttaaccggtttttaccccgggaccccggttaaggggtaaaccccgttaaagggttacgggtaaactttaaccgtaaaccggtaaaaaccggtaaccggttcgggttaaccgggtacctttaccgggaaccccttaaacccgtagtttacccgttacggtttaccctttaacccgttaacgtttccccccggtttaacccccgg

SEQ ID NO: 111243 - DNA, 544 bp, Homo sapiens
  misc_feature: GYAE6OF01B1CDB.23.88.H11.1.454.CMB.1.raw
  modified_base (524)..(524): a, c, t, g, unknown or other
  misc_feature (524)..(524): n is a, c, g, or t
  modified_base (533)..(533): a, c, t, g, unknown or other
  misc_feature (533)..(533): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccgccagactgttgacaacgacttagcctggtaccaacagaagcctggccaggctcccaggctcctcatctatgatacttccagtaggccatggcatccccagcccgcttcagtggcagtgggtctggggacagacttcactctcaccatccaccagacctagacgcctagaagtattttgactagtttatactgtcagctaaccgtaagagtcgacctacaatattccacgtttcccggccgtagggaccctaaaggtcggataactacaaacgtacgtgtaggctcgacaccatcctnttacttctntcccttccccg

SEQ ID NO: 111244 - DNA, 565 bp, Homo sapiens
  misc_feature: GYAE6OF01EZP8L.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagcccaccctgtctttgtctccgggggaacagccaccctctcctgcagggccggccagactgttgacaacgacttagcctggtaccaacagaagcctggccaggctcccaggctcctcatctatgatacttccagtacggccacgtgcatcccagcccgcttcagtggcaggtgggtctgggacagacttcactctcaccatccaccagcctagacgcctagaagtattttgactagtttatactgtcagcacgtaagagtcgcctacaattacttctaccgtttccggacccgttgggaaccctaaaggtggtaactagtaccgaaaacgtaacgtcggtaggctcgaccaacctacttcttcgttacttcctacttcccgttaccccg

SEQ ID NO: 111245 - DNA, 517 bp, Homo sapiens
  misc_feature: GYAE6OF01ARDVE.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccgcagactgtgacaacgcttagcctggtaccaacagaagcctggccaggctcccaggcctcctcatctatgatacttccagtacggccacgtggcatccccagcccgcttcagtcggcaggtgggtctgggacagacttcactctcacctatccaccagcctagacgcctagaagtatttgctagtttatactgtcagcacgtaagacgtgcctacaatacttctactttccggcctagggaccaagtgatatacaaacgtactgtgctgcacatctgtctctactctcccg

SEQ ID NO: 111246 - DNA, 630 bp, Homo sapiens
  misc_feature: GYAE6OF01A5WNE.23.88.H11.1.454.CMB.1.raw
  modified_base (335)..(335): a, c, t, g, unknown or other
  misc_feature (335)..(335): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccgccagactgttgacaacgacttagcctggtaccaacagaagcctggccaggctcccaggctcctcatctatgatacttccagtacgggccatggcactcccagcccgnttcagtggcaggtgggtctgggacagtacttcactctcaccatccaccagcctagacgcctagaacgtattttgacttagtttacttacgtgtactacgactaaccgtaagaacgtcggacccttaccgaaacttacttacctaccgttttccggaccccgttagggtaacccctaaaggtcgggtaaacttaacgtaccgtaaaaccggtaacgttcggtacggtaccgttacgaccctaacccgtacgttaccgttacggttaccttttacctacgtttccccgttacccccg

SEQ ID NO: 111247 - DNA, 614 bp, Homo sapiens
  misc_feature: GYAE6OF01BSU6V.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacagccaccctctcctgcagggccgcagactgtgacaacgacttagcctggtaccaacagaacgcctggccaggcctcccgaggcctcctcatctatgataccttccaggtacgggccacgtggccactccccgagcccccgtcttcgaggtcggctaggtcggggtctaggggacaggtaccttcacttctacaccataccaccgagccctagacgtacctagaagttatttcgtactagttttatacgttagtcagtaccgtaaccgtaagtaacggtcggtaccctactaacttacttaccgtaccgtttccggacccgttacgggaacctaaggtgtactacgtacgaaacgtacgtgtaggactcgacctactacttacgttcgttacttctacttccgtaccccg

SEQ ID NO: 111248 - DNA, 568 bp, Homo sapiens
  misc_feature: GYAE6OF01E253L.23.88.H11.1.454.CMB.1.raw
  modified_base (413)..(413): a, c, t, g, unknown or other
  misc_feature (413)..(413): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagcccaccctgtctttgtcgtccgggggaacgagcccaccctctcctgcagggccggccagactgttgacaacgacttagcctggtaccaacgagaacgcctggccaggcctcccgaggcctcctcatctatgataccttccaggtacgggccacgtggcactccccaggccccgtcttcgaggtggcaggtcgggtctggggacaggtacttcaccttctaccacctatccaaccgngtcccgtagacgctagtaagttatttgcttagtttatactgtacagacgtacgtaagagtcggacctactaattacttctacgttcgccgtaggaccaggtgatagtacgaaacgtacgtgtagctcgacactatctcgtctctcttccgtcccg

SEQ ID NO: 111249 - DNA, 858 bp, Homo sapiens
  misc_feature: GYAE6OF01A8505.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacgagccaccctctcctgccaggccgccagactgttgacaacgacttagcctaggtaccaacagaagcctggccaggcctcccgaggcctcctctatctatgacttaccttccgaggtacgggccctacgtggccactccccgacgccccgtcttcgaggttcggccgtagggttcggggtccgtaggggactacggtacctttccgaaccttccgtaccaaccctactcccaacccgtacgtaccctacggacgtacccgttaggtaaacgttagtttttacgacgtttaagtttttacctttaaccgttaggttaccgtaacggtaccgtaaacccgggttaaaggtaaccggtttaccgggtacccttaacccgttaaaacgttttaccgttttaaccccgttaaccccgggtttttaccccgggtacccccgggtttaaccggggtaaacccgttaaaacgggttccggggtaaaacttttaaaccggtaaacccggttaaaaaacccgggttaaaccgtttacgggggttaaccgggtacccgttaaccgggttaaccccgtaaaccccgttaacgtttccccggttttaaccggtttaacccctttttacccgttaaccccgtttttccccccgtttaaccccccccgg

SEQ ID NO: 111250 - DNA, 505 bp, Homo sapiens
  misc_feature: GYAE6OF01CT98D.23.88.H11.1.454.CMB.1.raw
  modified_base (360)..(360): a, c, t, g, unknown or other
  misc_feature (360)..(360): n is a, c, g, or t
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggcctcccgaggcctcctcatctatgataccttccagtagggccactggcatcccagcccgcttcagtgcagtggtctgggacngacttcactctcaccatcaccagcctagagcctgaagtattttgactagtttatactgtcagcacgtaagaagtgctcaatattcacttcgcctggacaagtgatancaaagactgngctgcacatctgtnttcnttcgtacccg

SEQ ID NO: 111251 - DNA, 533 bp, Homo sapiens
  misc_feature: GYAE6OF01BDYDM.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggcctcccaggcctcctcatctatgatacttccagtacggccatggcactcccagccccgcttcgagtggcaggtgggtctggggacagcttcactctcaccatccaccagcctagacgcctagaagtatttgactagtttattactgtacagctacgtaagagtcgacctacaatattcacgtttcgcctggacctaagtgatactacaaacgacgtgtgctcgcacacttctcgttacttctacttccgtccccg

SEQ ID NO: 111252 - DNA, 754 bp, Homo sapiens
  misc_feature: GYAE6OF01ADAC3.23.88.H11.1.454.CMB.1.raw
  modified_base (201)..(201): a, c, t, g, unknown or other
  misc_feature (201)..(201): n is a, c, g, or t
  modified_base (288)..(288): a, c, t, g, unknown or other
  misc_feature (288)..(288): n is a, c, g, or t
  modified_base (338)..(338): a, c, t, g, unknown or other
  misc_feature (338)..(338): n is a, c, g, or t
tcagacgcgagtatcacgaccggtgctcgatttagcgacagcgagaacacacaaagggggaggaactgctcagttaggacccagagggaaccatggaagcccagctcagcttctcttcctcctgctactctggctcccagattccaccggcgaaattgtgttgacacagtctccagccaccctgtctttgctccggggacngccacctctctgcaggccgcagctgtcgacacgcttagcctggtaccaacagaacgcctggccaggcctccaggctcctcattctancgtactccgttccaggtacgggcccagttggccactccccgagccccgtnttcgacggtcggctaggttcgggtactggggaccaggtacctttccgaacttcctacccaccaattcccgaaaccctcggtacccgtacggacgtaccgttacgaacggtttacttttcggtaccgtttaacgttttaacgtttaccgtttacggttacccgtaacggtacccgttaaaccccgggttaaagggttaaccggttaccgggttaccctttaaccgtaaacgttttaaccgtttacccgttaaccggtttttcccgggacccggtttacggggtaaaccccgttaacggttacgggttaaacttccggttaaaccgtaaaacggtaaccgttcgggttacggtcgttacggacccctaacggtcttccggtttacgttacccttccgttaaccgttcctttaccccgg

SEQ ID NO: 111253 - DNA, 723 bp, Homo sapiens
  misc_feature: GYAE6OF01EHTO0.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagcccaccctgtctttgtctccgggggaacagccaccctctcctgcgagggccggccagactggttgacaaccgacttacgcctaggtaccaagagaacgcctggccaggcctacccgaggcctcctacatctatcgactactccgagtacggccagtcggcactcccacgtcccgtcttcgacggtggcgtaggtcgggtctaggggactgtaccttcgactccgtactaacccactccgaccacgtacccgtaagaccgtcccgtaagtaacgttagttttcggactttaagtttaacttacgttagtacctacggaccgtaaaccgttaaggaacggttaccggtccctaacgtaaactttacgtttacccttaccgggttttccccgggacccgttacggggtaaaccctaaagggttcggtaaagttaaccgtaaccgaaaacggttaccggttcggttacggacccgttaacggaccccttaacccgtacgtttacctttaccggttactttaccccgttacttcccccggtttaacccccg

SEQ ID NO: 111254 - DNA, 695 bp, Homo sapiens
  misc_feature: GYAE6OF01CM0RS.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctcagccaccctgtctttgtccgtccgggggaacgacgccaccctctcctgcgacgggccggccagactgttgacaacgacttagccgtggtaccaacaggacgcctggccaggcctcccgaggcctcctcacttctatcgactaccttccgaaggtacgggcccacgtcggccactccccgtacgccccgtcttacgaggtcggtaccgtaggttcggggtcgttacggggaaccacgtaccgtttcgaacttccgtaccaacctagtacccacccacgtaccctacggacgtacccgtagtaacgttattttacgacttaagtttaacttacgtcgtacgagtaccgaacgtaagacgtcgtaccctacgtaacttacttctaccgtttccgaccgttacggaacccgtaaggtcggtaacttaacgtaaaccgaaacgttaacgttcgggtacgtaccgttacgaacccgtaaccttacgttaccgttacgttactttaccgtacctttcccggtaccccg

SEQ ID NO: 111255 - DNA, 676 bp, Homo sapiens
  misc_feature: GYAE6OF01C6QHE.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccggccagactgttgacaacgacttagcctggtaccaacagaagcctggccaggcctcccaggcctcctcatctatgtaacttaccttaccaggtacgggcccacgtggaccactccccagccccgcttacgaggtggactaggtggggtctaggggacagtacttcacttctaccacactccaaccacgtcctagacgcctagaagtacgttttgacttaagttttaacttacgtgttacgaacgtacccaaaccggttaaggaacgtacgggtcccttaacgtaaagtttactttaccgtaccggttttccggaccccgttaggggtaaccctaaaggtcggtaactaacgtaaccgtaaaacgttaacgtcggtaggtaccttcggaccctaaccctacgttacccgttacgtttacctttacccgtaatttccccgttaacccccgg

SEQ ID NO: 111256 - DNA, 727 bp, Homo sapiens
  misc_feature: GYAE6OF01BE4RI.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacgagccaccctctcctgcgacgggccggcagactgttagacaacgcttagcctaggtaaccaacagaacgcctggccaggcctcccgaggcctcctcatctatgactactccgaggtacggccacgtggcacgtccccagccccgtcttcgagtggcgaggtgggtcgtagggacagtaccttcactcctacacctatcccaacgacgtacctaagacgtacccgtaggtaacgtttacgttttacgactttaacgttttaatttaccgttacgttaccgaacggtacccgtaaacccggttaaaggtaacggttcccggtacccttaacctaaacgtttaaccgtttccgtaacccggttttcccgggaaccccggttacgggtaacccgtaaagggtacggttaagttaaaccgtaaccgtaaaaaccggttaccggtacggttacgggtacccgttacgacccgtaaccctaacgttccttacgttaccctttaccgtaccgtttccccgttacccccgg

SEQ ID NO: 111257 - DNA, 655 bp, Homo sapiens
  misc_feature: GYAE6OF01BB1VP.23.88.H11.1.454.CMB.1.raw
  modified_base (207)..(207): a, c, t, g, unknown or other
  misc_feature (207)..(207): n is a, c, g, or t
  modified_base (603)..(603): a, c, t, g, unknown or other
  misc_feature (603)..(603): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggcctcccagattccaccggcgaaattgtgttgacacagtctccagccaccctgtctttgtcgtccgggggaacncgccaccctctcctgcagggccgcagactgtgacaacgcttagcctcggtaccaacagaagcccgtggccaggcctcccgaggcctcctcactctatcgattaccttccgaggtacggcctagtcggcactcccagcccgtcttacgaggtcggcaggtcgggtctaggggacacggtacttcgaactcctacacctataccaccgacgtacctagacgtaccgttagtaagttacgtttgacttaggtttattaacgtgtactaacgtaccgtaacggtaagtacggttacgtacccttaccgtaattaccttacgtaccgttttacccggacccgttacgggaacctaaggtcggtaattaacgtaccgaaaccgtacgtcggtacggttaccngtaccctacctacgttaccgttacttaccttacctaccgttccgttaccccg

SEQ ID NO: 111258 - DNA, 557 bp, Homo sapiens
  misc_feature: GYAE6OF01APZI3.23.88.H11.1.454.CMB.1.raw
  modified_base (386)..(386): a, c, t, g, unknown or other
  misc_feature (386)..(386): n is a, c, g, or t
  modified_base (407)..(407): a, c, t, g, unknown or other
  misc_feature (407)..(407): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggacagccaccctctcctgcagggccggccagactgttgacaacgacttagcctggtaccaacagaagcctggccaggcctcccgaggcctcctcatctatgatacttcagtcggccactggcatcccagcccgtcttcagtggcaggtcggggtctgggacagacttcactctcacctatccaccngacctagacgcctagaacgtntttgacttagtttattactgtacagctaacgtagacgtcgcctactaagttacttcgtacttccggccctagggaaccctaaggtcgatacaccaaacgtacgtggtgctgaccaccttatccttgtaccttctacttcccgttaccccg

SEQ ID NO: 111259 - DNA, 840 bp, Homo sapiens
  misc_feature: GYAE6OF01CQE4R.23.88.H11.1.454.CMB.1.raw
tcagacgcgagtatcacgaccggtgctcgatttagcgacagcgagaacacacgaaagggggaggaactgctcagttaggacccagagggaaccatggaagccccagctcagcttctcttcctcctgctactctggctccagacttccaccggcgaaattgtgttgacacagtctccagccaccctgtctttgtccgtccgggggaacacgccaccctctcctgcgacgggccgcagtactgttgaacaacgtacttacgcctacggtaaccaacaggaacgtccgtggacccacgggccctacccgacggtccttcccgtacaacttccgttaatacgtaactttaacccgtttccgaacgggttaaccggggcccctacggttcgggaccctaaccgttacccccgacggtcccccggtactttaccgacgggttcggaccgtagggttcggggtacgtacggggaacctacggtacctttccgacgttcctaccgtaaccctacgttacccgaacccgtacggtacccgtaaggtacccggtaccgttaacggtaaagtttacgttttacgtacgtttaacggttttacgtttaccgttacggttaaccgtaacggtaacccgttaaaccggttaacggtaacggttccggtaacccttacggttaaactttaccgtttaccgttacccggttttaccggtaccccggtaacggggtaaacctaacgggttacgtaacgtaaccgtaaccgtaaaaccggtacgttcggtacggtacccgttaccgacctaaccgttcttaccgttattacccttacttaccgtttccccgtaccccg

SEQ ID NO: 111260 - DNA, 649 bp, Homo sapiens
  misc_feature: GYAE6OF01BHMQU.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaacgcctggccacggcctcccgaggcctcctcatctatgataccttccaggtacgggccacgtggaccactccccacgccccgtcttccgaggtcggcgtacggtggggtcgtggggacctaggtaccttcacctcgtaccacctactccaccgtagaccctagacgtcctagaacgttatttcgtacgttagtttacttacgttgtacacggtacctaaccggtaacgtaacggtcggtacccttacgtaaagttacttaccgttaccgtttcccgggtcccttacggggaacctaaacggttgtacgtactaccgaaacgtacgtacggtacgacgtcgacctacctacgttcttcgttaccttcctcgttcccgtaccccg

SEQ ID NO: 111261 - DNA, 702 bp, Homo sapiens
  misc_feature: GYAE6OF01CE5EG.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagcccaccctgtctttgtcgtccgggggaacgacgccaccctctcctgcgagggccgcagactgttgacaacgcttacgcctaggtaccaacagaacgcctggccaggcctcccgaggcctcctcatctatgtataccttccaggtacgggccacgtggacactcccgacgtcccgcttcgaggtcggcgtaggtcgggtcgtacggggactagtaccgttcacgtctacgactactccaccgacgtacctaggacgtacctaggtaaacgttcgttttacgacgtttaagttttaacttacgttacgtactacggtaaccgtaaccggtaacgtaacggttacggtaccctttaacgtaaactttactttacccgttaccggttttaccgggaccccgttaacgggaaaccgtaaggttacgggtaaacttaacgtaaccgaaaaaccgtacgttacgggttacgacgttacgaccctaaccgtacttcccgttagttcccttaccgtcctttccccgttaccccg

SEQ ID NO: 111262 - DNA, 612 bp, Homo sapiens
  misc_feature: GYAE6OF01DJ0AV.23.88.H11.1.454.CMB.1.raw
  modified_base (347)..(347): a, c, t, g, unknown or other
  misc_feature (347)..(347): n is a, c, g, or t
  modified_base (395)..(395): a, c, t, g, unknown or other
  misc_feature (395)..(395): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggcccggccagactgttgacaacgacttagcctaggtaccaacagaacgcctggaccaggcctcccaggcctcctcatctattgattacctcgagtacgggccacgtggcactcccagccccgtnttccgagtggactaggtggggtactggggacagtaccttcaaccttcncgtaccagtcaaccgagtccctagacgacctagtagtattttgctaagtttattactgtcagactacgtaagagtacgtacctactaattacttacgtactttccgggaccctacgggtaacctaagtacggaacgtaactaccgtaaaaccgtaacgtacggttaggacttacggacctactaacgttcttagttccttactcgtttcccgtcccg

SEQ ID NO: 111263 - DNA, 724 bp, Homo sapiens
  misc_feature: GYAE6OF01CQXW4.23.88.H11.1.454.CMB.1.raw
tcagacgcgagtatcacgaccggtgctcgatttagcgacagcgagaacacacaaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacacgcccaccctctcctgcgagggccggccagactgttgaacaacgacttagcctggtaccaacgagaacgcctggccaggcctcccgaggcctcctcaacttctatcgacttaccttaccgagtacgggcccacgtcggcactccccgacgccccgtcttccgaggtcggccgtaggttcggggtcgtggggaacctaggtactttccgacttccgtccaaccgactcccaaacccgtacgtacccgtaacggaccgtaccgttaggtaaacgtttacgttttacgtactttaaggttttaacttacgttacgtaccgtaacgtaacccgtaaaccggtaaaggtaacgggtccgtacccttaaccgttaaattaacttacccgttaccgtttcccggacccgttaacgggaacccgtaaaggtcggtaattaacgtaaaccgtaaaccgtaacgttggtacggtactcggacctaccgttattccgtacttaccttacctccgttcccgttaccccg

SEQ ID NO: 111264 - DNA, 568 bp, Homo sapiens
  misc_feature: GYAE6OF01B3SOZ.23.88.H11.1.454.CMB.1.raw
  modified_base (238)..(238): a, c, t, g, unknown or other
  misc_feature (238)..(238): n is a, c, g, or t
  modified_base (334)..(334): a, c, t, g, unknown or other
  misc_feature (334)..(334): n is a, c, g, or t
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattcccaccggcgaaattgtgttgacacagtctccagccaccctgtctttgctccgggggaacagccaccctctcctgcagggccgccagactgttnacaacgcttagcctaggtaccaacagaagcctggccaggctcccaggctcctcatcctatgatacttccagtacggccactggcatcccagcccgnttcagtgcagtggtctgggacagactcactctcacatcacagcctangctgagatttgactagtttatacgtgtacngacacgtaagaacgtggccttacaagttacttactaccgtttccggacccgttacgggaaccctaaagtaccggtaattaacgtactaaaaccgtaacttggtaggtacctgtaccaaccacgttactacgtttacctttacagttcccttaccccg

SEQ ID NO: 111265 - DNA, 812 bp, Homo sapiens
  misc_feature: GYAE6OF01B0PJ2.23.88.H11.1.454.CMB.1.raw
tcagacgcgagtatcacgaccggtgctcgatttagcgacagcgagaacacacgaaagggggaggaactgctcagttaggacccagagggaaccatggaagccccagctcagcttctcttcctcctgctactctggctcccagtattccaccggcgaaattgtgttgacacagtctccagccacctgttctttcgtccggtaccgggggaacaccggcccacccgtctcccgtagccgacggggcccggccgaggtacgttcgttacgaacaacgtacgttacgccgttaggaaccaacgaacggaacgtccgacggaccgaacggccttacccgaaggtcctttacccgtactacgttaccttagtacggtaactttaccttccgaacgggttaacggcccctaagttcggaccctacgtcccgtaacgcccgtaccgtttacgacgggttacggcggtaacgggttcggggtaccgttagggggaacctacgggttaccttaccaaccttacccgtaccaaccgtatacccgacctaacggtacgtacgacggtacgtagtaagttacgtttcgtattacgtttaacttacggtctacgtacgtaccgtaacggttaacggtaacgtcggtaccttaactacgttaacgtttccgtaaccggtttccggaccggttaacgggtaaccctaagggttacgacttaacggttaacctaaaacggtacggttacggtacggtaccgtacgtaacccgtaaacgttaccgttacgttacccgttacggttccctaaacccgttccccggtaaccg

SEQ ID NO: 111266 - DNA, 772 bp, Homo sapiens
  misc_feature: GYAE6OF01A5XYA.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacgacgccaccctctcctgcgacggggccgccagactgttgaacaacgtacttacgccgtaggtaaccaaacgagaacgccgtaggccacggcctacccgaggcctcctactactcgtatacgactttacctccgaggtacgggccacgtcggacctacgtcccgacgtccccgtcttcgaggtcggacgtaggttcgggtcgtaggggaacctaggtaccttcgactctaccaacctataccacccgtacgtaccgtaaggtaccgtaccgtaaggttaacgttacgttttacgacgtttaacgttttaaacgttaccgttacgtacgtaacgtaccgtaaaccggttaacggtaacggttaccggtaccttaacgttaaactttacgttacccgttaaccggtttcccgggtacccgttaacggggtaaacctaaagggttacggaaaccttaacgtaaacccggtaaaacggtaaccgtttcggggtaccggtacgtcgtaacccctaaccgtttacgttaccgtttacgttacctttaccgttaccggttccccttaacccccgg

SEQ ID NO: 111267 - DNA, 750 bp, Homo sapiens
  misc_feature: GYAE6OF01DL12N.23.88.H11.1.454.CMB.1.raw
  modified_base (209)..(209): a, c, t, g, unknown or other
  misc_feature (209)..(209): n is a, c, g, or t
  modified_base (475)..(475): a, c, t, g, unknown or other
  misc_feature (475)..(475): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagacttccaccggacgtaaattgtgttgacacagtctccacgccacctgtctttgtccgtccggggaacncgccaccctctccgtgcgacgggccgcagtctgttacgacaacgtactagtcctacggtaaccaacgagaacgtccgtacggaccgacggtccctacccgacggtcctcctactacttcctattacgtactttacctccgagggtaccgggacctacgtcggaccaaccgtcccgacggtcccgtcgttacgacgggtaggccgtagggtcggggtacgtaccggggactaacggtaccttacacccgttactacccgaccctaanacccgtaccgtaccggacccttaggacccgttacgtaggtaacgtttgtttacgtaactttaggtttaacttaccgtacgtaccgtacgtaaccgtaacggtaacggtaacgttcgtaaccttaacgttaattacgtttaccgttacccggttcccggaccgttacgggtaaaccgtaggttaacgtaactacggtaaccgtaaacgtaccggtcggtacggtacctacgtaaccctacgtacttcgttactacttcccttagtccccgttaccg

SEQ ID NO: 111268 - DNA, 740 bp, Homo sapiens
  misc_feature: GYAE6OF01AFOF0.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagtacttccaccggacgtaaattgtgttgacactagtctccagcccaccctgttctttgtccgtccgggggaacgacgcccaccctctccgtgcgacgggccgccagtacgtgtacgacacgtacttacgcctacggtaaccaacgagacgccgtcggccgacggcctcccgacggtccttccgtactacttactatacggtactttaccttaccggacggtaccgggaccctacggtcggacctaccgtcccccgaccgtccccgttccgttacgacggtcggacggtacggttcgggtacggtcgggaacgtacgttaccttctaccgtccctaccaacctactccaaccgtcgtaaccgtaggaccgtactaaggtaagtttctttacgtacttaacggttttacttacgcgttacacgtaacgtaaccggtaagtacggtccgtaaccttaacgtactttacgtccgtttacccggttacccggaccggtaacggaacgttaaggtaccgttaataccgtaaacgaaccggttgttcggtacgccttccggaactccttacgttcccgtacttccctttctacccttcccgttcccc

SEQ ID NO: 111269 - DNA, 582 bp, Homo sapiens
  misc_feature: GYAE6OF01C7VTH.23.88.H11.1.454.CMB.1.raw
  modified_base (404)..(404): a, c, t, g, unknown or other
  misc_feature (404)..(404): n is a, c, g, or t
  modified_base (569)..(569): a, c, t, g, unknown or other
  misc_feature (569)..(569): n is a, c, g, or t
tcagacgcgagtatcacgaccggtgctcgatttagcgacagcgagaacacacaaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccgccagactgtgacaacgacttagcctggtaccaacagaacgcctggccaggcctcccgaggcctcctcatctatgataccttaccaggtaggccactggcactccccagcccgcttacgagtggcaggtgggtctggggacagtacttcactctcaaccactcaaccagcctagacncctagtaatattttcgcttaagtttatactcgtacaacgtcctacgtaagtacgtcggtacctacaacttacttcctaccgtttcgaccgtagggaacctaaggtcgaataactacgaaacgtacgtcgtaggtctcgacaacctacgttacttcgttacttacncttccgtaccccg

SEQ ID NO: 111270 - DNA, 782 bp, Homo sapiens
  misc_feature: GYAE6OF01CQGXD.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtccgtccgggggaacgacgcccaccctctcctggcgacggggcccggccagacttgttacgaaccaacggtacttacggccgtacggtaccaacgaaggaacgcccgtgggacccaacggccctacccgaggtcccttccctacattctatcgtacttaccgttccgaggtacggggccctacgtcggcctactccccgacgcccgtcttcgacgtggctggtcgggtcgtgggaccagtacttccgacctctaccaacctctaccaccgacgtccgtaacggaccgtacctacggtaagttacgttttacgactttaagttttaactttaccgttacgtacgtaacggtaaccgtaaaccgggtttaaggtaacggtaccggtacccgtttaactaacgtttaccgtttacccgtttaaacccggtttcccggtaccccggttaacgggtaaaccgtaacgggtaggtaaacgtttaacgtaaacccgtaaacgttacccggtaggttaccgggaccgttaccggtaaccctaaccgtacgtttaccgttacccgtttacttacccggttaaccttccccttacccccgg

SEQ ID NO: 111271 - DNA, 758 bp, Homo sapiens
  misc_feature: GYAE6OF01B5R2Z.23.88.H11.1.454.CMB.1.raw
  modified_base (382)..(382): a, c, t, g, unknown or other
  misc_feature (382)..(382): n is a, c, g, or t
tcagacgcgagtatcacgaccggtgctcgatttagcgacagcgagaacacacaaaggggggaggaactgctcagttaggacccagagggaaccatggaagccccagctcagcttctcttcctcctgctactctggctcccagacttccaccggcgaaattgtgttgacacagtctccagccacctgttctttgtccgtccgggggaacgacgcccaccctctcctgcgacgggccgccagactgttgacaacgtacttagccgtacggtaaccaacgagaacgccgtcggccgacggcctcccgacggtcctcctcactactatgtactaccttaccgtacggtacgggtacccacgggggggggggggggggggggggtcnccgtacctaccccgaccggccccgtccgttccgacggtcggtcgtacggtcggggtcggtacggggacgacgtaccttacctacctacctacctacctactaccacccgacgtaccgtacgacgtaccgtacgtaacgttagtttcgtacgttacgtttaacttacgttacgtacgtacgtaccgtaaccggtaacggtaacggtacggtaccctacctaacttaactttaccgttaccgtttacccggtacccggttacgggtaacccgtaacggtacggtaacgtaacgtaaccgtaaaccgtaacgtacggtacggtacgtcgtaccgtacctacgttacgttacgttacctttacctccttcccgttacccg

SEQ ID NO: 111272 - DNA, 785 bp, Homo sapiens
  misc_feature: GYAE6OF01CNX5H.23.88.H11.1.454.CMB.1.raw
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacgacgcccaccctctcctgcacgggccggccagactgtgacaacgacttagcctggtaccaacagaacgcctggccaggctcccaggctcctnatctangatacttccgagtacgggccacgtggaccactccccaggtccccgtacttccgacgggtcggaccgtagggttcggggtaccgtagggggaacctaacgggtaccctttccgaccctttcctacccaaccctacgtacccaacccgacgtaccgtaacggtaccgtacccgttagtaaacggttacgtttttacggtacgttaacggtttttaacttaccgttacgggtacctaaccggtacccgtaaacccggttaaacggtaaacgggttcccgggtaacccttaaccgttaaacgtttaacctttacccgttaacccggtttttacccgggaaccccgttaacggggtaaacccgtaaagggttaacggtaacgttaaccgtaaccgtaaaaccggtaacgttcggtacgggtacctaccgtaccgtaaccgtacgttaccttacgtttaccttaccgtacctttccccggttaccccg

SEQ ID NO: 111273 - DNA, 663 bp, Homo sapiens
  misc_feature: GYAE6OF01ALNNE.23.88.H11.1.454.CMB.1.raw
  modified_base (435)..(435): a, c, t, g, unknown or other
  misc_feature (435)..(435): n is a, c, g, or t
tcagacgcgagtatcacgaccggtgctcgatttagcgacagcgagaacacacaaagggggaggaactgctcagttaggacccagagggaaccatggaagccccagctcagcttatcttcctcctgctactctggctcccagattccaccggcgaaattgtgttgacacagtctccagcccaccctgtctttgtccgtccgggggaacgacgccaccctctcctgccgagggccgccagactgttacgacaacgacgttagcctggtaaccaacgagaacgcctggccaggcctccgaggtcctcctcattctatcgtacttaccttccgaggttacggcccacgtcggccacttccccaggcccccgtcgttcgacggtggccgtagggttcggggtcgtacggggactaggtaccttcgactccgtaccacctntacccaccgacgtccgtacgacgtccgtaagacgttagtttcgtacttagtttacttactgtaccacgaccgtaacgtaacgtacggtacgtcctaactaacttacttcgttaccgttccggaccgttacgggaactaaggtcgtaactacgtaaaccgtaacgtacgtggtacgtcgtacgacccgtaacctacgttccgtcgtacctctaccgttcccgttacccg

SEQ ID NO: 111274 - DNA, 785 bp, Homo sapiens
  misc_feature: GYAE6OF01D73TG.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattcccaccggcgtaaattgtgttgacacagtcctccagcccacccttgttctttgtccgtaccgggggaacacgcccacccctctcctgccgacggggcccgaccgagtacgttggttacgaacctaaaccggtaccttacgacccgtacggtaaaccaaacgaggaacgtccgtacggacccgaggcctccccgaaggtcctacctccaagttactagtacgtaacttaccgttacgtaacgggtaacgggccctaaggtcggtaccctaaccgtccccgaccgccccggtactttacgaggtcggacgtaggtcgggtacgtaggggaactacggtaccttaccacctccgttacaccctatacccgaaccgtacggtacctagtacgtaccgtaaggtaagttacgtttcgtaacgttaagtttacttaccgttagtacctaaggtaaccctaacgggtaagtacggtacgtaccctaacttaaacttacttaccgttaccggtttaccccggtacccggtaaggaaacccgtaaggtaccggtaacttaacgtaaccgtaaaacggtacgtacggtacggttaccgagtaacccgtactaccgttacttacgttaccttacgtccttaccccgttcccg

SEQ ID NO: 111275 - DNA, 759 bp, Homo sapiens
  misc_feature: GYAE6OF01DHU9P.23.88.H11.1.454.CMB.1.raw
  modified_base (202)..(202): a, c, t, g, unknown or other
  misc_feature (202)..(202): n is a, c, g, or t
tcagacgcgagtatcacgaccggtgctcgatttagcgacagcgagaacacacaaaggggggaggaactgctcagttaggacccagagggaaccatggaagccccagctcagcttctcttcctcctgctactctggctcccagattccaccggcgaaattgtgtgacacagtctccagccacctgtctttgtcgtcggggacncgccaccctctcctgcgagggccgccagactgttgaacaacgtacttagccgtcggtaccaacgaggaacgccgtggcccacggcctacccgaggtcctcctcattctatgaattaccgttccaggtacggccacgtggacactccccgacgcccgtctcgaggtgcgtaggttggggtactaggggactagtacctttccaccgttcctccaacctacgtacccaacccgtaacggtcccttaacgggacgtcccgttaagggtaaacgtttcgtttttacggacgtttaaaggtttttaactttaccgttacggtacctaacgggtacccgttaaaccggtaagttacgggtacccggtacccttaaccgttaaaatttctttacccgttaccgggttttcccgggaaaccccgttaggggtaacccgttaaggttaggtaacctaaccgttaaccgtaaaacggttaaccgttgggtaccgtacccgtttggaccccgtaaactccgtttaccttagtttaccccgttacttacccggtttccccttaccccgg

SEQ ID NO: 111276 - DNA, 702 bp, Homo sapiens
  misc_feature: GYAE6OF01B1T9I.23.88.H11.1.454.CMB.1.raw
  modified_base (210)..(210): a, c, t, g, unknown or other
  misc_feature (210)..(210): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagcccaccctgttctttggtccgtccgggggaacncgcccaccctctccgtgcgacgggcccgcagtctgtacgaacaacgtacttacgcctggtaaccaagaggaacgccgtggacccgaggtccctcccgagggtcctcccgtcaacttctaatcgtaactttaccgttcgaaggtccgggaccctagtcggccactccccgacggtcccctcgttcgaggtcggacgtagggtcgggtccgtaggggacctacgtaccttacctacgtcctaccaccctatacccgaacctacggtacctacggacgtaccgtagtaagtttactttgactttacgtttactacgtacgtacgtacgtaccgtaacggtaagtcggtacgtacctaactacttaccgttcgttaccgttccggacccggttaacggaacgtaacggtcgtaactaacgtacgaaacgtacggtggtacgtactcggacctaccgtcgttcttacggttccttaaccgtccgtttcccgtacccg

SEQ ID NO: 111277 - DNA, 689 bp, Homo sapiens
  misc_feature: GYAE6OF01EB4CQ.23.88.H11.1.454.CMB.1.raw
  modified_base (234)..(234): a, c, t, g, unknown or other
  misc_feature (234)..(234): n is a, c, g, or t
  modified_base (346)..(346): a, c, t, g, unknown or other
  misc_feature (346)..(346): n is a, c, g, or t
tcagacgcgagtatcacgaccggtgctcgatttagcgacagcgagaacacacgaaagggggaggaactgctcagttaggacccagagggaaccatggaacgccccagctcagtcttctcttcctcctgctactctggcctaccagtacttccgaccggacgtaaagttgttagttcgacacgtacgtcctccgacgaccctaccttgttcgtttcggtccggtaccggggaacncgtccctaccgtctccgcgcgacgggccgacagtactgtacgacgtacgtacgttcgccgtacggtaaccagagacgtccgacggaccgacgtcctaccgacgccttcgtanatctagtctactacttcgacggtaccggcctacgtgaccactccgaccgtccgtatcgaggtcgcgtacggtcgggtacgacggactacgtctactcgtacctactaccgtctaccgacgtcgtaccgtaggactaccgtagtagttcttgtaccttagttactcgtactacgacgtacgaacgttaggtaccgtcgtaaccctgttaacgtttcctaccgttaccggtacccggtaccgtaagggtaaccgtagttacgaactttaccggaaactaacggttcgtggtacgacctcgaacctacgtacttcggttactactttaccgtccgtcccgtaaccg

SEQ ID NO: 111278 - DNA, 663 bp, Homo sapiens
  misc_feature: GYAE6OF01EESDR.23.88.H11.1.454.CMB.1.raw
  modified_base (220)..(220): a, c, t, g, unknown or other
  misc_feature (220)..(220): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacagcccaccctctccngcagggccgccagactgttagaccaacgacttagccgtaggtaaccaacgagaacgccgtggccaggcctcccgaggctcctcatctatgattacctccgaggtacgggccacgtcggctactccccgacggccccgtcttcgagtcggcgtaggtcgggtcgtagggaccagtaccttcacctctaccacctactccaaccgacgtaccctagaccgtccgtagtaacgttagttttacgacttaagttttacttacgtgtactacgacctaacggtaagtaacggtacgaccttactaacttacttaccgtaccgtttaccggcccggttacgggtaacctaacgggtcgtaactaacgtacgtaaaacgtacgtcggtacggtacgtacgacccgtaactacgttcgttacgtaccctttactacgttcccgttaccccg

SEQ ID NO: 111279 - DNA, 809 bp, Homo sapiens
  misc_feature: GYAE6OF01DJGFS.23.88.H11.1.454.CMB.1.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggcctcccagattccaccggcgaaattgtgttgacacagtctccagccacccttgtcctttgtccgtccgggggaacncgccaccctctcctgcacgggccgccagtactgttgaacaacgacttagcctaggtaccanagaacgccnggccaaggcctacccgaggcctcctacatctatgactaccttcgaggtacgggccctacgtggacctactccccgacgccccgtcttcgaaggttcggactacgggttgggtaccgtagggggaacctaacgttaccgtttacccaacctttcccgtacccgtaaacccctaacttacccgaaaccccgtaaccggtacccgttaacggaccggttaccccgtaagggttaaacgtttaacgttttttcggtaaccgtttaagggttttttaacttacggttaccggttaacgtaaccgtacccggtaaaccgggttaaacggttaacgggttaccggtacccttaccgttaaacttccgtttacccgttaccgtttccccgggacccgttaacggggaacctaaagggttacggtaaacttaacgtaaaccggtaaaccgtaaccggtaggtaccggtacgtccgtaaccctacccgtaacttcccggttaacgttccctttaacgtccgtttccccggttacccccg

SEQ ID NO: 111280 - DNA, 619 bp, Homo sapiens
  misc_feature: GYAE6OF01DSHXV.23.88.H11.1.454.CMB.1.raw
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
tcagacgcgagtatcacgaccggtgctcgatttagcgacagcgagaacacacaaaggggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacgagccaccctctcctgcagggccgccagactgttgacaacgacttacgcctaggtaccaagagaagcctggccgaggcctcccgaggctcctcatctatgactacgttacaggtacggccacgtggcactcccgacgccccgtcttcgaggtcgcgtacggtggtcgtagggacagaccttcacttcncacctanccacacgcagcgactagtatatttgntagtttatctgtacagactaacgtaagtacgtcgtacctactaacttacttaccttacgttcccgggtaccgttacgggaaaccgtaaggtacggtaaactacgtaaacgtaaacggtaacgttggtacggtccgtagaacccgtacgtacttccttacggttccttaaccgtccgtttcccgttacccccg

SEQ ID NO: 111281 - DNA, 629 bp, Homo sapiens
  misc_feature: GYAE6OF01EKX4T.23.88.H11.1.454.CMB.1.raw
  modified_base (296)..(296): a, c, t, g, unknown or other
  misc_feature (296)..(296): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagcccaccctgtctttgtcgtccgggggaacgagccaccctctcctgcagggccggccagactgttgacaacgacttagcctggtaccaacagaacgctggccaggctcccgaggctcctnatctatgactaccttccgaggtacggccacgtggcactcccacgcccgtcttacgagtcggctaggtcgggtcgtggggactaggtacctttcgacttctccaaccatccaaccagtcctagacgtcctagtaagttagtttgactagttttattacgtgtacagtccgaacgtaagacgttcggacctactaacttattaccgtacgtttccggacccgttacgggtaaccgtaaaggttcgtaacttaacgtaccgtaaaacgtaccgtgggtacgtcgtcgacctaccgacgtttaccttacgttaccttccttccgttccgtacccccg

SEQ ID NO: 111282 - DNA, 648 bp, Homo sapiens
  misc_feature: GYAE6OF01DGW02.23.88.H11.1.454.CMB.1.raw
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggcctcccagattccaccggcgaaattgtgttgacacagtctccagccaccctgtctttagtcgtccggggggaacacgccaccctctcctgcgagggccggccagactgttgacaacgacttagcctaggtaccaacagaacgcctggccaggcctcccagctccncatcangatactcagtaggccatggcactcccacgccccgcttaccgagttcgggactaggtcgggtcgtaggggacacggtacctttacaactcgtcacccagtaccaaccgtacgcctaagaccgacccgaaagttatttacgtactagtttaacttactgtacagtaccgaaccgtaagtaagtcggaccttacgtaataactttcctaaccgttttccggacccgttacgggaacctaaggttacggaacttaaacgtaaccaaaacggtaactaggtacgtacgtacggtaccaaccgtacttaccgttacgttaccttactaccgttcccttcccggtaaccc

SEQ ID NO: 111283 - DNA, 880 bp, Homo sapiens
  misc_feature: GYAE6OF01AOMTN.23.88.H11.1.454.CMB.1.raw
tcagacgcgagtatcacgaccggtgctcgatttagcgacagcgagaacacacaaagggggaggaactgctcagttaggacccagagggaaccatggaacgccccagctcagcttctcttcctcctgctactctggctcccagacttccgaccggacgtaaattgtgttcgacactagtcctccagcccaccctgttctttggtccgtaccgggggaacacgtcccaccctctccgtgcgacgggccgccagtcttgtacgacaacgtacttacgccgtacggtaaaccaacgacggaacgcccgtacggaccgaacggccctaccgacggtcctcctacacgttctaatcgtaccttacgttaccgaaggtaccggacctacggtacggcctaaccgtccccgaaccggtccccgttacgttcgtacggggtcggtaacggtcgggtttaccgggggtcgtaacgggaacgtacggttaacctttccgtaaccttaccttccgaaacccttactaccccgaaaccggtaccttacccggtaagtaccggtacgttaacgggttaacgttaacgtttttacggtaaccgttttaagttttaaaccgttacggttaaccgttaccgtaaccgttaacccggtaaacggtaaacgggttaccggtaccggttacccttaaccgttaacgtttaaccgttacccggttaccggtttaccccgggtaacgttaaccgggaacgttaaacggtcgggttaaaaccttaacggtaaacccgtaaacgggttacggttaccgggttagaccggttaaccgtacccgttaacgtacccgttttacgttacccgtttacccttcgtttaccccgttccccggttaacccc

SEQ ID NO: 111284 - DNA, 773 bp, Homo sapiens
  misc_feature: GYAE6OF01BOQOL.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacgagcccaccctctcctgcagggccgcagactgttgacaacgcttagcctggtaccaacagaacgcctggccaggcctcccgaggcctcctcatctatgactaccttccaggtacggcctacgtggaccactccccgacgtccccgtctttacgacggtggacctagggtcggggtcctagggggacctaggtaccctttccgaaccttcctacccaaccctactcccaaccctacggtacccgtaaggaccgtacccgtaggtaacgttatttttacggaccgtttaagttttaacgtttaccgttacggttactaacggtacccgtaaaccggttaacggtaacggttccggtaccccttaacgtaaactttaaccgtttacccgttaacccggttttcccgggtaccccggtttaacggggtaacccgttaaacgggttacggtaaactttaacggtaaaccgtaaaaccgggttaacgttcgggttacgggtaccgttacggaccctaacccgtacgttccgtttacgtttaccctttaccgttaccgtttccccgttacccccg

SEQ ID NO: 111285 - DNA, 808 bp, Homo sapiens
  misc_feature: GYAE6OF01DOJ3L.23.88.H11.1.454.CMB.1.raw
tcagacgcgagtatcacgaccggtgctcgatttagcgacagcgagaacacacaaagggggaggaactgctcagttaggacccagagggaaccatggaacgccccagctcagcttctcttcctcctgctactctggcctcccagtacttccaccggacgtaaatttgttcgttgaccactacgttcctaccacggccctacccttgttcttttcggtccggtacccggggggaacacgacccctacccgttcctccgtcgacgaccggggcccggtaccaaggtacttacggttcgaacctaaaccggtacctttaacggtcccgtaagggtaaaccccaaacgaacggtaaaccgcccgttaacgggcccgaacggtacccttaccccggaggtcccttacctcctaattccgtattacgtaacgtttacccttaccggaggtaccggaccctaacggtcggaccacctccccgtacgtaccccgtccttacgaggtccggacgtacgggttcggtacgtagggaccctacggtacttcgaccttccaccctaacacctacaacccgtaacgccgtacgacgtaccgtacgtaactttacgttacgttacgtttagtttaaccttacgttacggtacgaaccggtaccgtaaaccggtaaggtaccggtacgtacccttactaactttaccttaccgttaccgttcccggtaccggtacggaacgttacgacggtaactacgaacgaacgtacggtcgtacgtacgtacgacctaacgtctacttcgtaactctaccttcctaacccg

SEQ ID NO: 111286 - DNA, 749 bp, Homo sapiens
  misc_feature: GYAE6OF01BBNSR.23.88.H11.1.454.CMB.1.raw
  modified_base (141)..(141): a, c, t, g, unknown or other
  misc_feature (141)..(141): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctccagnttccgaccggcgaaattgtgttgacacagtctccagccaccctgtctttgtcgtccgggggaacacgccaccctctcctcgcgaggggcccggccagtacttgttacgaccgtaaccgtacgtttacggcccttacgggtaaccaaacgtaaggaaccgtcccggtacgggacccacggggtccctaccccaacggggtcccttccctactacttcgttaagtacgtaacgttaccgttaccgagggttaccgggaccctacgtcggacctccgtaccccgtacggtcccccggtcttacgacgggttcggacggtacggttcggggtactacggggaacctacggtaccttacgccttaccgtacccaaccacgtacccgacctacggtacccgtaggactaccgtagtaacgttcgtttacgtacgtttattacgtacttacgaaactacgtacctaacgtcgtccgtcgtacgtacggacgttacggaccgtaagggtaccgaaggtaacgtaacgtacgtaaacggtcgtgtacgtacgtgaccttacacggttcttaccggttacttcccgtacgtttccccacgtaccctgttccgtaaacg

SEQ ID NO: 111287 - DNA, 656 bp, Homo sapiens
  misc_feature: GYAE6OF01BXMGD.23.88.H11.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (361)..(361): a, c, t, g, unknown or other
  misc_feature (361)..(361): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgctccgggggaacngccaccctctccngcaggccgcagactgtagacaacgacttagcctggtaccaagagaacgcctggccaggcctcccgaggcctcctacatctatcgactaccgttcccgaaggtacgggccctaacgtcggacctaccgtccccgacgtccccgtnttaccgaggtcggctaggtcgggtcgtaggggacctaaggtaccttcgaccttcctccacctactcccacctacggcctaagacgtacctaggtaacgttattttagactttagtttacttacgtcgtacacgtacgtaaccgtaaggtacgtcggtaccttacaacttacttaccgtaccgtttcggaccgttacgggtaacctaaaggtgtaactacgtaccgtaaacgtacgtcggtacggtactccgacctaactgttacgttactaccgttactccgttcccgtaccccg

SEQ ID NO: 111288 - DNA, 669 bp, Homo sapiens
  misc_feature: GYAE6OF01EMYP2.23.88.H11.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (303)..(303): a, c, t, g, unknown or other
  misc_feature (303)..(303): n is a, c, g, or t
tcagacgcgagtatcacgaccggtgctcgatttagcgacagcgagaacacacgaaaggggggaggaactgctcagttaggacccagagggaaccatggaagccccagctcagcttctcttcctcctgctactctggcctcccagacttccgaccggagaaattgtgtgacacagtctccagccaccctgtcttgtcgtccgggggaacngcccaccctctcngcgagggccgcagctgtacgacaacgacttagcctagaaccaacagaacgccgtggaccgaggcctaccgagtcctcctanatactatagacttacctcgtaaggtacgggacctagtcggaccactcccacgccctactgaggttcggactagggtcgggtcgtacgggaactacggtactttaccacgtctaccaaccgtactcgaaacccgtacgtaccgtaagacgtacctaaggttaagttacgttttagacttaagttttaacgtaccttgtacgaacgaccgtaacgtaagtaacgtccggacctaacgtaacttacttaccgtacgttcccggtaccgtaacgggtaactaaggtaggaatacgtaaaccgtaaacgtaatgggtacggtctcggacccaacgtacttacgttataccttactaaccttcccggtaccc

SEQ ID NO: 111289 - DNA, 715 bp, Homo sapiens
  misc_feature: GYAE6OF01D06SW.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagacttccaccggcgaaattgtgttgacacagtctccagccacctgtctttgtcgtccggggaacgacgccaccctctccgtcgccgacgggcccgaccgacgtactgttacgaaccgaacgtacttacgcctacggtaccaacgagaacgccgtcggaccgacggccctacccgacggcctcctacgtactcgtatacgacttacctcgaggtacggccacgtcgcactccacgccgtcttacgagtcggacgtaggtcggtacgtacggactacgtaccttcgacctctaccgactactaccacacgccgtaagaccgtacgtaagaagtttacgttttacgactttacgtttaacttacgtacgttacgaccgtaccgtaacggtaacgtacggtccgtaaccgttactaatttaccgttaccgttaccggttttacccgggtaccgttaacgggtaacgtaaggttacgtaacgttaacgtaaccgtaaacggtacgtcgggttaggtacccgtagaacccttaccgtacttacccggttacgtacctttactcccgttccccgttaacccg

SEQ ID NO: 111290 - DNA, 627 bp, Homo sapiens
  misc_feature: GYAE6OF01BYTMY.23.88.H11.1.454.CMB.1.raw
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (608)..(608): a, c, t, g, unknown or other
  misc_feature (608)..(608): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccacctctcctagcacgggccgccagactgtcgacaacgtactagcctaggtaccaacgagagcctggccacggccgtacccggctccgtcatctatgactacgtccagtcggaccngtggcacgtcccgagtcccgacttnagtcggcgaggttcggtcgtaggactagtctcactcncaccntacaccagccgtataacgccgtagtaacgtatttcgacgttagtttaacgttactcgtacgagtccaaaccggtaaggtaaccgtcggtacccttacaaagtccgtttaactaccgtttacccggtccgtacgggtaaccctaaggtagtaacttagtaacctaaacgaagttcgtacgggctacggacccgttacgtaacttccgtaagtcccttanacctccgttaccccgtacc

SEQ ID NO: 111291 - DNA, 782 bp, Homo sapiens
  misc_feature: GYAE6OF01EN6YM.23.88.H11.1.454.CMB.1.raw
tcagacgcgagtatcacgaccggtgctcgatttagcgacagcgagaacacacgaaagggggaggaactgctcagttagggacccagagggaaccatggaagcccagctcagcttctcttcctcctgctactctggctccagattccaccggcgtaaattgtgttgacacagtctccagccacctgtctttgtcgtccgggggaacgacgccaccctctcctgcgacggggccgccagactgttacgacaacgtacttacgccgtacggtaaccaacgagaacggtccgtggacccgaacgggccctacccgaggtcctccctacaacttctaagtagaactttaccgttaccgtagggttacgggacctacggtcggacctaccgtcccgacgtccccgtcttccgaggttcggacgtaggtcggggttcgtacggggaactacgtacttaccgtactcgtaccacctacgtacccgaaccgacggtaccctacggaccgttccgtaaggtaactttacgttttacggaactttaacggttttagttaaccgttggtaccgaacgtacccgttaaccggttaaaggaacgttccggtaccctaacgtaacgtttaacttccggttacgttttacccgggaccggttaacggggaaaccgttaaacgggttacggtaacttaaccgtaaaccgtaaaaccggttacgtacgggttacggccgttacgacccgtaccgtaacgtttccgttacgttcctttacgttaccgtccccgtttccccg

SEQ ID NO: 111292 - DNA, 644 bp, Homo sapiens
  misc_feature: GYAE6OF01B00OX.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgatactctggctcccagacttccaccggcgaaattgtgttgacacgagtctccagccaccctgttctttgtcgtccgggggaacgacgcctaccctctcctgcgacggccggccagtctgtgacaacgtacttacgcctaggtaccaacgagaagccgtcggccaacggcctcccgaggtcctcctctactctatgacttaccttccgaggtcgggtaccacgtggccactccccgacggaccctcgttacacggtggacgtaggtgggttcgtagggacagtacctactctcctaccacgtactccaacacgtctagacgtctagaattcgtttgtacttagtttaacttacgtgtactacgtaccgtacggtaagcggtacgtacctaactaacttacgttccgtaccgtttccggaccgttacggtaaccgtacggtagtaactaacgtacgtaaaacgtcgtagggtagcctaggaccctacgtaactctacggtttctcgttctcccgttacccg

SEQ ID NO: 111293 - DNA, 924 bp, Homo sapiens
  misc_feature: GYAE6OF01CIGZ3.23.88.H11.1.454.CMB.1.raw
  modified_base (318)..(318): a, c, t, g, unknown or other
  misc_feature (318)..(318): n is a, c, g, or t
tcagacgcgagtatcacgaccggtgctcgatttagcgacagcgagaacacacaaagggggaggaactgctcagttaggacccagagggaaccatggaacgccccagctcagcttctcttcctcctgctactctggcctcccagacttccgaccggacgtaaattgtagttgacactagtcctccacgccctacccttgttctttcggtccggtaccgggggaacgacgaccctaccctcctccgtcggacgacgggccggccgagtacgttcgttacgaaccaacgtacttacgccgtacgtaccaacagacgtccgnggaccgaggccgtaccgaggtacctccgtacacttcgtattctacttaccgttacgacggtaccgggaccacgttcggacctaccgtaccccgccggtacccgtcgttaccgagggtcggacggttcggttcgggtacgacggacgtacgtacccgtttacacccgtactacctaccgacctaaccacccgtaaccgtaccgtaacggtacccgtaccggttaaggttaacgttttacgtttaggtaaccgttttaacgttttaacctttaccggttacggttaacgtaaacccggggttaacccgtttaaacccgggtaaagggtttaaccggtaccccggtttaaccttaacccgtttaaacgttttacccggttttaacccccggtttacccggggttttacccccgggtaaccccggtttaacggggtaaaaccccggttaaggttacccgtaaacgggttttaaccggtaaaaaccggtaaacccgggtttaaccgggtcggggtttaacccgccggttaacccggaacccttaacccgtttaccgtttacccggtttagttccccgtttaacttacccccggtttccccgtttacccccg

SEQ ID NO: 111294 - DNA, 516 bp, Homo sapiens
  misc_feature: GYAE6OF02GM9ZC.23.88.H11.1.454.CMB.1.raw
tcagacgcgagtatcacgaccggtgctcgatttagcgacagcgagaacacacaaaggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtagggccactggcatcccagcccgcttcagtggcagtgggtctgggacagacttcactctcaccatcaccagcctagagcctgaagtattttgctagtttattactgtcagcaccgtaagaagtggcctcaatattcactttcggccctggaccaaagtgatatacaacgtacgtgtagcgtgcaccatctcgtctactatcctcccg

SEQ ID NO: 111295 - DNA, 508 bp, Homo sapiens
  misc_feature: GYAE6OF02HW3RP.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagcccacctgtctttgtctccgggggaacgagccaccctctcctgcagggccgccagactgttgacaacgacttagcctggtaccaacagaagcctggccaggctcccaggctcctcatctatgatacttccagtagggccactggcatcccagcccgcttcagtggcagtgggtctgggacagacttcactctcaccatccaccagcctagacgcctgaagtattttgctagtttattactgtcagcacgtaagagtgcctcaatatctacttcgcctggaccaagtgatatacaacgactgtgctgcaccatctgtcttctactcttcccg

SEQ ID NO: 111296 - DNA, 501 bp, Homo sapiens
  misc_feature: GYAE6OF02ID58D.23.88.H11.1.454.CMB.1.raw
  modified_base (398)..(398): a, c, t, g, unknown or other
  misc_feature (398)..(398): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccggccagactgttgacaacgacttagcctggtaccaacagaagcctggccaggctcccaggctcctcatctatgatacttccagtagggccactggcatcccagcccgcttcagtggcagtgggtctgggacagacttcactctcaccatcaccagcctagacgcctgaagnttttgctagtttattactgtcagcacgtagagtgcctcatatcacttcgcctggaccaagtgatatacaacgactgtgctgccacatctgtcttcatctcccg

SEQ ID NO: 111297 - DNA, 582 bp, Homo sapiens
  misc_feature: GYAE6OF02H87I5.23.88.H11.1.454.CMB.1.raw
  modified_base (262)..(262): a, c, t, g, unknown or other
  misc_feature (262)..(262): n is a, c, g, or t
  modified_base (353)..(353): a, c, t, g, unknown or other
  misc_feature (353)..(353): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggcagactgttgacaacgacttagcctggtaccaanagaagcctggccaggctccaggctcctcatctatgatacttccagtaggccactggcactcccagccccgcttcaggtggcaggtgggtcngggacagacttcactctcaccatccacagcctagacgcctagaagtattttcgactagttttaacttctagtccaacggtaccaaccggttaaagaagtcggcccttacctaaattacttcctaaccgttttccggacccgttagggaacccaaaggttcgaatactaccgaaacgtacgtggtacggctcgaccactactctagttacctactaccttccttaccccg

SEQ ID NO: 111298 - DNA, 519 bp, Homo sapiens
  misc_feature: GYAE6OF02II9QJ.23.88.H11.1.454.CMB.1.raw
  modified_base (291)..(291): a, c, t, g, unknown or other
  misc_feature (291)..(291): n is a, c, g, or t
  modified_base (503)..(503): a, c, t, g, unknown or other
  misc_feature (503)..(503): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccgccagactgttgacaacgacttagcctggtaccaacagaagcctggccaggctcccaggctcctnatctatgatacttccagtagggccatggcatcccagcccgcttcagtggcagtgggtctgggacagacttcactctcaccatccaccagccctagagcctgaagtattttgctagtttattactgtcagcacgtaagagtcggcctcaatatctacttcgcctggaaccaagtgatagtacaaacgtacgtgtaggcgtgacaccgactctntcttcacgtcttcccg

SEQ ID NO: 111299 - DNA, 518 bp, Homo sapiens
  misc_feature: GYAE6OF02F6FVN.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccggccagactgttgacaacgacttagcctggtaccaacagaagcctggccaggctcccaggctcctcatctatgatacttccagtagggccactggcatcccagccccgcttcagtggcaggtgggtctgggacagacttcactctcaccatccaccagccctagacgcctgaagtattttgctagtttattactgtcagcaccgtaagagtcggcctcaatacttcactttcggcctgggaccaaaggtgatatacaacgactgtgctgcacatctgtctcatccttcccg

SEQ ID NO: 111300 - DNA, 521 bp, Homo sapiens
  misc_feature: GYAE6OF02HXMTO.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccacctgtctttgtctccgggggaacgagccaccctctcctgcagggccggccagactgttgacaacgacttagcctggtaccaacagaagcctggccaggctcccaggctcctcatctatgatacttccagtagggccactggcatcccagccccgcttcagtggcaggtgggtctgggacagtacttcactctcaccatccaccagcctagacgcctgaagtattttgctagtttattactgtcagcaccgtaagaagtggcctacaatattcactttcggccctgggaccaaagtgatatacaacgactggtgctgcacatctcgtcttcacttcctcccg

SEQ ID NO: 111301 - DNA, 689 bp, Homo sapiens
  misc_feature: GYAE6OF02HFCK0.23.88.H11.1.454.CMB.1.raw
  modified_base (260)..(260): a, c, t, g, unknown or other
  misc_feature (260)..(260): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccacctgtctttgtctccggggaacagccaccctctcctgcagggccgcagactgttgacaacgacttagcctaggtaccaanagaacgcctggaccaggcctccaggcctcctcatctaatcgattaccttaccagttagggccaacgtggccaactcccagccccgtcttaccaggtcggacaggtgggtctcggggacaggtaccttcaccttcaccaacctaatcccaaaccgacgtaccttacggaacgcccgttaaggtaaacgtacgtttttacggaccttaaggttttaaacctttaccgttagttaccgtaacgggtacctaacggttaaaacgtaacgtttacgggacccttacgtaaaacgttactttacctaaccggttttaccggcccgttaacgggtaacccgtaaaggtcgtaactaacgtactaaacgtaacgtggtacggtactacgaccgtacctacgttaccgtcgtttaccttacgtacttaccgttccccg

SEQ ID NO: 111302 - DNA, 513 bp, Homo sapiens
  misc_feature: GYAE6OF02H46JT.23.88.H11.1.454.CMB.1.raw
  modified_base (334)..(334): a, c, t, g, unknown or other
  misc_feature (334)..(334): n is a, c, g, or t
  modified_base (502)..(502): a, c, t, g, unknown or other
  misc_feature (502)..(502): n is a, c, g, or t
tcagacgcgagtatcacgaccggtgctcgatttagcgacagcgagaacacacaaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtaggccactggcatcccagcccgnttcagtgcagtgggtctgggacagacttcactctcaccatcacagcctagagcctgaagtattttgctagtttattactgtcagcacgtaagaagtggcctacaatattctacttcggccctggaccaagtgatatacaacgactgtcgctagccaccatctgttctntactcttcccg

SEQ ID NO: 111303 - DNA, 547 bp, Homo sapiens
  misc_feature: GYAE6OF02I20BS.23.88.H11.1.454.CMB.1.raw
  modified_base (293)..(293): a, c, t, g, unknown or other
  misc_feature (293)..(293): n is a, c, g, or t
  modified_base (341)..(341): a, c, t, g, unknown or other
  misc_feature (341)..(341): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccgccagactgttgacaacgacttagcctggtaccaacagaagcctggccagggcctcccaggctcctnatctatgatacttccaggtacgggccactggccactcccagtccccgnttccaggtcggcaggttgggctggggacaggtaccttcactctcaccatccaccagcctagacgcctagaagtatttgctagtttattactgtctagcacgtaagaacgtcggacctctaatattcctactttcggcctacgggtaccaacgtgatatacgaacgtacgtggtagctgacactactctgtactctactcctacccg

SEQ ID NO: 111304 - DNA, 502 bp, Homo sapiens
  misc_feature: GYAE6OF02F2BFA.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccggccagactgttgacaacgacttagcctggtaccaacagaagcctggccaggctcccaggctcctcatctatgatacttccagtagggccactggcatcccagcccgcttcagtggcaggtgggtctgggacagacttcactctcaccatcaccagcctagacgcctgaagtatttgctagtttattactgtcagcacgtaagagtgcctcaatatcactttcgcctggaccaagtgatatcaacgactgtgctgcacatctgtctcatctcccg

SEQ ID NO: 111305 - DNA, 511 bp, Homo sapiens
  misc_feature: GYAE6OF02ITI09.23.88.H11.1.454.CMB.1.raw
  modified_base (335)..(335): a, c, t, g, unknown or other
  misc_feature (335)..(335): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccacccctctcctgcagggccggccagactgttgacaacgacttagcctggtaccaacagaagcctggccaggctcccaggctcctcatctatgatacttccagtagggccactggcatcccagcccgnttcagtggcagtgggtctgggacagacttcactctcacatcaccagcctagacgcctagaagtatttgctagtttatactgtcagcaccgtaagacgtggacctctaatattcactttcggccctggacaagtgatatacaacgactgtagctgcactatctgtctcactctcccg

SEQ ID NO: 111306 - DNA, 552 bp, Homo sapiens
  misc_feature: GYAE6OF02HLRYE.23.88.H11.1.454.CMB.1.raw
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (409)..(409): a, c, t, g, unknown or other
  misc_feature (409)..(409): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccggccagactgttgacaacgacttagcctggtaccaacagaagcctggccaggcctcccaggctcctnatctatgatacttccagtacgggccactggcatcccagccccgtnttcgaggtcggcaggtgggtctgggacagacttcactctcaccatccaccagcctagacgcctagaagtnttttgactagtttacttactgtacagaccacgtaagaagtcggacctacaattacttctactttcggcccgtaggaacctaaagtgatactacgaaacgtacgtgtaggctagaccacgtatctgttcttacacttcctcccg

SEQ ID NO: 111307 - DNA, 587 bp, Homo sapiens
  misc_feature: GYAE6OF02I9U6J.23.88.H11.1.454.CMB.1.raw
  modified_base (333)..(333): a, c, t, g, unknown or other
  misc_feature (333)..(333): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctccccaggctcctcatctatgatacttcagtagggccatggcatcccagcccgnttcagtggcagtgggtctgggacagacttcactctcaccatccaccagccctagacgcctagaagtagtttgctagtttacttctgtcagcacgccgttacccgccaccgccgcctaccgtaccgtttccggggaccggggggtaccgtagggggtcgggaggaacgtaggaggaccggtaacgtcgggtcgggtctacgggacctaccgtacgttccgttcggttaccttcgtacttcccgttccccgtaccc

SEQ ID NO: 111308 - DNA, 568 bp, Homo sapiens
  misc_feature: GYAE6OF02JZ4X7.23.88.H11.1.454.CMB.1.raw
  modified_base (205)..(205): a, c, t, g, unknown or other
  misc_feature (205)..(205): n is a, c, g, or t
  modified_base (340)..(340): a, c, t, g, unknown or other
  misc_feature (340)..(340): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagacgcgagtatcacgaccggtgctcgatttagcgacagcgagaacacacaaaggggggaggaactgctcagttaggacccagagggaaccatggaagccccagctcagcttctcttcctcctgctactctgactcccagattccaccggcgaaattgtgttgacacagtctccagccaccctgtctttgctccgggggaacngccacctctcctgcagggccggcagactgtgacaacgcttagcctggtaccaacagaacgcctggcccaggcctcccaggccttcctcatctatgattacttccaggtacggccactggcactcccagccccgtnttcagtggcaggtgggtctgggacagacttcactcncacntcacngcctagacgctagaagtatttgcttagtttacttacgtgtacacgactaacgtaagacgtcgtacctactaatacttactaccgtttcggacccgttagggaacctaaggtcgtattacgtacgtaacgtacgtcgtcggctacgaccacgtactcgtcgttacttccgtacttccctacccg

SEQ ID NO: 111309 - DNA, 612 bp, Homo sapiens
  misc_feature: GYAE6OF02JXX7L.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccacctgtctttgtctccgggggaacagccaccctctcctgcagggccgcagactgtgacaacgacttagcctggtaccaacagaagcctggccaggcctcccaggcctcctcatctatgatacttccagtacgggccagtcggcactcccagccccgcttcagtcggctaggtcgggtctggggacaggtactttcgacttctaccaacctataccacccgagtcctaagacgacctaggtaagtactttttgacgttagttttaactacgttacgtctagtaccaaccggttaaggtaacgtcggacccttactaagttacttcgtaaccgtttccgggacccgttacgggaacctaaaggtggtaactacgtacgaaacgtaacgtgtacgtctacgaccactagtcttcgtaccgttctacttcctacccg

SEQ ID NO: 111310 - DNA, 498 bp, Homo sapiens
  misc_feature: GYAE6OF02FMISY.23.88.H11.1.454.CMB.1.raw
  modified_base (334)..(334): a, c, t, g, unknown or other
  misc_feature (334)..(334): n is a, c, g, or t
  modified_base (483)..(483): a, c, t, g, unknown or other
  misc_feature (483)..(483): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtagggccactggcatcccagcccgnttcagtggcagtgggtctgggacagacttcactctcaccatccaccagcctagacgcctgaagtatttgctagtttatactgtcagcacgtagagtgctcaatattcacttcgcctggaccaagtgatatacaacgactgtgctgcacntctgtctcatctccg

SEQ ID NO: 111311 - DNA, 521 bp, Homo sapiens
  misc_feature: GYAE6OF02FVYCL.23.88.H11.1.454.CMB.1.raw
  modified_base (292)..(292): a, c, t, g, unknown or other
  misc_feature (292)..(292): n is a, c, g, or t
  modified_base (338)..(338): a, c, t, g, unknown or other
  misc_feature (338)..(338): n is a, c, g, or t
  modified_base (507)..(507): a, c, t, g, unknown or other
  misc_feature (507)..(507): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctnatctatgatacttccaggtacgggccagtggcactcccagccccgnttcagtggcaggtgggtctgggacagtacttcactctcacatccaccagtcctagacgccctagaagtattttgactagtttattactgtcagccacgtaagagtcgacctcaatattctacgttcgcctggacaaagtgatatacaagactgaggctgacactatctntcttcatcctcccg

SEQ ID NO: 111312 - DNA, 602 bp, Homo sapiens
  misc_feature: GYAE6OF02I0STT.23.88.H11.1.454.CMB.1.raw
  modified_base (424)..(424): a, c, t, g, unknown or other
  misc_feature (424)..(424): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggcctcccagattccaccggcgaaattgtgttgacacagtctccagccaccctgtctttgtcgtccgggggaacgagccaccctctcctgcacgggccgccagactgttgacaacgacttagcctggtaccaacagaacgccgtggaccaggcctcccgaggtcctccctcatctatgactacttccaggtacgggccacgtggccacgtcccacgcccgtcttcgagtcggctaggtgggtctgggacagtactcactctcacatccaccacgcctagcgcctagaacgtntttgacttagtttacttacgtgtacagtacctaacgtaagtacgtcgcctaacgtattacttcctacgtttccgccgtaggaacctaaggtcgaattacgtactaaacgtacgtggtacggtacttacgacctaacgttacgtcgttacgttccttacgtaccttcccgttaaccccg

SEQ ID NO: 111313 - DNA, 577 bp, Homo sapiens
  misc_feature: GYAE6OF02HX4XW.23.88.H11.1.454.CMB.1.raw
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
tcagacgcgagtatcacgaccggtgctcgatttagcgacagcgagaacacacaaaggggggaggaactgctcagttaggacccagagggaaccatggaagccccagctcagcttctcttcctcctgctactctggctcccagattccaccggcaaattgtgttgacacagtctccagccaccctgtctttgcgtccgggggaacagcccaccctctcctgcagggccggcagactgttgacaacgacttagcctggtaccaanagaagcctggccaggcnccaggctcctcatctatgatacttccagtaggccatgcatccagcctnttcagtgcagtggtcngggacagtctnactctacaccatcactacgctagacgtctagaagtatttgctaagtttactactgtcagtacacgtaagaagtcggacctactaaactacttacctacgttttcccgggcccgttagggtaacccgtaaaggtcgggtaatacgtaacgtaaacgtaacgtggtacggtaccgtagcccaactactcgttaccgttacctttactacgttcccttaaccccg

SEQ ID NO: 111314 - DNA, 518 bp, Homo sapiens
  misc_feature: GYAE6OF02GSHYS.23.88.H11.1.454.CMB.1.raw
  modified_base (292)..(292): a, c, t, g, unknown or other
  misc_feature (292)..(292): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctnatctatgatacttccagtagggccacgtggcactcccagcccgcttcgagtggcaggtcgggtctggggacagacttcactctcaccatcaccagcctagacgcctgaagtatttgctagtttattactgtcagcacgtaagagtcggcctacaatacttctactttcgcctggacaagtgatatacaacgtactgtgctgcacgatcgtgtctctactcctcccg

SEQ ID NO: 111315 - DNA, 518 bp, Homo sapiens
  misc_feature: GYAE6OF02FRY4X.23.88.H11.1.454.CMB.1.raw
  modified_base (335)..(335): a, c, t, g, unknown or other
  misc_feature (335)..(335): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacgagccaccctctcctgcagggccggccagactgttgacaacgacttagcctggtaccaacagaagcctggccaggctcccaggctcctcatctatgatacttccagtaggccactggcatcccagccccgnttcagtggcaggtgggtctgggacagacttcactctcaccatccaccagcctagacgcctgaagtattttgctagtttattactgtcagccacgtaagagtcgcctacaatattctacgtttcgcctggaacctaaagtgatatacaacgacgtgtgctgcactatctgtcttcactctcccg

SEQ ID NO: 111316 - DNA, 556 bp, Homo sapiens
  misc_feature: GYAE6OF02G0YF5.23.88.H11.1.454.CMB.1.raw
tcagacgcgagtatcacgaccggtgctcgatttagcgacagcgagaacacacaaaggggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccgcagactgtgacaacgacttagcctggtaccaacagaagcctggccaggcctcccaggctcctcatctatgatacttccagtacgggccacgtggcactcccagcccgtcttcaggtcggctaggtcgggtctgggacagtacttcactctcacatccacagcctagacgctagaagttatttcgacttagtttattactgtacacgtctaacgtaagacgtcgacctacaattacttctacgttccggtccgtaggaaccaagtcgactacgtacgaaacgtacgtggtacgctacgacacgtacttctgtcttctacttcctacccg

SEQ ID NO: 111317 - DNA, 721 bp, Homo sapiens
  misc_feature: GYAE6OF02J0MIY.23.88.H11.1.454.CMB.1.raw
  modified_base (407)..(407): a, c, t, g, unknown or other
  misc_feature (407)..(407): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagacttcccaccggcgaaattgtgttgacacagtctccagccacctgtctttgtcgtccgggggaacacgccaccctctccctgcgacgggcccggccaggtaccttggtttacgaaccaacggtacctttacggcccgttagggtacccaaacaggaacgccctgggacccagggcctccccgaggtcctccctacgactctatgacttaccttccgaggtacgggccctacgtcgggccacgtccccacggtcccccgtcttacgnggtcggaccgtaggttcgggggtctaggggaccacgtccgtttaccacgttcctaccaccgtactcccaaccgacgtacccgtaggacgtcccgtaggtaacgttacttttgacctttagtttacttacgtcgtctaacgtaccgtaaccggttaagaacgtccggtacccttaccgtaattacctttaccgtaccgtttaccggtaccccgttagggtaaccctaaaggtcggtactacgtaccgaaccgtacgtggtcggactacggactacctacttccgtacgttcctttactaccgttcccgttacccg

SEQ ID NO: 111318 - DNA, 564 bp, Homo sapiens
  misc_feature: GYAE6OF02HNRAP.23.88.H11.1.454.CMB.1.raw
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccacctgtctttgtctccggggaacagccaccctctcctgcagggccgccagactgttgacaacgacttagcctggtaccaacagaagcctggccaggcctcccaggctcctcatctatgatacttccagtacggccacgtggccatccccagccccgcttcaggtggcaggtcgggtctgggacagtcttcactcncaccatcaaccngtcctagacgctagaacgtntttgctagtttatactgtcagcacgtaagagtgacctacaattacttctacgtttccggccgtacgggtaacccaaaggtcgtaatacgtacaacggtacgtaggtcggtctacggaccaacctattacgttcgttaccttactactcccgttccccg

SEQ ID NO: 111319 - DNA, 522 bp, Homo sapiens
  misc_feature: GYAE6OF02FO5TO.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtagggccactggcatcccagccccgcttcagtggcagtgggtctgggacagacttcactctcaccatccaccagcctagacgcctgaagtattttgctagtttattactgtcagcacgtaagaagtggcctacaatattctactttcggccttgggaaccaaaggtgatatacaacgaactgtgtctcgcaccatctgtcttctatcttcccg

SEQ ID NO: 111320 - DNA, 524 bp, Homo sapiens
  misc_feature: GYAE6OF02FQBVL.23.88.H11.1.454.CMB.1.raw
  modified_base (332)..(332): a, c, t, g, unknown or other
  misc_feature (332)..(332): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtaggccatggcatcccagcccgnttcagtcggcagtgggtctgggacagacttcactctcaccatccaccagcctagacgcctagaagtattttgctagtttattactgtcagctaacgtaagagtcgcctcaatacttctacttcggcccgtggaacctaaaggtgaatactacaacgactggtgtctgcactatctgtctctactccttcccg

SEQ ID NO: 111321 - DNA, 727 bp, Homo sapiens
  misc_feature: GYAE6OF02IGXDO.23.88.H11.1.454.CMB.1.raw
tcagacgcgagtatcacgaccggtgctcgatttagcgacagcgagaacacacaaagggggaggaactgctcagttaggacccagagggaaccatggaagcccagctcagcttctcttcctcctgctactctggctcccagattccaccggcgaaattgtgttgacactagtctccagccacctgtctttcgcgtccgggggaacacgcccaccctctcccgtgcgacgggccgccaggtaccttggttacgaaccaacgtacttagcccgttaggtacccaacgagaacgccgtcggaccgaaggcctaccccgacggtaccttccctacgtatcctaagttcgaacttaccttccgaggttacgggccctacgttcggctaacttccccgaaggccccgtaccgtttcgaaggtccggacgagttcggggtctacgggatacgtacttcgaacctcgttacacctatcccgaacgcgtacctacgacgtaccgtagtaacgtacgttttgaccgtttagtttacgtttaccttgtacgtaacgtccgtaaccgttaaacgtaacggttcggaacccttacaagttaacttacgtacctttaccgggtcccgttacggtaacccgtaaaggttaccgaacgttacgacgtaaaccgtaccgtaaggttccggagttaccgtactaacccgtattccgtacggtttctacttaccttcccgttacccg

SEQ ID NO: 111322 - DNA, 589 bp, Homo sapiens
  misc_feature: GYAE6OF02GGL1G.23.88.H11.1.454.CMB.1.raw
  modified_base (206)..(206): a, c, t, g, unknown or other
  misc_feature (206)..(206): n is a, c, g, or t
tcagacgcgagtatcacgaccggtgctcgatttagcgacagcgagaacacacaaaggggggaggaactgctcagttaggacccagagggaaccatggaagccccagctcagcttctcttcctcctgctactctggctcccagattccaccggcgaaattgtgttgacacagtctccagccaccctgtctttgtctccgggggaacngccaccctctcctgcagggccgccagactgttgacaacgacttagcctggtaccaacagaagcctggccaggctcccaggctcctcatctatgattactccagtacgggccacgtggcatcccagcccgcttcgagtggcaggtgggtctgggacagtacttcactctacacctatccaccagtcctagacgcctaggaagttattttcgacttaagtttacttactgtacctagcctaaccgtaagaagtcggccctacaatcttactacgtttccggccctagggacctaaaggtcggattactacgtaaacgacgttaggtcggcgtacgacctaacctgttaccgttcgttacctttctacctttcccgttacccccgg

SEQ ID NO: 111323 - DNA, 753 bp, Homo sapiens
  misc_feature: GYAE6OF02IVWDL.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctcgggggaacagccaccctctcctgcagggccgccagactgttgacaacgacttacgcctggtaaccaacagaaacgcctaggcccagggcctacccgaggtcctccctcgatctatgaactaccttcaggtacggcctacgtggaccactcccgacgcccgtcttaccgaggtgcgacggttgggtactcggggactaggtaacctttcgaaccttccgtaccgaaccctacgttaccaacccggtagtaccccgtaacggaaccggtacccgtaaggtaaacggtttaacgtttttaccggaccgtttaaagttttaacgttaaccgttacggtaccgtaacggtaaccgtaacccggttaaaggtaacggttaccgggtaccctaaccgttaaatttacgtttaccgtaaaccgttttacccggacccggttaacgggaaacccgtaaacggttaacgggtaacttaacgtaccgaaaaccggtaacgttcgggtaacggtacgtacgtacccgaactacgttccgttcgttacgttaccgtacgttcccgtacccg

SEQ ID NO: 111324 - DNA, 652 bp, Homo sapiens
  misc_feature: GYAE6OF02GO3V6.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacagcccaccctctcctgcagggccgccagactgttgacaacgacttagcctggtaccaacagaacgcctggccaggcctcccgaggctcctcatctatgtattaccttccaggtacgggccacgtggaccactccccgagtccccgtcttccgaggttcggcctaggttcggggtccgtaggggaccaggtaccttccacttcctaccaaccctacgtacccaacccgagtcccgtaacgacgtccctagaaagttacttttgcttaagtttaacttacttgtacagtaccgtaaccggtaaagtacgtcggtaccctacctaaattactttcgtaccgttttccggacccgttacgggaacccgtaaagttaggaacttaactaccgaaacgtacgtggtacggctcgacccactacttcgtacgttcttactcttacccgttcccg

SEQ ID NO: 111325 - DNA, 798 bp, Homo sapiens
  misc_feature: GYAE6OF02JLJNV.23.88.H11.1.454.CMB.1.raw
  modified_base (221)..(221): a, c, t, g, unknown or other
  misc_feature (221)..(221): n is a, c, g, or t
tcagacgcgagtatcacgaccggtgctcgatttagcgacagcgagaacgaacgacgaaaggggaggaacgtgctcagttaggacccagagggaaccatggaagcccagctcagcttcctcttcctcctgctactctggctcccagattccgaccggcgaaattgtgttgacacagtctccagtccacctgtactttgcctccgggggaacacgccaccctntcctagcagggccgcctagactgttcgaacaacgaacttagccttaggtaccaacgacgaagcctaggccaagggcctcccgaggcctcccgtacaacgtctaacgtgactaccgttccgaggtacgggcccaacgttcggacctaacgtccccacggccccgtcttacgacgggtttcggacctaggttcggggtccttacgggggacctaacgggtacctttaccgacgtttcccggaccaacccgtaagttcccaaccgtacggtccgtaggaccggtaccgtaggtaaacgtacgttttacggacttaacggttttacttaccgttacggtttacacggttaccgaaccggtaaacggtaacggtccggtacctttaccgaaacggtttacttaccgtaccgttttacccggggtacccgttaacgggggtaaccccgtaaaaggttacgggaacgtttaaccgttaccgtaaaccggtaaccggttacggttaacggtaccgtaccggtaacccgtacccgtacgttaccggttaccgttacccgttaccggttaccttcccgttaccccgg

SEQ ID NO: 111326 - DNA, 661 bp, Homo sapiens
  misc_feature: GYAE6OF02JZW8W.23.88.H11.1.454.CMB.1.raw
  modified_base (207)..(207): a, c, t, g, unknown or other
  misc_feature (207)..(207): n is a, c, g, or t
  modified_base (416)..(416): a, c, t, g, unknown or other
  misc_feature (416)..(416): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctgctcccagattccaccggcgaaattgtgttgacacagtctccagcccaccctgtcctttgtcgtccgggggaacncgccaccctctcctgcagggccgccagactgtgacacgacttagcctggtaccaacagacgcctggccaggctcccgaggcctcctcatctatgaacttacctccaggtacgggcctacgtcggactacctccccgaagccccgtcttacaggtcggccaggttcggggttactggggaacaggtactttcaacgttctccgaaacccnctccgaccacgtacctacgacgtacctagaacgtattttcgacttacgtttactacttcggtactaacgtacgtacgtaggaacgttcggacccttactaaccgttattacccgttaccgtttaccggcccgttaacgggtaaccttaaacggtggtaacttaacgtaccgtaaacggtaacgttcggtacggttacacgtaccgtaactacgttacgtcttacgtcctacttcccgttaacccg

SEQ ID NO: 111327 - DNA, 578 bp, Homo sapiens
  misc_feature: GYAE6OF02H2072.23.88.H11.1.454.CMB.1.raw
  modified_base (379)..(379): a, c, t, g, unknown or other
  misc_feature (379)..(379): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattcccaccggcgaaaattgtgttgacacagtctccagccaccctgtctttgtctccgggggaacgagccaccctctcctgcagggccggccagactgttgacaacgacttagcctggtaccaacagaagcctggccaggcctcccaggcctcctcatctatgatacttccagtaggccagtggcatcccagcccgtcttcagtggcaggtgggtctgggacagacttcactctcacntcaccagcctagacgcctagaagtattttgctagtttaacttacgtgtactagacaccgttaaagaacgtcggacctactaaattacttactacgtttccggccctagggtaaccaaaggttcggaatactaccaaacggtaactggtacggctacgaccaacctacgtccttagttcctttacaccttcccgttcccg

SEQ ID NO: 111328 - DNA, 522 bp, Homo sapiens
  misc_feature: GYAE6OF02I5FT7.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtagggccactggcatcccagcccgcttcagtggcaggtgggtctgggacagacttcactctcaccatcacctagcctagacgctgaagtatttgactagtttattactgtcagctacgtaagagtgcctacaattacttcacttcgcctcgggaacctaaaggtgatatacaacgactaggtgctgacacactctagtctactactctacccg

SEQ ID NO: 111329 - DNA, 560 bp, Homo sapiens
  misc_feature: GYAE6OF02F00CY.23.88.H11.1.454.CMB.1.raw
tcagacgcgagtatcacgaccggtgctcgatttagcgacagcgagaacacacaaaggggggaggaactgctcagttaggacccagagggaaccatggaagccccagctcagcttctcttcctcctgctactctggctcccagattccaccggcgaaattgtgttgacacagtctccagccaccctgtctttgtctccggggggaacgagccaccctctcctgcagggcccggcagactgttgacaacgacttagcctgttaccaacagaagcctggccaggcctcccaggcctcctcatctatgattaccttccaggtacgggccactggccactcccagccccgtcttcaggtcggcaggtcgggtctgggacagacttcactctcacctatcaccagcctagacgctagaagtatttgcttagtttacttactgtcagtacaccgtaagagtcgacctaccaatacttctacgtttccggccgtagggaacctaaggtgactagtacaaacgtacgtggtcgtactcgacctactactctcgtcttctactcctcccg

SEQ ID NO: 111330 - DNA, 618 bp, Homo sapiens
  misc_feature: GYAE6OF02JBR20.23.88.H11.1.454.CMB.1.raw
  modified_base (264)..(264): a, c, t, g, unknown or other
  misc_feature (264)..(264): n is a, c, g, or t
  modified_base (412)..(412): a, c, t, g, unknown or other
  misc_feature (412)..(412): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacgagccaccctctcctgcagggccgccagactgtgacaacgacttagcctggtaccaacngaacgcctggcccagggcctccccgaggcctcctcatctatgactacttccaggtacgggccactcggcctactccccgacgcccggtcttcgaggtcggcgtaggtcgggtcgtgggactagtactcgactctacacctatccaccnacctagacgcctagaagtatttgacttagtttactactgtactagacctacggtaataggtcgaccttactaatttaccttctacgtttccggacccgttaggaacctaaaggtcgtaactacgtacaaacggtacgttcggtacggtacgtacgacccgtaactacgttccgtacgtttaccttacgtaccgttcccgttacccg

SEQ ID NO: 111331 - DNA, 569 bp, Homo sapiens
  misc_feature: GYAE6OF02HWSG2.23.88.H11.1.454.CMB.1.raw
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (325)..(325): a, c, t, g, unknown or other
  misc_feature (325)..(325): n is a, c, g, or t
  modified_base (344)..(344): a, c, t, g, unknown or other
  misc_feature (344)..(344): n is a, c, g, or t
  modified_base (552)..(552): a, c, t, g, unknown or other
  misc_feature (552)..(552): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggacacgccaccctctcctgcagggccgcagctgttgacaacgcttagcctggtaccaanagancctggccaggccnccgaggcctcctcatctatgactcttcaggtacggccactggcctacncccgacgcccgtcttacgnggtcggcgtaggtcgggtactggggacagtactcacttcaccgacactccaccgtacgtctagacgtcctagtaacgtatttgacttagtttacttctgtacacacgacgtaaagaacgtcgcctactaattacttctacgtttccgggcctagggaactaaaggtcgaatactacgaactagtggtacgtctagcctactatccgtnttctctacttcccgtcg

SEQ ID NO: 111332 - DNA, 515 bp, Homo sapiens
  misc_feature: GYAE6OF02FVDK8.23.88.H11.1.454.CMB.1.raw
  modified_base (337)..(337): a, c, t, g, unknown or other
  misc_feature (337)..(337): n is a, c, g, or t
tcagacgcgagtatcacgaccggtgctcgatttagcgacagcgagaacacacaaaagggggaggaactgctcagttaggacccagagggaaccatggaagccccagctcagcttctcttcctcctgctactctggctcccagattccaccggcgaaattgtgttgacacagtctccagccaaccctgtctttgtctccgggggaacagccaccctctcctgcagggccggccagactgttgacaacgacttagcctggtaccaacagaagcctggccaggctcccaggctcctcatctatgatacttccagtaggccactggcatccccagccccgnttcagtggcagtgggtctgggacaggacttcactctcaccatccaccagccctagacgcctagaagtattttgctagtttatactgtcagcacgtaagagtcgcctcaatattcactttcgcctggaccaaagtgatatacaacgacgtgtgctgcacatctgtcttcactctacccg

SEQ ID NO: 111333 - DNA, 561 bp, Homo sapiens
  misc_feature: GYAE6OF02HXSVK.23.88.H11.1.454.CMB.1.raw
  modified_base (401)..(401): a, c, t, g, unknown or other
  misc_feature (401)..(401): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagcccaccctgtctttgctccgggggaacagcccacctctcctgcagggccggcagactgttgacaacgacttagcctggtaccaacagaagcctggccaggcctcccaggcctcctcatctatgatacttccagtagggccacgtggcactccccgagcccgtcttcgagtcggctaggtgggtctgggacagtacttcactcctcaccatccacacgcctagcnctgaatatttgctagtttattacgtgtcagtacacgtaagagtcgacctacaattcttactaccgtttcggacccgttagggaacctaaggtcgatacgtacaacgtacgtggtcggactcgaccaccgtcttacgtcttccttctacttccttaccccg

SEQ ID NO: 111334 - DNA, 712 bp, Homo sapiens
  misc_feature: GYAE6OF02JLKVL.23.88.H11.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccggggacngccacctctcctgcagggccgcagactgttgacaacgacttagcctggtaccaacgagaagcctaggccaggctccccaggcctccncatcttataggtactaccttaccgagttcgggccaacgttggacctacttcccgaacgtccccgtacttcgaaggtcggtacctaggtcggggttaccgtagggacctaagtcccgttacgaccttcggtaccaccgtaacttacccgaactacccggtcctaaggtaaccgtccttacggtaaacttacggtttacgtaccgtaacgtttaacgttacttacgtacgtacgtaccgtaaccgtaaggttaacgtacgtacccttaccgtaacgtttaacgttccgtttacctttaccgggtacccgtacgggtaacccgtaaagttcgggaatacgttaccgtaacggtaaccgttcggtaagtccgtaccgtaccgtactaacgttcgttaccgttcgttacctagttaccctacccgg

SEQ ID NO: 111335 - DNA, 820 bp, Homo sapiens
  misc_feature: GYAE6OF02GKRSK.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccggggggaacagccaccctctcctgcagggccggccagactgtgacaacgacttagcctggtaccaacgagaacgcctggaccaggctcccgaggcctcctcatctatcgaatacttccaggtacgggccacgtcggacacgtcccgacgcccgtcttaccgaggtggacctagggtcgggttcgtacgggacgtaggtaccttcgaccttaccgtacctaaccctaactcccaaacccgtaccggtaccctaaagggtacctacccggttaaggtaaacgtttacgtttttacggtaaccgtttaagtttttaaactttaaccgttcggttaaccgtaacggtaaccccgttaaacgggttaaaggtaacgggttaccggtaacccgttaacccgtttaaaatttcccgttttaaccgttaccccggtttttaccggggaccccggtttaaccggggtaaaacccgttaaagggtttacggaaaccgtttaaccgtaaacccgtaaaacgggttaacccgtttggggtaccggttaccggttacccgaacccgtaacccgtttacggtttacgttaccccgttttacgtttaaacccgtttcccggttaccccctttacccccg

SEQ ID NO: 111336 - DNA, 555 bp, Homo sapiens
  misc_feature: GYAE6OF02GRQ31.23.88.H11.1.454.CMB.1.raw
  modified_base (382)..(382): a, c, t, g, unknown or other
  misc_feature (382)..(382): n is a, c, g, or t
  modified_base (410)..(410): a, c, t, g, unknown or other
  misc_feature (410)..(410): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccacctctcctgcagggccggcagactgttgacaacgacttagcctggtaccaacagaacgcctggtcaggcctcccgaggcctcctcatctatgactacttccgagtacgggccacgtggccactcccgagccccgtcttcgagtcggcaggtgggtctgggacagcttcactcncacatcagcagcctagacgctagaagtntttgcttagtttacttactgttcagcgagtcgtagacacgtcgtaccctacgttcgggcggacggaccgaagggtacgaaacgtacgaaacgtacgtaggtcggctcgacaactgtcgtgttcctctactccgttcccgactacg

SEQ ID NO: 111337 - DNA, 561 bp, Homo sapiens
  misc_feature: GYAE6OF02GHPGZ.23.88.H11.1.454.CMB.1.raw
  modified_base (380)..(380): a, c, t, g, unknown or other
  misc_feature (380)..(380): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtccgtccgggggaacgagccaccctctcctgcagggccggccagactgttgacaacgacttagcctggtaccaacagaacgcctggccaggcctcccaggcctcctcatctatgatacttccagtacgggccacgtggcactcccagccccgcttcagtggcaggtggggtctgggacagcttcactcncaccatccaccagcctagacgcctagaagtatttgctagtttattactgtcagctaacgtaagtacgtcggcctacaattacttactaccgtttccggacccgttcgggaacctaaaggtagatactacaaacgtacgtggtcgtctgctaccgtatctacgttcttctacttccgtcccg

SEQ ID NO: 111338 - DNA, 702 bp, Homo sapiens
  misc_feature: GYAE6OF02F2298.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacagccaccctctcctgcagggccgccagactgtgacaacgacttagcctggtaccaacgagaagcctggccaggcctcccgaggcctcctcatctatgactacttccaggtacgggccacgtggcactcccagccccgtcttcgaggtcggcaggttcggggtcgtcggggactacggtaccttcacctcctaccacctacttcccaaccacgtacctaacggacgtccgttaggtaacgttagttttgacgttaacgttttacttacgtcgtaccgtaacgtaccgtaaaccggttaaaggtacggttaccggtacccttaaccgtaaattaccgtttaccgtaccgttttccccgggtacccgttaacggggtaaacccgttaaaggttcggtaacttaaccgtacgaaaaccgtacgttcgggttacggtaccgttacggaccctaaccgtagtttccgttagttaccctttaccgtaccgttcccgttaccccg

SEQ ID NO: 111339 - DNA, 535 bp, Homo sapiens
  misc_feature: GYAE6OF02JE3QZ.23.88.H11.1.454.CMB.1.raw
  modified_base (205)..(205): a, c, t, g, unknown or other
  misc_feature (205)..(205): n is a, c, g, or t
  modified_base (332)..(332): a, c, t, g, unknown or other
  misc_feature (332)..(332): n is a, c, g, or t
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacngccacctctcctgcagggccgccagctgtgacaacgcttagcctggtaaccaacagaagcctggccaggcctcccaggctcctcatctatgatactcagtcggccactggcactcccgagccccgtnttccaggtcggcaggtcgggtctagggacngacttcactctcacatccactagcctagacncctgaagtactttgactagtttactactgtacgtagctacgtaagaacgtcgacctactaaactcttactacgtttccgacctacggaactaaagtgactatacgaacgacgtggtgactgacacatctgtctcatcctccg

SEQ ID NO: 111340 - DNA, 652 bp, Homo sapiens
  misc_feature: GYAE6OF02J1BQ0.23.88.H11.1.454.CMB.1.raw
  modified_base (595)..(595): a, c, t, g, unknown or other
  misc_feature (595)..(595): n is a, c, g, or t
  modified_base (614)..(614): a, c, t, g, unknown or other
  misc_feature (614)..(614): n is a, c, g, or t
tcagacgcgagtatcacgaccggtgctcgatttagcgacagcgagaacacacaaaggggaggaactgctcagttaggacccagagggaaccatggaagcccagctcagcttctcttcctcctgctactctggctcccagattccaccggcgaaattgtgtttgacacagtctccagcccaccctgtctttgtcgtccgggggaacgcgccacccctctccctgccagggcccggcagacctgttagacaaccgacttagccctaggtaccaacagaacgcctggcccaggtcctcccaggtcctcctagactctatcgaataccttccaggtacggcctacgtggcctactccccgagccccggtcttcaggtggtccaggttcgggtctggggaccaggtacctttccgattcgtcccaacctactccgaaccacgtcccgtaagccgtccgtagactagtttgacttagtttatcgtgtatacgcgtaacgtaagtgtacgaccttactaagttacttaccgtacgttcccgggtacccgtaacggaccgtaaacggtggtaattaccacgtaaaccgtaacgtggttaccgnttaccggacctaacccgtntttaccgtaccgttcgtttaccacctttcccgtacccg

SEQ ID NO: 111341 - DNA, 700 bp, Homo sapiens
  misc_feature: GYAE6OF02J0OQ1.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccgccagactgttgacaacgacttagcctggtaccaacagaacgcctggccaggcctcccgaggcctcctcatctatgactacttccagtacggccacgtggcctactcccagccccgtcttcgacggttcggacctaggttcggggtctaggggacctacggtactttaccacgttcctacaacctacgtacccaaccgtagtcccgtaaggacgtcccgtaggtaaacggttacgttttcggacctttaaggttttaactaccgttagtaccgtacgtaccgtaaaccggttaaagaacggttcggtacccttaccgtaaattcgttaccgtaccgtttacccggacccgtaacgggtaacctaaaggtcgtaacttaaccgtaccgaaacggtaaccgtcggtaaccggtcgtaacgacctaaccgttacgttaccgttcgttaccctttacgtaccgttacccgttaccccg

SEQ ID NO: 111342 - DNA, 849 bp, Homo sapiens
  misc_feature: GYAE6OF02JYE3Q.23.88.H11.1.454.CMB.1.raw
  modified_base (222)..(222): a, c, t, g, unknown or other
  misc_feature (222)..(222): n is a, c, g, or t
tcagacgcgagtatcacgaccggtgctcgatttagcgacagcgagaacacacaaagggggaggaactgctcagttaggacccagagggaaccatggaagcccagctcagcttctcttcctcctgctactctggctcccagattccaccggcgaaattgtgttgacacagtctccagccacctgtctttggtcgtccgggggaacacgccaccctctcctgcncgggccgccagtacttgtagacaacgacttacgccgtaggtaaccaacgacgaacgccgtcggacctacgggcctaccccggtacggcccttacccgtactaattacctatacggtaacttaacccgttaccggaaggggtttaacccgggccctacggttaccgggacctaccgttacccccgaccggtcccccggttactttaccggaccgggttggaccgtaacgggttcggggttaccgtagggggtaaacccgtcgggtttacccttacgtaaccctacctacctaaaccctacgtaccccaacccgaacggtacccgtaaggtaacccgtaccgtaaaggtaacgtttaacggttttacgttacttttaaggtttaactttaccggtacgttacgaacggttaccgtaaaaccggttaagttaaacgggtccgttaaccctaacttaaacgtttcccttaccgtttacccgggtttacccgtacccggttaaccgggtaaacgtaaacggtagttaacttaaccgtaacccaaggttaacccggtaggttaccggacgttccgaaccgtaccttaagttacccttagttacctaccggtttacccgttcccgttaccccgg

SEQ ID NO: 111343 - DNA, 825 bp, Homo sapiens
  misc_feature: GYAE6OF02JUQGS.23.88.H11.1.454.CMB.1.raw
  modified_base (783)..(783): a, c, t, g, unknown or other
  misc_feature (783)..(783): n is a, c, g, or t
tcagacgcgagtatcacgaccggtgctcgatttagcgacagcgagaacacacaaaggggaggaactgctcagttaggacccagagggaaccatggaagccccagctcagcttctcttcctcctgcctactctggctcccagattcccaccggcgaaattcgtgttgacacagtctccagccacccctgtcctttgtactccgggggaactagcccaccctctccgtgcacgggccgccagtactgttaggaccaacgtacctttaggcccttacggaacccaatagaacgtcctggacccacgggcctacccgacggtcctacccgtcctactacctaattcggaattacccgtttccgaggttaccgggacctaccgttcgggacaccttaccccggcgacccccgttcgttccgaagggttcggacccggtaggtttccgggggtaccgttagggggaccttaaacggtccgtttttaccgaacgttcccttaccccgaacctaaccgttcccgaaccccgtaagtccccgtttaacggaccggtacccttaacggtaaacgggttactttttacggaaccctttaaaggtttttaccttacttaacggttccgttaacggtaccctaaaccggttaacggtaaacgggttaccggtaacccctttacgtaaacctttactttaccgtaacccgttttccggtaccccgtagggtaaccctaaacggtaccgtaagtactaccgtaaacgtaaccgtcggttacgtacgaggtaccctacncgttactacggtttaccctttacgtaccttcccgttaccccg

SEQ ID NO: 111344 - DNA, 870 bp, Homo sapiens
  misc_feature: GYAE6OF02GJG7X.23.88.H11.1.454.CMB.1.raw
  modified_base (370)..(370): a, c, t, g, unknown or other
  misc_feature (370)..(370): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacagccaccctctcctgcagggccggccagactgttgacaacgacttagcctggtaccaacgagaacgcctggaccaggcctacccgaggccttccctcacttactattcgaacttaccgttcccgaaggtacgggccctacgtggccactaccccgacgccccgtnttcgacgtcggaccgtaggttcggggtcgtaggggaacctacggtacctttacgaacgttcctaaccgtaacctacgtacccgaaccccgaaggttccccgtaacgggtaccgtacccgttaaagggtaaaccggttttaacgtttttacgggtaacctttaaaccgggttttttaaactttaaccggtttaccggtttaccggttaaaccggtacccgttaaaaccccgggttaaaagggtaaccgggtttacccgggtaccccctttaacccgttaaaactttaccgtttaccccgtttaaccccgggttttaacccgggttaacccccgggttaggggtaaacccccggttaaaaggtttcgggtaaaaccgttttaaccgttaaaccggtaaaaccggttaaccggttacgggtacggttacccgttaccgtaaccgttacccgtacgtttccgttaccgtttcccgtttacggtaccctttcccggttacccccg

SEQ ID NO: 111345 - DNA, 733 bp, Homo sapiens
  misc_feature: GYAE6OF02GZNS3.23.88.H11.1.454.CMB.1.raw
  modified_base (205)..(205): a, c, t, g, unknown or other
  misc_feature (205)..(205): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccacctgtctttgtcgtccggggaacgngcccaccctctccgtgcgtacgggccgaccagtaccgtgttacgaacctaaccgacgttacgccgttagggtaacccaaacgacggaaacgtcccgtggacccgacggtccctcccgaggtccttccctaccgattacctaagtcgtaacttaccgtttacccgaagggttaccgggccctacggtcggacctacgtccccgaacggtccccgtaccttacgaggttcgacgtagggttcgggtacgtacggggactacgtactttcgaacttccacctaacgtactaccgacccgtagtacccgtaagtaccgtaccgtaaggtaacgtttaacgtttcgtaccgttagtttaccttacgttacgtacgacgtaccgaacgtaacgtacgtaccgtacctactaacgttacttccgtacgttccggaccgtagggtaacctaagtacgtataccgtacgtaacgtacgtgtacggtctacggtacctacgtctaccgttgttaccgttcgtaccttcccgttacccg

SEQ ID NO: 111346 - DNA, 693 bp, Homo sapiens
  misc_feature: GYAE6OF02JI4DH.23.88.H11.1.454.CMB.1.raw
  modified_base (461)..(461): a, c, t, g, unknown or other
  misc_feature (461)..(461): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctccagattccaccggcgaaattgtgttgacacagtctccagccaccctgtcttgtctaccggggacagccacctctcctgcacgggccggccagtacctgttgaacgtaacgtacgttagccttagggtaacccaacgagaacgcctacggaccgaacgggtccctacccgaacgggtccttacccgtctaacttcgtaacgtgtaacttaccttccgaaggttacgggcctacgtcggactactaccccgacgcccgtacttcgaacggttcgctaacggttggggtactacgggactacggtacttccgagttcacgacctacnccaacgacgtccgagcgacgtaagtatactttcgacttatttactacgtgtactacgtaccgtacgtaacggttacgtcgtacctcgtaaattccttacgtacctttaccggtcccgtacggtaaacccgtaagtacggtaacttacctacggaaaccgtacgttacggtacggaccgtcgaaccgtaccgttacgtaccttcgtaccctttacgtaccttacccgtacccg

SEQ ID NO: 111347 - DNA, 797 bp, Homo sapiens
  misc_feature: GYAE6OF02F0RBL.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacagccaccctctcctgcagggccgcagactgttgacaacgacttagcctggtaccaacagaacgcctggccaggcctccccgaggcctccctcatctatgactacttccgagttacgggcccacgtggctactcccgagccccgtctttacgacgttcggcgaggttcggggtctaggggacaacggtaactttcgaacgtcctaccgaaccgatacccaaccgtaacgccctaacgtacgaccctaggtaaacgttacgtttttacggtacctttaaaggttttaactttaacgtagttaccgtaacggtacccgtaaacccggttaaaagtaaacgggttaccgggttacccttaacccgttaaacgttaacgttttacccgttaaccgtttttcccggggtaacccccggttttaccggggtaaaaccccgttaaaagggttaccggtaaacgttttaaaccgttaaccgtaaaaaccggtttaacccggttaacgggtttaaccggttaccggttaaccgtaccgtaaacccgtacgtttacccgtttacggtttaccctttccttaacctttcccggttaaccccccg

SEQ ID NO: 111348 - DNA, 529 bp, Homo sapiens
  misc_feature: GYAE6OF02G8V5U.23.88.H11.1.454.CMB.1.raw
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggcctcccaggcctccncatctatgactacttccagtacgggcctacgtggcatccccagccccgtnttcaggtggcaggtgggtctgggcagcttcactctcacatccaccagtcctagacgcctagaagtatttgctagtttattactgtcagactacgtaagacgtcgcctacaatacttctacttcgcctggaacctaagtgatactacaacgtactggacgtntgacacatctntctcnctcctcccg

SEQ ID NO: 111349 - DNA, 574 bp, Homo sapiens
  misc_feature: GYAE6OF02F5HO5.23.88.H11.1.454.CMB.1.raw
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacactagtctccagccaccctgtctttgtctccgggggacagccacctctctgcagggccgcagactgtgacacgacttagcctggtaccaacagaagcctggaccagggcctcccgaggcctcctcatctatgattacttccagtacgggccacgtggcactcccagccccgcttcagtcgacagtgggctgggacaggtactcnctctccacntccacngctagcncctgaagtntttgcttagtttatacgtgtcagctaaccgtagacgtcgacctacaattacttcgtacctttccgggcccgttaggaacctaaggttgaacttataccgaaacgtacgttcgtaggtaccgtacaccgtaccgttactctttcgtacctttactaccgttcccgttaaccccg

SEQ ID NO: 111350 - DNA, 700 bp, Homo sapiens
  misc_feature: GYAE6OF02JRAER.23.88.H11.1.454.CMB.1.raw
  modified_base (318)..(318): a, c, t, g, unknown or other
  misc_feature (318)..(318): n is a, c, g, or t
  modified_base (617)..(617): a, c, t, g, unknown or other
  misc_feature (617)..(617): n is a, c, g, or t
tcagacgcgagtatcacgaccggtgctcgatttagcgacagcgagaacacacaaaggggaggaactgctcagttaggacccagagggaaccatggaagcccagctcagcttctcttcctcctgctactctggctcccagattccaccggcgaaacttgtgttgacacagtctccagccacctgtctttgtcgtccgggggaacagccacccttctccgtgccgacgggcccggaccagtacctggttagaaccaaacgtactttacgccctggtaacccaacgagaagcctggaccacggctccgacggctcctctanctatacgtactacttccgaggtcggacctcgtaggcctaactcccaacggtcccgtacttcgacgtcgggcagttcgggacttgggaccaggtacctacgtaccgtcttaccgacctacttacaacccggaactccgtaacggtactcccggtactaacggttaacttttacggtccgtaaagttttaaccgttaacctgtttaaccgacgttacctaccgggtaaacgtaaggtaccaccggttctaaacgttactttccggtaacctttcccggtaccgttacggaaccgtaaacgnggttaactacgtacaaacggtatacggtacgtcgtacactaaccgtcttaacgtcgtacctttaccttaagtcccttccccgg

SEQ ID NO: 111351 - DNA, 788 bp, Homo sapiens
  misc_feature: GYAE6OF02FWFNE.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccggggaacgcgcccacctctcctgcgacgggcccggccagacttgttcgaacaacgtacttacgccgtacggtaaccaacgagaacgccgtcggaccgacggtcctacccgaggtcctccctcacttctatagtactaccttccgaggtacgggacctacgtcggacctaccgtacccgacggcccgtcttacacggtcggacgtaggttcggggtcgtacggggaacctacggtacctttaccgaccgttcctaccacctactacccaaccgacgtacccgtaggaccgtccgttaggtaaacgttagttttacgacgtttaacgttttaacttaccgttcgtaccgtaacgtacccgtaaaccgggttaaaggtaacgggttccggtacccttaaccgttaacttaaccgtttacccgttaaccggtttttcccgggaccccgtttaccggggaaaaccgttaaacggttaggtaacgttaacctaaccgtaaaaccggtacggttacgggtacggtaccctacggtacccgtaacccgttactttccggttaccgtttaccgttaccgttaccgttcccgttacccccg

SEQ ID NO: 111352 - DNA, 693 bp, Homo sapiens
  misc_feature: GYAE6OF02J00YJ.23.88.H11.1.454.CMB.1.raw
  modified_base (678)..(678): a, c, t, g, unknown or other
  misc_feature (678)..(678): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacatagtctccagccaccctgtctttgtcgtccgggggaacgacgccaccctctcctgcgagggccggccagactgttgacaacgacttagcctaggtaccaacagaacgcctggaccaggcctacccgaggcctcctcatctatgactaccttcaggtacggccaacgtggaccacgtaccccgacgtaccccgctttacgaggttcgggactacggttcggggtcgttaggggaccaggtaccttaccgacttcgtaccgaaccctataccgaaccctaagtcccttaagacgtaccgtacgtaaacgttagttttacgacttaagtttacttaactcgttactacgacgtaacgtaaacgtacgtaccggtccttaacgtaagttacttaccgttaccgtttccggacccgttaagggtaacccgtaaaggtcggtaaacttaccgtacgaaaaccggtaattacggggtactacggtacgacgtaaccgtacttaccgtgttacccgttntaccttcctaccccg

SEQ ID NO: 111353 - DNA, 722 bp, Homo sapiens
  misc_feature: GYAE6OF02J2LKC.23.88.H11.1.454.CMB.1.raw
  modified_base (498)..(498): a, c, t, g, unknown or other
  misc_feature (498)..(498): n is a, c, g, or t
tcagacgcgagtatcacgaccggtgctcgatttagcgacagcgagaacacacaaagggggaggaactgctcagttaggaccagagggaacatggaagccccagctcagcttctcttcctccgtgctactctggctcccagattccaccggacgaaattcgtgttgacacagtctccagccacctgtcttgtcgtacggggtaacacgccacctctcctagcgacgggccggcagacgttgttacgaaccaacgtacttacgccgttacggtaccaacgtagaacgtccgtacggaccctagggtcctcccgtaacggtccttaccgtacattccgtaactcggtaacttccgttaccgaacggttacgggcccttaacgtcggtacctaaccgtacccgtacggtacccctcgtttaccgtacggtacgggtacctacgggttcgggtaccgtacggggaactacgtaaccgttcgtaacctcgtaacctacgtaacnccgtaccgtactaccgacgtacgtaccgtaagtaacgttcgtttacgactttaacgtttactacgttacgtactaacggaccgtaaacggttacgaacgttccggaccttaactaatacgtttacctacggttaccgtaccgtacgaaccgtaaggtcgtaactacgtacaacggtcgtacgtgacgtacgaccacgtactcgttatcctctaccgtacctccg

SEQ ID NO: 111354 - DNA, 775 bp, Homo sapiens
  misc_feature: GYAE6OF02H6RG1.23.88.H11.1.454.CMB.1.raw
  modified_base (322)..(322): a, c, t, g, unknown or other
  misc_feature (322)..(322): n is a, c, g, or t
tcagacgcgagtatcacgaccggtgctcgatttagcgacagcgagaacacacaaaagggggaggaactgctcagttaggacccagagggaaccatggaacgcccagctcagcttctcttcctcctgctactctggctacccagacttccgaccggcgaaattgtgttgacacagtctccagccacctgtctttgtcgtccgggggaacgcgccacccttctcctgcgagggccgcagacgtgttacgacaacgacttagcctggtaaccaagagaacgtccgtggaccaggcctacccgaggcctcctacgactcttaagtntacttacctttccgaaggtcggaccacgtcggcacgtcccacgccctcttacgagtcggctagggtcgggttcgaggggtacaacgggttcttccgaatttcccgtaccacctaccgttaccacccggtaacgtccgttaaacggtccggtacccgttaggtaaacgtttacgtttttacggaaccgttttaaagtttttaccgttaacgttagtttacccggaccggtaacttaaccgggttaaagttaacggttacccgggtacccttaacgtaaacgtttacgtttacccgtttaaccgtttcccgggttaacccgggttaacgggtaaacccgtaaggttaacgggttaacgtaacgtaaccggtaaacgtaccgttcggtacgaccgttacgtaaccctacccgttacgttccgtagttccgtttaccgtaccgtttccctaccccgg

SEQ ID NO: 111355 - DNA, 885 bp, Homo sapiens
  misc_feature: GYAE6OF02HR8RK.23.88.H11.1.454.CMB.1.raw
  modified_base (142)..(142): a, c, t, g, unknown or other
  misc_feature (142)..(142): n is a, c, g, or t
  modified_base (183)..(183): a, c, t, g, unknown or other
  misc_feature (183)..(183): n is a, c, g, or t
tcagacgcgagtatcacgaccggtgctcgatttagcgacagcgagaacacacaaagggggaggaactgctcgagttaggacccagagggaaccatggaagccccagctcagtcttctcttcctcctgctactctgctcccanagttccacggcgaaattgagttcgacacgagttcctccganccacccttgtcctttagcctaccggggggaacacgtcccaaccccgttcgttcctcggaccgtacggggacccggtcctaaggtacccttggtttacggaacctaaaccggtacttttacggacccgttacggggttaaccccaaaacgtaaggtaaccggtccccttagggggacccttaacggggtccccttacccccggtaacggttccccgttacccccgttactaaccgttaccgttaacgtcggtttaaactttacccccgttttaccggaaaccggggtttccgggacccctaacggttcgggttaccaacctttaccccccggagttacccccgtatttaccggacgtttaccgggcttaacgggtccgggttcaacgggggttaaccacggtacgttttcccgaacttccgtacgtacgtactcccgaaaaccgcgttacccgtacgacgtccctacggtaaacgtttacgtttacgtccgttaacgtttaacgttacgttaccgtacgtaccgtaacgtaccggttaaagtaccgtacgggtaccctaaccgtaatttaccgtaccgtacgtttccggtaccggttacgtaccgtaaagttacgtacgtaccgtaacgtaacggtaacggtcggttacggacgtacgcctacggttacttacgtcgtttaccttcgacgtttcccgttaccg

SEQ ID NO: 111356 - DNA, 695 bp, Homo sapiens
  misc_feature: GYAE6OF02J22XC.23.88.H11.1.454.CMB.1.raw
  modified_base (174)..(174): a, c, t, g, unknown or other
  misc_feature (174)..(174): n is a, c, g, or t
  modified_base (688)..(688): a, c, t, g, unknown or other
  misc_feature (688)..(688): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggcctcccgagacttccaccggtcgaaagttgtgttgacacngtcctccacgccacctgttctttgtcgtaccggggacacgccctaccctctcctcgcgacgggccggcagacttgtagacacgtacttagcgtacgtaaccaacgagacgccgtgccacggcctccgaggcctaccctgactctaacgtctaactcctacgtaggtaccggcctagtcggactaccctccgacgtcccgtattcgcgttcggcgtacggtgtacgacggactacgtaccgtacctacgttcaccgaacctacgtacccacgaactccgtaacgtacgtcctaaggtaactttccgttaggtaacctttacgttttacctacgtaccgttacgacgttaccgtaccgtagtacccgttaagttacccggttagttccggttaccggcgggtaaccgtaccgtacggtacctaggaaacctccgttaacgacggttacacggtttagcccggtatacccgtaactaccgtgtttcccgttaccgtacttcccgtactttaccccgnttacccg

SEQ ID NO: 111357 - DNA, 672 bp, Homo sapiens
  misc_feature: GYAE6OF02IUE0G.23.88.H11.1.454.CMB.1.raw
tcagacgcgagtatcacgaccggtgctcgatttagcgacagcgagaacacacaaagggggaggaactgctcagttaggacccagagggaaccaatggaagccccagctcagcttctcttcctcctgctactctggctccagattccaccggcgaaattgtgttgacacagtctccagccacctgtctttgtcgtccggggaacgacgccaccctctcctgcgacgggccgccagactgtcgacaaccgtactacgccgtacgaacctaacacgtacgccgtacggaccgacggccctcccgaggtcctcctcatctatagacttacgttaccgacggtacggacctacgtcggaccacgtcccacgccctactcgagtcgcgacgtggtacgtaggacgagtacttaccacttcctacacctacgtccaaccgcgtacctagcgtaccgtagtaaacgtttcgtttagaccgttaaggtttactttaaccgtgttaccgtacgtacgtaaccggttaagaaccgggtcctaacctactacgttacttccgttacgttcccgggtaccgtcgggtaaacctaggtacgtaacttacggaactaacggtaccgtggtccgtactacgactaccgtacgttaccttcggttacttacccgtacgttccctacccg

SEQ ID NO: 111358 - DNA, 712 bp, Homo sapiens
  misc_feature: GYAE6OF02FQ0PX.23.88.H11.1.454.CMB.1.raw
tcagacgcgagtatcacgaccggtgctcgatttagcgacagcgagaacacacaaaggggggaggaactgctcagttaggacccagagggaaccatggaagccccagctcagcttctcttcctcctgctactctggctcccagattccaccggcgaaattgtgttgacacagtctccagccaccctgtctttgtcgtccggggggaacagcccaccctctcctgcagggccgccagctgtcgacaacgacttagcctggtaccaacgagaacgcctggaccaggtcctcccaggcctccctcattctatgtacttaccttaccgaggttacgggccctaacgtcgggtaccaacgttcccccgaaggtcccccgtacttttaccgagggttacgggcctaagggtttggggtaccgttcgggggtaaacctaaggttaaccctttacaaccgttcctaccgtaacccctattcccaaacccgacgtaccctaggtacgtacccgttaaggtaaagtttacgttttacgacgtttaaggttttaacttacgtgttacgagtaccgtaacgtaaagagtccgtaccttactaactactttcaccgtttccggacccgttagggtaacctaaaggttgtatactaaccgtaaacgtacgtgtacgtccgtacgtaccacgtacttcgttacgttcttacctacgttcccttccccg

SEQ ID NO: 111359 - DNA, 758 bp, Homo sapiens
  misc_feature: GYAE6OF02HJQPL.23.88.H11.1.454.CMB.1.raw
tcagacgcgagtatcacgaccggtgctcgatttagcgacagcgagaacacacaaagggggaggaactgctcagttaggacccagagggaaccatggaacgccccagctcagcttctcttcctcctgctactctggctcccagattccaccggcgaaattgtgttgacacagtctcagccacctgtctttgcgtaccgggggaacacgccacctctcctgcacgggccgaccagtacgtgttcgaactaacgacttacgcctggtaccaactagaacgtccgtggaccaggcctccgaggcctctcgactctagtcgacttaccttcgaagtacggccactggacctactaccgacgcctacttacgacgtcgcgtaggttcggtacggcggtacacgtactacgacttccgactacctacgtaccaacgaccgtctaacggaccgacgtaagtaacgttacgttttacgagtttaacgtttacttacggtcgtaacgaacggtcccgtaaacgggtaaacggtaacggtaccggtaacccttaaccgtaaagtttacccgttaccgttacccggtttacccggtacccggttaacgggtaaacccgtaaaggttaaccgggtaactttaaccggtaaccggtaaaaccgttaccgggttacggtacggttcccgtttaacccgggaacccttaaccggttaccgttaaccggttaccgtttacccggtttacttaacccggtttcccgttaaccccgg

SEQ ID NO: 111360 - DNA, 705 bp, Homo sapiens
  misc_feature: GYAE6OF02HUFBW.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctccagattccaccggcgaaattgtgttgacacagtctccagccaccctgtctttgtccgtccgggggaacgacgccaccctctcctgcacgggccgcacgactgtgacaacgacttagcctggtaaccaacagaacgccgtggaccaaggcctacccgaggcctcctacatctaatcgtactaccttccaaggtacggccacgtggaccacgtccccaggccccgtcttcgacggtcggactaggttcggggtcctaggggactaacggtactttcgaccgttcctaccaaccctactccaacccgtacggtcccgtaagaccggtccgttaaggtaaacgttacttttcgactttaaggttttacttaacgtgttaacgtaacgtaccgtaaaccggtaaaggtaacggtaccggtaccctactaaacttactttaccgtaccgttttccggacccgttacgggaaacctaaaggtacgttaactacgtaaccgtaaacgtaacgtggtaacggtcgtacggtacctacgtacttaccgttacttcgttactaccgtttccttaccccg

SEQ ID NO: 111361 - DNA, 595 bp, Homo sapiens
  misc_feature: GYAE6OF02GWH42.23.88.H11.1.454.CMB.1.raw
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacgagcccaccctctcctgcacgggccgccagactgttgacaacgacttacgcctcggtaccaacagaacgccgtaggccaggcctcccgaggcctcctcatctatgataccttccaggtacggccacgtggccacgtccccacgcccgtcttcgaggtcggctaggtcgggtctgggacagtactcactcncacntcacagcctagacncgtagacttatttacgcttagtttactacgtcgtatacgactaacgtagtagtccgtacctactaacgttacttccgttaccgttccggtccgtagggaaccgtaaggtacgaattacgtaccgaacgtacgtggtacgactacgactactcgttctacgttctacgttctcccgttacccg

SEQ ID NO: 111362 - DNA, 666 bp, Homo sapiens
  misc_feature: GYAE6OF02GTQHE.23.88.H11.1.454.CMB.1.raw
  modified_base (301)..(301): a, c, t, g, unknown or other
  misc_feature (301)..(301): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcgagggccggccagacctgttcgacaacgacttacgcctggtaaccaacgagaacgtcctggccaggcctcccaggctcctnatctatgatacttccagtacgggcctacgtggccactcccagccccgtctttccaggttcggctaggtcggggtctaggggactaacggtacttcgactcctaccacctaactccaacccgagtacctaggacgtaccgtagtaacgttattttacgcgttaaggttttacttaaccgttgtactacgaccgttaacggtaaggaacgtcggaccctactaaacttacttaccgtaccgtttccgggacccgttacgggaaaccctaaaggttggtaactaacttaccgaaacggttacgtcggtacgtccgttacgacctaacccgtagttccgttacgttccttactacgttcccgttacccg

SEQ ID NO: 111363 - DNA, 738 bp, Homo sapiens
  misc_feature: GYAE6OF02HUSBW.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagacttccaccggcgaaattgtgttgacacagtctcagccacctgtctttgtcgtccgggggaacgagccaccctctcctgcgacgggccagtcgagagttgttgccgactcgttcggccgtggtaccaaacaaaaaccgtcgccacgcctccgaggctcgtactattcagtcggcacacaccaacgagggccacgtcgcactcccgaggacgtaggttacaggtcgacgtaggtcggtccgttacgtaggggacctaacggttacttaccgacttaccgtacgaaccgtacgttaccgacggtacctacgttacgggtccccggtaacccgttaaggaaccgtttaatttttacggacgtttaaatttttaccgttaacgttcgttacgtacggtaccgttaaacgggttcgggtacccgtaccgttcggtaacccttcttacccgttaccccgggttaccgggacccgttaaaggggtaccttaccgggaacgttggggaacgtaacgtaacggaaaacccggtcgttacggtacggtcttaacggtaccgaccgttacggttcgttaccggtttacctttcgacgttttacccccg

SEQ ID NO: 111364 - DNA, 824 bp, Homo sapiens
  misc_feature: GYAE6OF02I9E08.23.88.H11.1.454.CMB.1.raw
  modified_base (206)..(206): a, c, t, g, unknown or other
  misc_feature (206)..(206): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctccagattccaccggcgaaattgtgttgacacagtctccagccaccctgttctttgtcgtccgggggaacncgccaccctcctccgtgcgacgggccggccagactgttgaacaaccgtacttacgccgtacggtaccaacgaggaacgtccgtacggccacgggcctccccgaggtcctcccctgtactccttatcgacttaccgttaccgaggttaccggggccctacgtcggacctacgtcccccgacggtcccccgtacgttccgaggttcggaccgtagggtcgggggtctaggggaaccgtacggtaccttacctaccgttcctaaccgaccctactaacccgaacccgaacggtcccgttaacggaaccgtcccgttagtaaagtttacgttttagtacgttttaagtttaacttttaccgttagttccgtaacggttaacccgtaacccggttaaaggtaccggttccggtaccgttacccttaaagtttaccgtttaccttaccggtttttaacccgggtccccgttaacgggtaacccgtaaaaggtttacggtaaacttaaccgtaaaccggtaaaccgttaacgggttacggttaccggtacgtaaccgttacctaacccgttagttacccgtttcggtaccctttttaacccgtaccgtttacccccggtttcccg

SEQ ID NO: 111365 - DNA, 659 bp, Homo sapiens
  misc_feature: GYAE6OF02H94YQ.23.88.H11.1.454.CMB.1.raw
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (637)..(637): a, c, t, g, unknown or other
  misc_feature (637)..(637): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtcgtccgggggaacagccctaccctctcctgcgacgggccgaccagacttgttgaactacgacttagcctaggtaccaanagacgcctcggaccaggcctccgaggcctcctacnctctatgtactaccttacgaggtacggcctacgtggccacgtccccgagtccccgtattccggaggttcgggctaacgggttcggggtcgtacggggactacgtaccgttacaccgtcgtaccaccgttactacccaaccgacgtaccgtaagtaccgtaccgtaggtaaagttacgtttacgtacgttagtttaacttcgttacgtacgtaacgtcgtaacggtaaagtacgtaccgtacctacgtaactttacttccgttaccgttccggtaccgtacggtaaccgtaagtagtaatacgtacgaagtacgtgtcggtctcgtacactntcgtctactctacgtcttaccg

SEQ ID NO: 111366 - DNA, 712 bp, Homo sapiens
  misc_feature: GYAE6OF02GP951.23.88.H11.1.454.CMB.1.raw
  modified_base (206)..(206): a, c, t, g, unknown or other
  misc_feature (206)..(206): n is a, c, g, or t
tcagacgcgagtatcacgaccggtgctcgatttagcgacagcgagaacacacaaagggggaggaactgctcagttaggacccagagggaaccatggaagccccagctcagcttctcctttcctcctgatactctggctcccagattccaccggcgaaattgtgttgacacagtctccagccaccctgtctttgtctcgggggaacncgccaccctctcctgcgagggccggccagactgtgacaacgacttacgcctaggtaccaagacgaagcctggccgaggtcctacccgaggcctccctcatcctatgattaccttccgaggtaccggccacgtgccactcccgacgcccgtcttgacggtcggacgtaggttcgggtcgtaggggacctggtacttcaccttctaccaccgacttaccgaacctacgacctaacgacgtaccgtaagtaacgttacgttttagactttaacggtttaacttaccgttacgtacgtacgtacccgttaacggtaaacgtaccggtacggttacccgttaactaaactttaccgtttaccgttacccgttttccgggtaccccgttacggggtaaacccgtaaagggttcggtaacttaacgttaaccgaaacggttacggtacggttacggtaccgtcgtaccctacttacgttccgttacgttctttacgtaccgttcccttacccg

SEQ ID NO: 111367 - DNA, 820 bp, Homo sapiens
  misc_feature: GYAE6OF02JUNH1.23.88.H11.1.454.CMB.1.raw
tcagacgcgagtatcacgaccggtgctcgatttagcgacagcgagaacacacaaagggggaggaactgctcagttaggacccagagggaacatggaacgccccagctcagcttctccttcctcctgctactctggcctcccagtacttcccgaccggaccgtaaattgtcgttgacacgtacgtctccacgccctacccttgttcgtttcgtaccggtaccggggggaacgacgtccctaccctccgtccgtcgaccggacgggtccccgaaccgagtaccttagttacggaaacctaacggtaccgttaacggcccgtaaccgtaaccgaacgtaggtaaccgcgtccggccgacggtaccctaccgaccggtacctccctacacgttcctagtaccgtacttaaccgtccgtacgggtaccggacgtaccgtcggtacctacccggacctaccggtacccgtacgttacggaccggtcgggtaaccggtgggttcccgggtggtaacgggaccgtaacgtaccgttaaccctcgttacccgtaacccgtacccaactaccccgtaacaccgttaccgtacgtacggtaccgtagtaagttcgttacggtactttagttacttcttacgtacgtactaaccgtaacgttaacgaccggtctaaccgttacgtactttacgtaccgttaccggttacccggaccgttacggtaaccgtaaggtacgtaacgtacgtacccgtaacgttacgtaccggtactacggcctaccgtaacccgttagttaccttacggttactaccgttccgttaccctacccg

SEQ ID NO: 111368 - DNA, 793 bp, Homo sapiens
  misc_feature: GYAE6OF02G7L0S.23.88.H11.1.454.CMB.1.raw
  modified_base (225)..(225): a, c, t, g, unknown or other
  misc_feature (225)..(225): n is a, c, g, or t
tcagacgcgagtatcacgaccggtgctcgatttagcgacagcgagaacacacaaagggggacggaactgctcagttaggacccgagagggtaaccatggaagccccagctcagcttctcttcctctgctactctggctccagattccaccggcgaaattggtgttgacacagtctaccagcccaccctgtctttgccgtaccgggggaactacgcccaacccgtntccgtagtcgaagggcccgacagacttggttacgaactaacggactttaggccgttagggaccctaaacgaggaacgtccgtaggcccgaacgggtccctaccccgacgggccttacccgtactaacttaccgtatacgggtaactttaaccccttttccggaaggttaaccggggcccctaacggtttcggaaccaccgttccccgaacggtccccgtaacgtttccgaaggttcggaccgtaggttacggggtctacggggactacggtactactcgttacctaccgtacctaacgtaccgtaccctacggttcccgaacgtaccggcccgtagggtaaaccggtttagtttcggaaccgtttagttttactaaccggtcgttaacacgaccgtaacggtagtaaccggttcggtaccctaacgttaagtaccttcgtaacgtttccggaccttacgggtaaaccaggttagaccgtttaacgaccgtaaaccgtacggttagcggtcctacggtccaaccgttcttaaccgtccggttaactttcctaccgtttcccgttacccg

SEQ ID NO: 111369 - DNA, 1200 bp, Homo sapiens
  misc_feature: GYAE6OF02ICVB2.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggcctccagtacttcccgaccggtacgtaaatttggttaggttcaacctacgtaacggttcccttacccgaacgtcccccgaacccccttggtttacccgttttttcgggtcccgtttaccccgggggggggaaaccgtaccggaccccctaaaccccctttcccgttcccgttccgggaccggtacccgggggcccccgggtcccaaaacggtacccgtttagggtttacccggaaaccctaaccgggttaacccttttaaccggccccgttacggggtttaaaaccccaaaccggttaaacgggtaaaaccggtacccccgtttaaccggggggaccccgtaacccggggtccccgttaccccccggaacggggttacccccgtttcccccgttccggttaaacctttccggtttaacgtttaacgtttaaaccccggttttaacccccgttttaacccccggggttaaaggggggtttaaccccgggggtacccccgttaaaccccggttgggggtaaaccccccgtaaaacccgggttttaccccccccgaaacccccgggggttttcccccccggttacccccttttaccccgggggttaaagggggtttccccggggaaacccggtttaaccgggggttttacccgggggggtcccgggtttaacggggggttaaaacccccgttacggggttttaaacccccctttttacccggaccccgtttttaaacccccgttaccccccgttaaacccgttaaaccccgttaacccccgaaacccgggtttaacccgtttaaccccccgggttaacgggacccgtttaaaccccggtttaagggtaaaccggttttttacggttttttaaacccggttaccttttaaaacgggtttttaaccgttaaccggttacccgttttaaccggaccgttaaaccccgggttaaacccggggttaaaacggttaccgggtttaacccggtaaccccttaaccgtttaacttaccggtttaccccgttacggttttaaccccgggttacccggttaaacgggttaaccggtaaa

SEQ ID NO: 111370 - DNA, 1035 bp, Homo sapiens
  misc_feature: GYAE6OF02HPSN6.23.88.H11.1.454.CMB.1.raw
tcagacgcgagtatcacgaccggtgctcgatttagcgacagcgagaacacacaaaggggggaggaactgctcagttaggacccagagggaaccatggaagccccagctcagcttctcttcctcctgctactctggctccagattcccaccggcgaaattgtgttgacacagtctccacgccctaccctgttctttcggtccggtaccgggggaacgaccgcccctacccttcctccgtcggccggaccggggtcccggaccgacggtaccgttcggttacggaaaccgtaaaccggtaaccgtttacgtacccgtacgggttaaacccaaacgaacggaaccggtccgtcgggacccgaacggcccggttaccccgacggtccccttacctacgtacttacgttaatcggtaactttaccgttaccggtaggtaaccgggaccctacgtcggacctaccgtacccgcgtcccgtcgttaccgaggtcggtacggtaggttccggggtcggttacggggaaccttacggtaccgtttaccgtaaccttcccttaacccgtaacccgttaccgttacccgaaacccgttaccgggttaacccgttaaaccgggtaccgtaacccggttaacgggttttaaaacggtttaccgttttaccggttaacgttttaaacggttttaaccgtttaaacggttccgtttaacccggaaacgggttaaccccggttaaaaccgggttaaacggggtaacccggtttaaccgggtaaacccccggttttaaccttaaaacggtttttaacccgtttaaccccgttttaaccgggtttacccccgggtaaaccgggtttacccgggtttaaaacccgggttaaacgggtaaaccgggtttaacttaaaaccggtaaccggttaaaaccccgggtttacggtacggggtttaaacccggtcgttaaaacccggtacccgttaaacgttcctttacccgggtttactttaacccggtttacccttacccggtttaccccggttacccc

SEQ ID NO: 111371 - DNA, 717 bp, Homo sapiens
  misc_feature: GYAE6OF02F627F.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggctcccagattccaccggcgaaattgtgttgacacagtctccagccaccctgtctttgtctccggggaacagcccaccctctcctgcgacgggccggccagactgttcgacaacgtacttagcctggtaaccaacgagaacgcctggccaggcctacccgaggcctcctcattcctatgattaccttccgaggttaggcccacgtcggacactccccgaggtccccgtctttaccaggtcggggactagggttcggggtacccgtggggtaacctaacgggtaccctttacgaacccgttaccttacccgaaacccgacttaccccgtaacccgacgggttaccccgttaacggacgtaccccgttaggtaaaccgttagtttttacggacgtttaaggttttaactttaaccgttcgttaaccgacgtaccgtaaaccgttaaggaacgtcggtaccctaacctaagttaacttccgtaccgtttccggacccgttacggaacctaaggtacgtagttactacgaacgtacgtaggacgtcgtagacctacgtacttcgtcgttactacgtcttaccttcccg

SEQ ID NO: 111372 - DNA, 745 bp, Homo sapiens
  misc_feature: GYAE6OF02F8LSZ.23.88.H11.1.454.CMB.1.raw
  modified_base (175)..(175): a, c, t, g, unknown or other
  misc_feature (175)..(175): n is a, c, g, or t
tcagacgcgagtatcacgaccggtgctcgatttagcgacagcgagaacacacaaagggggaggaactgctcagttaggacccagagggaaccatggaagccccagctcagcttctcttcctcctgctactctggcctccagattccaccggcaaattgtgttgacacagtctcanccacctgtcttgtcgtacggggacagccacctctccgtgcgcgggtccggccgagtacgtgttcaacgaacgtactacgcgtacgtaacaacgtaacgtaacgccgtacggaccgacggtacctaccccgtacggtaccttacccgttactaacgttcctaagttaaccgtacttaacccgttaccgtaacgggtaacgggtaccctacgtcgggtaacctacgttacccgaacggtccctacgttacgacggtacgccgtaggtacggtcgtagggacctaaggttacctcgaacgtctaccgacctataccaccgaccgaacgtacgtacgacgtacgttaacgtacgtttagtaacgttatttaacgtactaggtactacgacgtaaaccgttagacgtacggaccttactaacgtacgttaccttaccgttaccgtaccgttaacggtaaccgtaaaggttcgaacgttactacgtaaacggtaccggttaggttaaccggtcgttaccggtaacctacgttaccgtcgtttaccgtccctttaacgtaccttaccccggttaccc

SEQ ID NO: 111373 - DNA, 827 bp, Homo sapiens
  misc_feature: GYAE6OF02GYGWA.23.88.H11.1.454.CMB.1.raw
tcagacgcgagtatcacgaccggtgctcgatttagcgacagcgagaacacacaaagggggaggaactgctcagttaggacccagagggaaccatggaagccccagctcagcttctcttcctcctgctactctggcctccagacttccaccggcgtaaattgtgttgacactagtcctccacgacccacccgttgttcctttgtaccggttaccgggggaacgacggtccctacccttcgtcctaggcgacgggccggacctagtaccgttcgttacgaacctaacggtacgttacgcccgtacggtaaccaacgtaacgaacggtcccgttcggacccgacggtacccgtccccgaacggtcccttcctaaccgtacttaccgttagtacgtaacttacccgttacggtaacgggtaaccggtacctaccggtcggtaccctacggtaccccgtaccggcccgtttcgttaccgtacggtcggtacggtacggtcggggtaccggtgggaacctacgttaccgttaccacgttacctaccgaccgttacgtacccgaccgtacgtacctaacggaccgtaccgtagttaacgtttacgtttacgtaacgttttaacgtttacggtacctacgtacggtaacccgtacgtaaaccggtagttaaacgtcccgtacctacttaacgttaccttcgttaaccgttccgggtacgtaaccgggttaacgtaaacgttaggaacttaaccgtagtaaccgtacggttaacgggtctacccgtcgacccttcgttacgtctttacgtccctttaacgtccttaccgtaacccg

SEQ ID NO: 111374 - DNA, 728 bp, Homo sapiens
  misc_feature: GYAE6OF02JVO8Z.23.88.H11.1.454.CMB.1.raw
  modified_base (416)..(416): a, c, t, g, unknown or other
  misc_feature (416)..(416): n is a, c, g, or t
tcagacgcgagtatcacgaccggtgctcgatttagcgacagcgagaacacacaaagggggaggaactgctcagttaggacccagaggaaccatggaagcccagctcagcttctctcctcctgctactcgtggcctccagacttccaccggacgtaaagttgtgttcgaactacgtagtcctccgaacgtcccaacccttgttcgtttagtccggtaccgggggaacgtacgacccctacccgttcttccgtcggaccgtacggggtcccgccgtacgacgttcgtacgaaccgtacgtactactacggtacgtaaccaacgacgaacgcgtacgcgtacgccgtcgcggactcacgtatcgtagtctacgtaccgttacgtacggacgaccgttaacgcggtaccacggttacccnccggtaccctacgtaccgtacggtcgtacggtcggtaccgggtcgacgggtacacgtctagacctcctacgaccctagcccaactcgacgtacgtacgtaccgtacgtaatacgtttcgtacttacgttactacgtacgtaccacggtaccgtaacggtaacttacggtcgtaccgttactaacttacgttacgttacgttccggtaccgttaccgtaaccgaagttacggtactacgtacggtaactcggtacgtacggtactacgtaccgacgttacgtccgtatacccgtacgttaccttccccgaacg

SEQ ID NO: 111375 - DNA, 221 bp, Homo sapiens
  misc_feature: GYAE6OF01DWEFK.45.36.D03.1.454.CMB.1.raw
  modified_base (218)..(221): a, c, t, g, unknown or other
  misc_feature (218)..(221): n is a, c, g, or t
tcagacgcgatcgacacgaccggtgctcgatttagctgcgtcacgatctctcttggggaggaactgctcagttaggacccagacggaaccatggaagccccagcgcagcttctcctcctcctgctactctggctcccaggaactgtggctgcaccatctgtcttcatcttcccgccatctgatcgatcgcgtctgagcgggctggcaaggcgcatagnnnn

SEQ ID NO: 111376 - DNA, 210 bp, Homo sapiens
  misc_feature: GYAE6OF01A8BKO.45.36.D03.1.454.CMB.1.raw
  modified_base (209)..(210): a, c, t, g, unknown or other
  misc_feature (209)..(210): n is a, c, g, or t
tcagacgcgatcgacacgaccggtgctcgatttagctgcgtcacgatctctcttgggtttggggaagaggaagactgacggtcctcccaggagttcaggtgctgggcaccttgggcacggggaggtgtgtcacaagatttgggccctgggctgcctggtcaaggactacttcctcgatcgcgtctgagcgggctggcaaggcgcatagnn

SEQ ID NO: 111377 - DNA, 223 bp, Homo sapiens
  misc_feature: GYAE6OF01BMA8Q.45.36.D03.1.454.CMB.1.raw
  modified_base (220)..(223): a, c, t, g, unknown or other
  misc_feature (220)..(223): n is a, c, g, or t
tcagacgcgatcgacacgaccggtgctcgatttagctgcgtcacgatctctcttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnn

SEQ ID NO: 111378 - DNA, 273 bp, Homo sapiens
  misc_feature: GYAE6OF01E5FP5.45.36.D03.1.454.CMB.1.raw
  modified_base (271)..(273): a, c, t, g, unknown or other
  misc_feature (271)..(273): n is a, c, g, or t
tcagacgcgatcgacacgaccggtgctcgatttagctgcgtcacgatctctcttgggtttgggggaagaggaagactgacggtcctcccaggagttcaggtgctgggcaccttgggcacggggaggtgtgtcacaagatttgggctctgggcaccgtgggcagtgggggaggtgtgtcacaagatttgggctctgggcacagcggccctgggctgcctggtcaaggactacttcctcgatcgcgtctgagcgggctggcaaggcgcatagnnn

SEQ ID NO: 111379 - DNA, 297 bp, Homo sapiens
  misc_feature: GYAE6OF01DQQ7S.45.36.D03.1.454.CMB.1.raw
  modified_base (271)..(297): a, c, t, g, unknown or other
  misc_feature (271)..(297): n is a, c, g, or t
tcagacgcgatcgacacgaccggtgctcgatttagctgcgtcacgatctctacgttgggttttgggggaagaggaagactgacggtcctcccaggagttcaggtgctgggcaccttgggcacggggaggtgtgtcacaagatttgggctcctgggcaccgtgggcatgggggagtgtgtcacaagatttggctctgggcacagcggccctgggctgcctggtcaagtactacttcctcgatcgcgtctgagcggctggcaaggcgcatagnnnnnnnnnnnnnnnnnnnnnnnnnnn

SEQ ID NO: 111380 - DNA, 232 bp, Homo sapiens
  misc_feature: GYAE6OF01C2QRE.45.36.D03.1.454.CMB.1.raw
  modified_base (228)..(232): a, c, t, g, unknown or other
  misc_feature (228)..(232): n is a, c, g, or t
tcagacgcgatcgacacgaccggtgctcgatttagctgcgtcacgatctctcttggggagagctctggggaggaactgctcagttaggacccagacggaaccatggaagcccagcgcagcttctcctcctcctgctactctggctcccaggaactgtggctgcaccatctgtcttcatcttccgcatctgatcgatcgcgtctgagcgggctgggcaaggcgcatagnnnnn

SEQ ID NO: 111381 - DNA, 235 bp, Homo sapiens
  misc_feature: GYAE6OF01AU4C8.45.36.D03.1.454.CMB.1.raw
  modified_base (231)..(235): a, c, t, g, unknown or other
  misc_feature (231)..(235): n is a, c, g, or t
tcagacgcgatcgacacgaccggtgctcgatttagctgcgtcacgatctctcttggggcagagctctggggaggaactgctcagttaggacccagacggaaccatggaagccccagcgcagcttctcctcctcctgctactctggctcccaggaactgtggctgcaccatctgtcttcatcttcccgccatctgatcgatcgcgtctgagcgggctggcaaggcgcatagnnnnn

SEQ ID NO: 111382 - DNA, 181 bp, Homo sapiens
  misc_feature: GYAE6OF01E1VEA.45.36.D03.1.454.CMB.1.raw
  modified_base (180)..(181): a, c, t, g, unknown or other
  misc_feature (180)..(181): n is a, c, g, or t
tcagacgcgatcgacacgaccggtgctcgatttagctgcgtcacgatctctcttgggtttggggaagaggaagactgacggtcctcccaggagttcaggtgctgggcacagcggccctgggctgcctggtcaaggactacttcctcgatcgcgtctgagcgggctggcaaggcgcatagnn

SEQ ID NO: 111383 - DNA, 235 bp, Homo sapiens; identical to SEQ ID NO: 111381
  misc_feature: GYAE6OF01BSDZP.45.36.D03.1.454.CMB.1.raw
  modified_base (231)..(235): a, c, t, g, unknown or other
  misc_feature (231)..(235): n is a, c, g, or t

SEQ ID NO: 111384 - DNA, 259 bp, Homo sapiens
  misc_feature: GYAE6OF01C74EL.45.36.D03.1.454.CMB.1.raw
  modified_base (255)..(259): a, c, t, g, unknown or other
  misc_feature (255)..(259): n is a, c, g, or t
tcagacgcgatcgacacgaccggtgctcgatttagctgcgtcacgatctctcttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggccctgggctgcctggtcaaggactacttcctcgatcgcgtctgagcgggctggcaaggcgcatagnnnnn

SEQ ID NO: 111385 - DNA, 510 bp, Homo sapiens
  misc_feature: GYAE6OF01BN4V8.45.36.D03.1.454.CMB.1.raw
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
  modified_base (496)..(496): a, c, t, g, unknown or other
  misc_feature (496)..(496): n is a, c, g, or t
  modified_base (506)..(506): a, c, t, g, unknown or other
  misc_feature (506)..(506): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacngggtccctggcgtcccagacaggttccgnggcaggtgggtctggggacaggagttcactcncaccgtcagcagcctggagcctgatgtattttgctagtttacttctgtcagcagcgttccgccacgccgctctacgtttcggcggggacagggtggagagtgagacgacgtggtggctgcaccntctgtcttcntccg

SEQ ID NO: 111386 - DNA, 272 bp, Homo sapiens
  misc_feature: GYAE6OF01CCGJ0.45.36.D03.1.454.CMB.1.raw
  modified_base (270)..(272): a, c, t, g, unknown or other
  misc_feature (270)..(272): n is a, c, g, or t
tcagacgcgatcgacacgaccggtgctcgatttagctgcgtcacgatctctcttgggtttgggggaagaggaagactgacggtcctcccaggagttcaggtgctgggcaccttgggcacggggaggtgtgtcacaagatttgggctctgggcaccgtgggcagtgggggaggtgtgtcacaagatttgggctctgggcacagcggcctgggctgcctggtcaaggactacttcctcgatcgcgtctgagcgggctggcaaggcgcatagnnn

SEQ ID NO: 111387 - DNA, 513 bp, Homo sapiens
  misc_feature: GYAE6OF01BR1R7.45.36.D03.1.454.CMB.1.raw
  modified_base (446)..(446): a, c, t, g, unknown or other
  misc_feature (446)..(446): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtcagagtattagaacatactggcctggtatcaatacaagcctggccagggtccccggctcctcatctatgatgcttccagcagggccactggcatcccagccaggttcaggtggcggtgggtttggcacgagtacttcactctcacaatcagcagccctaccaacctagaagtattttgctagtctatttactgtacaacagctacagtattcggccnctcacgtttcggcggaggaccgaaggtggagactacgaaacggactgtaggctagcacatcgtgttc

SEQ ID NO: 111388 - DNA, 212 bp, Homo sapiens
  misc_feature: GYAE6OF01DRX28.45.36.D03.1.454.CMB.1.raw
  modified_base (211)..(212): a, c, t, g, unknown or other
  misc_feature (211)..(212): n is a, c, g, or t
tcagacgcgatcgacacgaccggtgctcgatttagctgcgtcacgatctctcttgggttttgggggaagaggaagactgacggtcctcccagtagttcaggtgctgggcaccttgggcacggggaggtgtgtcacaagatttgggccctgggctgcctggtcaaggactacttcctcgatcgcgtctgagcgggctggcaaggcgcatagnn

SEQ ID NO: 111389 - DNA, 272 bp, Homo sapiens
  misc_feature: GYAE6OF01B1ZU6.45.36.D03.1.454.CMB.1.raw
  modified_base (256)..(272): a, c, t, g, unknown or other
  misc_feature (256)..(272): n is a, c, g, or t
tcagacgcgatcgacacgaccggtgctcgatttagctgcgtcacgagtctctcttgggtttgggggaagaggaagactgacggtcctcccaggagttcaggtgctgggcaccttgggcacgggggaggtgtgtcacaagattttggctctgggcaccgtgggcatgggggagtgtgtcacaagatttgggccctgggctgcctggtcaaggactacttcctcgatcgcgtctgagcgggctggcaaggcgcatagnnnnnnnnnnnnnnnnn

SEQ ID NO: 111390 - DNA, 216 bp, Homo sapiens
  misc_feature: GYAE6OF01C3SZA.45.36.D03.1.454.CMB.1.raw
  modified_base (214)..(216): a, c, t, g, unknown or other
  misc_feature (214)..(216): n is a, c, g, or t
tcagacgcgatcgacacgaccggtgctcgatttagctgcgtcacgatctctcttgggggaagaggaagactgacggtcctcccaggagttcaggtgctgggcaccttgggcacgggggaggtgtgtcacaagatttgggctctgggcaccctgggctgcctggtcaaggactacttcctcgatcgcgtctgagcgggctggcaaggcgcatagnnn

SEQ ID NO: 111391 - DNA, 536 bp, Homo sapiens
  misc_feature: GYAE6OF01CFZ4D.45.36.D03.1.454.CMB.1.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
  modified_base (373)..(373): a, c, t, g, unknown or other
  misc_feature (373)..(373): n is a, c, g, or t
  modified_base (423)..(423): a, c, t, g, unknown or other
  misc_feature (423)..(423): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcatcctgtctctgtctccagggganacagccaccctctcctgcagggccagtaggagtgtcagtaagtacttaggctggtaccaacagaaacctggccaggcctcccaggcctcctcatccatgatgcatccaacncgggtccctggcctcccagaccaggttccgtggcagtgggtctgggacagagttcactcncaccgtcagcagctggacgcctgatgtatttgcttagtttacttctgtcngcagtccgttccgccacgtccgctccgtacgtttccgggacgggggaccgtagggtggagagtggagtacgtaagtggtcggcgtcgactacgtactcgtcgttcttcgtacg

SEQ ID NO: 111392 - DNA, 259 bp, Homo sapiens
  misc_feature: GYAE6OF01CXXSA.45.36.D03.1.454.CMB.1.raw
  modified_base (256)..(259): a, c, t, g, unknown or other
  misc_feature (256)..(259): n is a, c, g, or t
tcagacgcgatcgacacgaccggtgctcgatttagctgcgtcacgatctctcttgggtttgggggaagaggaagactgacggtcctcccaggagttcaggtgttgggcaccttgggcacgggggaggtgtgtcacaagatttgggctctgggcaccgtgggcatgggggaggtgtgtcacaagatttgggccctgggctgcctggtcaaggactacttcctcgatcgcgtctgagcgggctggcaaggcgcatagnnnn

SEQ ID NO: 111393 - DNA, 518 bp, Homo sapiens
  misc_feature: GYAE6OF01DSN88.45.36.D03.1.454.CMB.1.raw
  modified_base (340)..(340): a, c, t, g, unknown or other
  misc_feature (340)..(340): n is a, c, g, or t
  modified_base (504)..(504): a, c, t, g, unknown or other
  misc_feature (504)..(504): n is a, c, g, or t
  modified_base (514)..(514): a, c, t, g, unknown or other
  misc_feature (514)..(514): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctctcatccatgatgcatccaacagggtccctggccgtcccagacagggttccgnggcaggtgggtctgggacagagttcactctcaccgtcagcagcctggagcctgatgtatttgctagtttacttcttgtcagcagtcgttccgccaccgccgctcgtacgtttccgggcgggggtaccgagggtggagagtggagacgaacgtgtggctgcaccntctgtcttcntccg

SEQ ID NO: 111394 - DNA, 566 bp, Homo sapiens
  misc_feature: GYAE6OF01BZOVF.45.36.D03.1.454.CMB.1.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaacctggccaggctccaggctcctcatccatgatgcatccaacngggtccctggcctcccagacaggttccgtggcaggtgggtctgggacaggagttcactctcaccgtcagcagcctggacgcctgatgtattttgctagtttacttcttgtcagtctacgtccgttcccgccaccgcccgtcctccgtaccgtttccgggccgggggtaccgaggggtcggaggtagtcggaggaaccggtaacgtggtcgggtccgtggacccaccgtacttcgttacgttcccttcgtacttcccg

SEQ ID NO: 111395 - DNA, 318 bp, Homo sapiens
  misc_feature: GYAE6OF01D82S1.45.36.D03.1.454.CMB.1.raw
  modified_base (315)..(318): a, c, t, g, unknown or other
  misc_feature (315)..(318): n is a, c, g, or t
tcagacgcgatcgacacgaccggtgctcgatttagctgcgtcacgattctcttgggggctctgggagacgagcccagcactggaagtcgccggtgtttcctttcggtgatcatcactgaacacagaggactcaccatggactttgggctgacctgggttttcctcgttgctcttttaagagcttccaccaagggcccatcggtcttcccctggcgccctgctccaggagcacctctgggggcacagcggccctgggctgcctggtcaaggactacttcctcgatcgcgtctgagcgggctggcaaggcgcatagnnnn

SEQ ID NO: 111396 - DNA, 545 bp, Homo sapiens
  misc_feature: GYAE6OF01EUN5C.45.36.D03.1.454.CMB.1.raw
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctcctcatccatgatgcatccaacncgggtccctggccgtcccagaccaggttccgnggcaggtgggtctgggacaggtagttcactctcaccgtcagcagccgtggacgcctgatgtatttgctagtttacttctgtcagcacgtcgttccgccgaccgcccgtctccgtacgtttccgggcgggggtaccgagggtggagagtggaggacggtaacgtggtggcgtcgcaccgtactcttgtccttcgtcgttcccg

SEQ ID NO: 111397 - DNA, 583 bp, Homo sapiens
  misc_feature: GYAE6OF01AGYM8.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcatcttctcttcctcctgctactctggctcccagataccaccggaaaaattgtgttgacacagtctccaggcaccctgtctctgtctccagggganacagccaccctctcctgcagggccagtaggagtgtcagtagtacttaggctggtaccaacagaaacctggccaggctcccaggctcctcatccatgatgccatccaacgcgggtccctggccgtcccagaccaggttccgtggcaggtcgggtctggggacaggtagttcactctcgacgtcagcagccgtggacgcctgagtgtatttgctacgtttacttcgtgtcagcgacgtcgttccgcctacgcccgtcgtctaccgtttcggggccgggggtacgtacgggtcggacgtaggtacggtacgtaccggtaacgttgggtacggccgttacgccgtacccgtacgtttcgtacgttcctttcgtaccgtttccccg

SEQ ID NO: 111398 - DNA, 533 bp, Homo sapiens
  misc_feature: GYAE6OF01C1NKY.45.36.D03.1.454.CMB.1.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (343)..(343): a, c, t, g, unknown or other
  misc_feature (343)..(343): n is a, c, g, or t
  modified_base (524)..(524): a, c, t, g, unknown or other
  misc_feature (524)..(524): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggctcctcatccatgatgcatccaacngggtccctggccgtcccagacagggttccgnggcaggtgggtctgggacagagttcactctcaccgtcagcagcctggagcctgatgtattttgctagtttacttctgtcagcagtcgttccgccacgcccgtctccgtacgtttccgggccgggggaccgaggggtggaggagtggagacggaacgtggtggcgtgcaccatctgtcttcnttcctcccg

SEQ ID NO: 111399 - DNA, 222 bp, Homo sapiens
  misc_feature: GYAE6OF01AHSVR.45.36.D03.1.454.CMB.1.raw
  modified_base (219)..(222): a, c, t, g, unknown or other
  misc_feature (219)..(222): n is a, c, g, or t
tcagacgcgatcgacacgaccggtgctcgatttagctgcgtcacgatctctcttgggggaggaactgctcagttaggacccagacggaaccatggaagccccagcgcagcttctcctcctcctgctactctggctcccaggaactgtggctgcaccatctgtcttcatcttcccgccatctgatcgatcgcgtctgagcgggctggcaaggcgcatagnnnn

SEQ ID NO: 111400 - DNA, 241 bp, Homo sapiens
  misc_feature: GYAE6OF01ETMU8.45.36.D03.1.454.CMB.1.raw
  modified_base (212)..(241): a, c, t, g, unknown or other
  misc_feature (212)..(241): n is a, c, g, or t
tcagacgcgatcgacacgaccggtgctcgatttagctgcgtcacgagtcgtctcttgggtttgggggaagaggaagactgacggtcctcccaggagttcaggtgctgggcaccttgggcacggggaggtgtgtcacaagatttgggccctgggctgcctggtcaaggctacttcctcgatcgcgtctgagcgggctggcaaggcgcgatagnnnnnnnnnnnnnnnnnnnnnnnnnnnnnn

SEQ ID NO: 111401 - DNA, 523 bp, Homo sapiens
  misc_feature: GYAE6OF01BHZU1.45.36.D03.1.454.CMB.1.raw
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaangggtccctgggcctcccagaccagggttcccgnggcaggtgggtctggggacaggagttcactctcaccgtnagcagcctggacgcctgatgtattttgctagtttacttctgtcagcagtcgttccgccacgccgctcgtacgtttccgggcggggtaccgagggtggagagtggaggacgaacgtggtggctgcacntctgtcttcntccg

SEQ ID NO: 111402 - DNA, 529 bp, Homo sapiens
  misc_feature: GYAE6OF01DNMQR.45.36.D03.1.454.CMB.1.raw
  modified_base (313)..(313): a, c, t, g, unknown or other
  misc_feature (313)..(313): n is a, c, g, or t
  modified_base (343)..(343): a, c, t, g, unknown or other
  misc_feature (343)..(343): n is a, c, g, or t
  modified_base (381)..(381): a, c, t, g, unknown or other
  misc_feature (381)..(381): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggctcccaggctcctcatccatgatgcatccaacgnggtcccctggcctcccagacacggttccgnggcaggtgggtctgggacaggagtcacgtctcaccgtnagcagcctggagcctgatgtatttgctagtttacttctgtcagcagtcgttcggccacgccgctccgtacgttcgggcgggggaccaggggtggagtagtagagacgtacgtgtggcgtgcaccgtatcgtagttcttctcgttcccg

SEQ ID NO: 111403 - DNA, 268 bp, Homo sapiens
  misc_feature: GYAE6OF01BVH54.45.36.D03.1.454.CMB.1.raw
  modified_base (265)..(268): a, c, t, g, unknown or other
  misc_feature (265)..(268): n is a, c, g, or t
tcagacgcgatcgacacgaccggtgctcgatttagctgcgtcacgatctctcttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttcctcgatcgcgtctgagcgggctggcaaggcgcatagnnnn

SEQ ID NO: 111404 - DNA, 555 bp, Homo sapiens
  misc_feature: GYAE6OF01BDKFX.45.36.D03.1.454.CMB.1.raw
  modified_base (346)..(346): a, c, t, g, unknown or other
  misc_feature (346)..(346): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctccaggctcctcatccatgatgcatccaacgcgggtccctggccgtccccagaccagggttcccgnggcaggttcgggtctggggacaggtacgttcacttcctcaccgtcagcagcctggacgcctgatgtatttgctagtttacttctgtcagtcagtccgttccgcaccgccgtctcgtaccgtttccgggccgggggtaccgaggggtggaggtagtggacggacggaacgtggtggctcgccaccgtagtctgtccttcgtacgttcccg

SEQ ID NO: 111405 - DNA, 267 bp, Homo sapiens
  misc_feature: GYAE6OF01DTA84.45.36.D03.1.454.CMB.1.raw
  modified_base (263)..(267): a, c, t, g, unknown or other
  misc_feature (263)..(267): n is a, c, g, or t
tcagacgcgatcgacacgaccggtgctcgatttagctgcgtcacgatctctcttgggggaagaggaagactgacggtcctcccaggagttcaggtgctgggcaccttgggcacgggggagtgtgtcacaagatttgggctctgggcaccgtgggcatgggggagtgtgtcacaagatttgggctctgggcacagcggccctgggctgcctggtcaaggactacttcctcgatcgcgtctgagcgggctggcaaggcgcatagnnnnn

SEQ ID NO: 111406 - DNA, 526 bp, Homo sapiens
  misc_feature: GYAE6OF01CP3FC.45.36.D03.1.454.CMB.1.raw
  modified_base (341)..(341): a, c, t, g, unknown or other
  misc_feature (341)..(341): n is a, c, g, or t
  modified_base (381)..(381): a, c, t, g, unknown or other
  misc_feature (381)..(381): n is a, c, g, or t
  modified_base (419)..(419): a, c, t, g, unknown or other
  misc_feature (419)..(419): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (519)..(520): a, c, t, g, unknown or other
  misc_feature (519)..(520): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaacctggccaggctcccaggctcctcatccatgatgcatccaacgcggtccctggcctccagacacggttcgnggcaggtgggtctgggacaggagttcacttctcaccggtnacgcagcctggagcctgatgtatttgctagtttacttntgtcagtctacgcgttcccgcgaccgccgctcgtacggtttcgggcgggggaccgagggtggagagtggagacgacgtgtggctgcacgntactntcttnnttcccg

SEQ ID NO: 111407 - DNA, 514 bp, Homo sapiens
  misc_feature: GYAE6OF01B42GD.45.36.D03.1.454.CMB.1.raw
  modified_base (503)..(514): a, c, t, g, unknown or other
  misc_feature (503)..(514): n is a, c, g, or t
tcagacgcgatcgacacgaccggtgctcgatttagctgcgtcacgatctctcctgtgcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctggggcaaagggacctcggtcaccgtctccgcagcttccaccaagggcccatcggtcttccccctggccgccctgcctccaggacgcacctctggggcacgagccggccctgggctgccctggtcaacggtacctacttccctcgactcgcgtctgaggcgggctgggcaggcgcgatagnnnnnnnnnnnn

SEQ ID NO: 111408 - DNA, 583 bp, Homo sapiens
  misc_feature: GYAE6OF01BZANY.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctccaggctcctcatccatgatgcatccaacgcgggtccctggccgtcccagacctaggttccgtggcaggtgggtctggggactaggacgtttcactctacaccgtcagcagtccgtggacgccgtgatgtatttgacttacgtttacttcgtgtcagtcacgtccgttcccgccgtaccgccgtcctccgtaccggtttccgggccgggggtaccgtacggggtaggaggagtaggaaggtaccggtaacgtggtcggtcgtcggaccaccgtacgttcgttaggttccttcgtacgttcccg

SEQ ID NO: 111409 - DNA, 528 bp, Homo sapiens
  misc_feature: GYAE6OF01CAJES.45.36.D03.1.454.CMB.1.raw
  modified_base (525)..(525): a, c, t, g, unknown or other
  misc_feature (525)..(525): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgagggggagacagccaccctctcctgcagggccagtaggagtgtcagtaagtacttaggctggtaccaacagaaacctggccaggcctcccgaggcctcctcatccatgatgcatccaacacgggtccctgggccgtccccagactagggttccgtggcaggtggggtctggggacaggacgttcactctcacgtcagcagctgagctgatgtatttgctagtttacttctgtcagcagtcgttccgccacgccgctcctacgttcgggcggggggaccgagggtcggaggagtgagacgtacgtggtggctgcactatctgtctcgtntcc

SEQ ID NO: 111410 - DNA, 583 bp, Homo sapiens
  misc_feature: GYAE6OF01CC1MV.45.36.D03.1.454.CMB.1.raw
  modified_base (431)..(431): a, c, t, g, unknown or other
  misc_feature (431)..(431): n is a, c, g, or t
  modified_base (463)..(463): a, c, t, g, unknown or other
  misc_feature (463)..(463): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctgtgtctccgaggggagagagtcaccctctcctgcacggccagtcaaagtgttcgcaccggatacttagcctggtaccagcagagacctggccagcctccaggcctcctcatctagtggtcgcactcctccgagggcccttcgtgggtccgtcccccgctagggtttcaggttcggctagggttcgggtcgtggggacagtacgttcactctacacctatcagcacgcctgacagtctagaagtntttgcgtatttattattgtctgtctaatttanaatagtctcggtacccgtgggtaccgttcgggcccgtagggtacccgtaaggggttacgaaacgttaccgaaaacggtacgttggtacggcctaggacctaaccacgttccgttgttacc

SEQ ID NO: 111411 - DNA, 524 bp, Homo sapiens
  misc_feature: GYAE6OF01AB8FN.45.36.D03.1.454.CMB.1.raw
  modified_base (202)..(202): a, c, t, g, unknown or other
  misc_feature (202)..(202): n is a, c, g, or t
  modified_base (340)..(340): a, c, t, g, unknown or other
  misc_feature (340)..(340): n is a, c, g, or t
  modified_base (469)..(469): a, c, t, g, unknown or other
  misc_feature (469)..(469): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacagggtccctggcctcccagacaggttccgnggcaggtgggtctggggacaggtagttcactcctccaccgtcagccagcctggacgccgtgatgtatttgctagtttactctgtcagcagtcgttccgccacgccgctcgtacgttcgggcggggacgnggggtgaggatggacgacgacgtggtggctgcacntctcgtcttcnctcctcccg

SEQ ID NO: 111412 - DNA, 711 bp, Homo sapiens
  misc_feature: GYAE6OF01EHDY7.45.36.D03.1.454.CMB.1.raw
  modified_base (348)..(348): a, c, t, g, unknown or other
  misc_feature (348)..(348): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagcccaccctctcctgcagggccagtaggagtgtcagtaagtacttaggctggtaccaacagaaacctggaccaggcctcccgaggcctcctcatccatgatgcatccaacgcgggtccctggcctcccagtaccaggttccgnggactaggtcgggtctaggggactaggtacgttccacgttctccgtaccgtcaacgcgaacgtccgtgggacgtccgtagtaagttgtaacgttttcggtacgttaacgttttaccgtttcgttcggttaccgtacgtaccgtaacgggttcccgtttaccccggacccgtaacccggtccccgtaccgttacccgttaacccgggttttccgggggacccgggggggtaacccggtacgggggttacgggtaaggtacggtacgggtaaacggtaaccggtaacggttgggtaccgggtccgttacggacccgtaacccgttacgttaccgtttaccggttcctttccgtccgtttaccccg

SEQ ID NO: 111413 - DNA, 277 bp, Homo sapiens
  misc_feature: GYAE6OF01EON72.45.36.D03.1.454.CMB.1.raw
  modified_base (183)..(183): a, c, t, g, unknown or other
  misc_feature (183)..(183): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (273)..(277): a, c, t, g, unknown or other
  misc_feature (273)..(277): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggtgtgtcacaagatttgggctctgggctaccgtgggcagtgggggagtgtgtcanaagatttgggctctgggcacagcggccctgggctgcctggtcaaggctacttcctgatcgcgtctgagcgggntggcaagggcncatagnnnnn

SEQ ID NO: 111414 - DNA, 566 bp, Homo sapiens
  misc_feature: GYAE6OF01CK3R2.45.36.D03.1.454.CMB.1.raw
  modified_base (203)..(203): a, c, t, g, unknown or other
  misc_feature (203)..(203): n is a, c, g, or t
  modified_base (344)..(344): a, c, t, g, unknown or other
  misc_feature (344)..(344): n is a, c, g, or t
  modified_base (382)..(382): a, c, t, g, unknown or other
  misc_feature (382)..(382): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccagggganacagccaccctctcctgcagggccagtaggagtgtcagtaagtacttaggctggtaaccaacagaaacctggccaggctcccaggctcctcatccatgatgcatccaacgcgggtccctggcctcccagacacgggttccnggcaggtgggtctggggacagagttcactctcaccgtnaggcagccgtggacgcctgatgtatttgcttagtttacttctgtcagtctacgtcgttccgccgtacgccgtctccgtacggtttccgggccgggggtaccgtaggggtggacggtagtcggaggtacggaacgttggtcggtccgttaggcctaccgtacttcgtgttccttctacgttcccg

SEQ ID NO: 111415 - DNA, 522 bp, Homo sapiens
  misc_feature: GYAE6OF01BM93S.45.36.D03.1.454.CMB.1.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
  modified_base (497)..(497): a, c, t, g, unknown or other
  misc_feature (497)..(497): n is a, c, g, or t
  modified_base (516)..(516): a, c, t, g, unknown or other
  misc_feature (516)..(516): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggctcccaggctcctnatccatgatgcatccaaacngggtccctggcgtcccagacaggttccgtaggcaggtcgggtcnggggaacaggagttcacttctcaccgtnagcagctgagctgatgatttgctagtttacttctgtcagtcagtcgtccgcaccgccgctcgtacgtttccggcgggggaccagggtggagagtgagacgaactggtacggntggcacgtatctgtcttcnttcccg

SEQ ID NO: 111416 - DNA, 550 bp, Homo sapiens
  misc_feature: GYAE6OF01B5P1M.45.36.D03.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccacctctcctgcagggccagtaggagtgtcagtaagtacttaggctggtaccaanagaaacctggccaggcctccaggctcctcatccatgatgcatccaacacgggtccctggccgtccccagaccacggttccgtggcagtggggtctgggacagagttcactctcgaccgtcagcacgccgtggagcctgactgtattttgctagtttacttctgtctagctacgcgttcccgctacgcccgtctcgtaccgtttccggggcgggggacctaggggtggagtagtggaacggtacgacgtggtgggctggcacccgtattccgtagttctctattccccg

SEQ ID NO: 111417 - DNA, 234 bp, Homo sapiens
  misc_feature: GYAE6OF01AZACU.45.36.D03.1.454.CMB.1.raw
  modified_base (231)..(234): a, c, t, g, unknown or other
  misc_feature (231)..(234): n is a, c, g, or t
tcagacgcgatcgacacgaccggtgctcgatttagctgcgtcacgatctctcttggggcagagctctggggaggaactgctcagttaggacccagacggaaccatggaagccccagcgcagcttctcctcctcctgctactctggctcccaggaactgtggctgcaccatctgtcttcatcttcccgccatctgatcgatcgcgtctgagcgggctggcaaggcgcatagnnnn

SEQ ID NO: 111418 - DNA, 566 bp, Homo sapiens
  misc_feature: GYAE6OF01DAZHZ.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggctccaggctcctcatccatgatgcatccaagcgggtccctggcctcccgagaccgaggttccgtggcaggtgggtctgggacaggacgttcacgtctcgaccgtcagcacgccgtggacgccgtgatgtatttgctagtttacttcgtgtcagtcacgtcgtccgccgaccgccgtcctccgtacgtttccgggcgggggtaccgagggtcggaggacgtggaagaccggtaacgtggtacggcgtacggaccaccgtacgtaccgtgttccttcgtacgttccccg

SEQ ID NO: 111419 - DNA, 541 bp, Homo sapiens
  misc_feature: GYAE6OF01DLYOY.45.36.D03.1.454.CMB.1.raw
  modified_base (311)..(311): a, c, t, g, unknown or other
  misc_feature (311)..(311): n is a, c, g, or t
  modified_base (338)..(338): a, c, t, g, unknown or other
  misc_feature (338)..(338): n is a, c, g, or t
  modified_base (374)..(374): a, c, t, g, unknown or other
  misc_feature (374)..(374): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccaggctcctcatccatgatgcatccaacnggtccctggctcccagacaggttccgnggcagtgggtctgggacagagttcactctcaccgtnagcagcctggagcctgatgtatttgctagtttacttctgtcagcacgtcgttccgccaccgccgcctcgtaccgtttccgggcggggggtaccgaggggtacggaggtagtggaggacggtaacgtggtcggcgtcgccaccgtatccgtgtcctcgtacgttcccg

SEQ ID NO: 111420 - DNA, 595 bp, Homo sapiens
  misc_feature: GYAE6OF01EAWZG.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggagacagccaccctctcctgcagggccagtacggagtgtcagtaagtacttaggctggtaccaacagaaacctggccaggctcccaggcctcctcactccatgatgcataccaacgacggtccctggccgtacccagactacggttccgtggaccaggttcgggtcgtagggactaggtacgttcactcgtctaccgtcacgcacgtccgtggacgccgtgattgtactttgctagtttacttctgtctagtctacgtcgttccgctaccgccgtctccgtacgtttccgggcgggggtaccgtaggggtcggacggtagtcggaacgacggtaacgttggtacggtccgtcggacccaccgtacgttccgttacgtccctttcgtaccgttccccg

SEQ ID NO: 111421 - DNA, 578 bp, Homo sapiens
  misc_feature: GYAE6OF01BSMRF.45.36.D03.1.454.CMB.1.raw
  modified_base (349)..(349): a, c, t, g, unknown or other
  misc_feature (349)..(349): n is a, c, g, or t
  modified_base (414)..(414): a, c, t, g, unknown or other
  misc_feature (414)..(414): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaacagaaacctggaccaggcctcccaggctcctcatccatgatgacatccaacgacgggtccctgggcctcccagactaggttccgnggctaggtcgggtcgtagggaccaggtacgtttccacttcgtacgaccgtcagtcagcctggacnccgtgatgtatttgctagtttctctgtcagctacgtcgttccgccaccgcccgtcgtcgtaccggtttcgggacgggggtaccgtaggggtcggagtagcggtaacggaacgtacgtggcggtcgtacgaccgacgtacttcgtagttccttcgtacgttcccg

SEQ ID NO: 111422 - DNA, 563 bp, Homo sapiens
  misc_feature: GYAE6OF01B6MLT.45.36.D03.1.454.CMB.1.raw
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagcccaccctctcctgcagggccagtaggagtgtcagtaagtacttaggctggtaccaacagaaacctgtccaggcctcccaggctcctcatccatgatgcatccaacgcgggtccctggcctccccagaccaggttccgnggcaggtgggtctgggacngagtcactctcaccgtnagcagccgtggacgcctgatgtattttcgacgtagtttacttcgtgtctagctacgtccgttccgccgaccgtcccgtctccgtaccgtttccgggcgggggtaccgaggggtcggagtagtaggaacggacggtaacgtggtacggtcgtgccacgtactctgtccttcgacgttcccg

SEQ ID NO: 111423 - DNA, 585 bp, Homo sapiens
  misc_feature: GYAE6OF01E4AOS.45.36.D03.1.454.CMB.1.raw
  modified_base (205)..(205): a, c, t, g, unknown or other
  misc_feature (205)..(205): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggctccaggctcctcatccatgatgcatccaacgcgggtccctggcctcccagactacggttccgtggcgtaggtgggtctggggacaggtacgttcacttctccacgtcagcagccgtggacgcctgatgtatttgcttagtttacttctgtcagcgacgtccgttccgccaccgtcccgtctccgtaccggtttccggggaccgggggtaccgaggggtggaggtagtacggaacggtaccggtacgtgggtcggtccgtacggaccctaaccgtacgttccgtgttccttcgtacgttccccg

SEQ ID NO: 111424 - DNA, 542 bp, Homo sapiens
  misc_feature: GYAE6OF01A3DNV.45.36.D03.1.454.CMB.1.raw
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaanagaaacctggctaggctccaggctcctcatccatgatgcatccaacncgggtccctggcctccagacaggttccgnggcaggtgggtctgggacagacgttcactctcaccgtnagcagctggacgctgatgtatttgctagtttacttctgtcagtcagtcgttccgcacgcccgtcgtccgtacggtttcgggccgggggtaccgagggtggagtagtaggacggacggtacgtggtcggtcgtcgcaccgtactcgtagttcttcgtacttcccg

SEQ ID NO: 111425 - DNA, 233 bp, Homo sapiens
  misc_feature: GYAE6OF01D71CB.45.36.D03.1.454.CMB.1.raw
  modified_base (230)..(233): a, c, t, g, unknown or other
  misc_feature (230)..(233): n is a, c, g, or t
tcagacgcgatcgacacgaccggtgctcgatttagctgcgtcacgatctctcttggggcagagctctggggaggaactgctcagttaggacccagacggaaccatggaagccccagcgcagcttctcctcctcctgctactctggctcccaggaactgtggctgcaccatctgtcttcatcttcccgcatctgatcgatcgcgtctgagcgggctggcaaggcgcatagnnnn

SEQ ID NO: 111426 - DNA, 582 bp, Homo sapiens
  misc_feature: GYAE6OF01DIYDQ.45.36.D03.1.454.CMB.1.raw
  modified_base (410)..(410): a, c, t, g, unknown or other
  misc_feature (410)..(410): n is a, c, g, or t
  modified_base (561)..(561): a, c, t, g, unknown or other
  misc_feature (561)..(561): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggggagacacgccaccctctcctgcagggccagtaggagtgtcagtaagtacttaggctaggtaccaacagaacctggccaggctccaggcctcctcactccatgatcgcactaccaacgaggggtcccctggccgtacccagtaccgaggttcccggaggcctaggtcgggtctaggggactaggtacgttccacgtcctacaccggtcagccngaccctgggacgtcctggaattgtacttttgacgttacgttttactcgtgtcaggctagtccgttccgcacgccgtctcgtacgttcggggcggggaccgtaggggtacggagacgtggacggacggtaacgttggtcggctgaccacgtntcgttgtccttcgtcttcccg

SEQ ID NO: 111427 - DNA, 555 bp, Homo sapiens
  misc_feature: GYAE6OF01DZV2N.45.36.D03.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (432)..(432): a, c, t, g, unknown or other
  misc_feature (432)..(432): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccagccaccctgtctttgtttccaggggaaangccaccctctcctgcagggccagtcagggtgttaacngctacttagcctggtaccaacaaaacctggccaggctccaggctcatcatctatgacgcatcgaacagggccacgtggcatcccagccaggttcagtggcagtgggtctggggacagacttcactctcaccatcagcagcctgtaccctgaggtatttgcctatttactactgtcagcagcgtggcgaccgngcgctctacgtttcgggacggacgggaccaagggtggaagtactaccgaaaacgacgttggtaggcgtcgacctaacccgtagttccgttacgttacctttaccacgtttcccgttacccccg

SEQ ID NO: 111428 - DNA, 282 bp, Homo sapiens
  misc_feature: GYAE6OF01BOVBR.45.36.D03.1.454.CMB.1.raw
  modified_base (254)..(282): a, c, t, g, unknown or other
  misc_feature (254)..(282): n is a, c, g, or t
tcagacgcgatcgacacgaccggtgctcgatttagctgcgtcacgatcgtctcttgggttttgggggaagaggaagactgacggtcctcccaggagttcaggtgctgggcaccttgggcacggggagtgtgtcacaagatttgggctctgggcaccgtgggcatgggggagtgtgtcactaagatttgggccctgggctgcctggtcaaggctacttctcgatcgcgtctgagcggctggcgaaggcgcatagnnnnnnnnnnnnnnnnnnnnnnnnnnnnn

SEQ ID NO: 111429 - DNA, 684 bp, Homo sapiens
  misc_feature: GYAE6OF01C2P7J.45.36.D03.1.454.CMB.1.raw
  modified_base (206)..(206): a, c, t, g, unknown or other
  misc_feature (206)..(206): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagaaaccattggagaaatactgatgacgcagtttccagccaccctgtctgtgtctccgaaggggaaanagccaccctctcctgctgggccagtcagagtgtagacaaccacttagcctaggtaccagcaacgaaacctggcccaggcctaccacgtacctccttacaattttagtcggtttactttaccgtaaccgacgggtcccgtctacgggtaacctccccgagtcccgtaaggggtttccaggtcggacccgtagggttcggggtcgtaggggaacctaggtacggtttaccaccttccgtaccaaccgtataccgaacggccaacggtcctaggaccgtagtaccgtaggtaaagttacgttttacgacgttagttttactttcgtgtacacgtactaagtactactaagttaacgtcggtacttaggttacgttagggttttaccggaccggtaacgggtaaccaggtacgtaagtaaaacgtacgaaacggtacgtggtaccggtcttacggaccctaacgacgttctgttcttacccg

SEQ ID NO: 111430 - DNA, 738 bp, Homo sapiens
  misc_feature: GYAE6OF01BZH2L.45.36.D03.1.454.CMB.1.raw
  modified_base (362)..(362): a, c, t, g, unknown or other
  misc_feature (362)..(362): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacacgccaccctctcctgcagggccagtaggagtgtcagtaagtacttaggctaggtaccaacagaaacctggccaggcctcccaggcctcctcactccatgatcgcactccaacgtcgggtcccctggcccgtacccaggaccgtacgggtttccgngggcagggttcggggtcgtaggggaaccaggtacgttccaaccgttccgtaccgacccggtcacggtccacggtcccgtgggaccgtcccttaggaacttggttaacgtttttcggaccgttttaacggtttttaacccgtttcgttacgggttacctaacgggtccttaacgggttccccggttttaccccggacccgtaaccgggtcccccgttaccgtttcccggttaacccgggttttcccgggggggaccggggggtaacccgtagggggttacggaacggtacgtacgggaaacgggtaacgtaacggttgggtacgggtccttcggacctacccggtacttccgttcggttccttccgtacgttccccg

SEQ ID NO: 111431 - DNA, 625 bp, Homo sapiens
  misc_feature: GYAE6OF01CAE4K.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacgcgggtcccctggcccgtacccagaccgtacgggttcccgtggcgtaggttcggggtcctaggggaacaggtacgtttccactcctaccgaccgtcaggccacgccgtggacgtccgtgattgtattttgcttagtttacttcgttgtcagtctacgtcgttcccaccgaccgcccgtctccgtaccggtttccggggaccgggggtaccgtaggggtcggaaggtacgtacgggaacggtaccggtaacggttgggtacgggtccgtacggacccgaccgtacgttccgttagtttccttccgtacgttccccg

SEQ ID NO: 111432 - DNA, 589 bp, Homo sapiens
  misc_feature: GYAE6OF01D71N0.45.36.D03.1.454.CMB.1.raw
  modified_base (347)..(347): a, c, t, g, unknown or other
  misc_feature (347)..(347): n is a, c, g, or t
  modified_base (385)..(385): a, c, t, g, unknown or other
  misc_feature (385)..(385): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaaccaacagaaacctggccaggcctccgaggctcctcatccatgatgcatccaacgcgggtccctggcctcccagacctggttccgnggcaggtgggtctgggacagtacgttcactctcacgtnacgcagccgtggcgcctgtatgtagtttgcttacgtttcttctgtcgagtcgacgtccgtccgccgaccgtccgtcgtccgtaccggtttccggggaccggggggtaccgtacggggtcgggaaggtacgtacggacggtaacggtaacgtggtacgggtcgtacggaccgaccgtcgttacgttcgttccttcgtcgttcccg

SEQ ID NO: 111433 - DNA, 530 bp, Homo sapiens
  misc_feature: GYAE6OF01CBG1K.45.36.D03.1.454.CMB.1.raw
  modified_base (345)..(345): a, c, t, g, unknown or other
  misc_feature (345)..(345): n is a, c, g, or t
  modified_base (524)..(524): a, c, t, g, unknown or other
  misc_feature (524)..(524): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatcccaacgacgggtccctggccgtccccagaccaggttccgnggcaggtgggtctggggacagagttcactctcaccgtcagcagccgtggacgctgatgtatttgctagtttacttctgtcagctagtcgttccgccacgccgtctcgtaccgttcgggccgggggtacgagggtggagagtagagacgacgtggtggctgcacgtctctgttcttcgtnttcccg

SEQ ID NO: 111434 - DNA, 221 bp, Homo sapiens
  misc_feature: GYAE6OF01BA7WI.45.36.D03.1.454.CMB.1.raw
  modified_base (220)..(221): a, c, t, g, unknown or other
  misc_feature (220)..(221): n is a, c, g, or t
tcagacgcgatcgacacgaccggtgctcgatttagctgcgtcacgatctctcttgggggaagaggaagactgacggtcctcccaggagttcaggtgctgggcaccttgggcacgggggaggtgtgtcacaagatttgggctctgggcacagcggccctgggctgcctggtcaaggactacctcctcgatcgcgtctgagcgggctggcaaggcgcatagnn

SEQ ID NO: 111435 - DNA, 585 bp, Homo sapiens
  misc_feature: GYAE6OF01D3J5E.45.36.D03.1.454.CMB.1.raw
  modified_base (352)..(352): a, c, t, g, unknown or other
  misc_feature (352)..(352): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctggtaaccaacagaaacctggccaggcctcccgaggcctcctcatccatgatgcatccaacgcgggtccctgggcccgtcccagaccgtagggttcccgnggcctaggttcggggtctggggacaggtacgttcacttctaccgaccgtcagcagccgtggacgccgtgtatgtatttgctagtttcttctgtcagtctagtccgttccgcctaccgccgtcctccgtacggtttccggggccgggggtaccgaggggtaggagtagtacggaggacggtaacgtggtcggcgtcgaccaaccgtacgttcgttgttccttcgtcgttccccg

SEQ ID NO: 111436 - DNA, 582 bp, Homo sapiens
  misc_feature: GYAE6OF01A1CQ3.45.36.D03.1.454.CMB.1.raw
  modified_base (202)..(202): a, c, t, g, unknown or other
  misc_feature (202)..(202): n is a, c, g, or t
  modified_base (345)..(345): a, c, t, g, unknown or other
  misc_feature (345)..(345): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccagtaggagtgtcagtaagtacttaggctggtaccaacagaaacctggccaggcctccaggcctcctcatccatgatgcatccaacgacgggtccctggccgtcccagacaggttccgnggctaggtgggtctgggacaggagttcactctcaccgtcacgcagccgtggacgccgtgattgtatttcgcttagtttaccttcgttgtcagtcacgtccgttccgcctaccgcccgtctccgtaccggtttccgggcgggggtaccgacggggtggacggtagtaggaaggtaccgacgttggtcgggtctacggaccgtaccgtacgttcgttacgttccttcgtccgttccccg

SEQ ID NO: 111437 - DNA, 585 bp, Homo sapiens
  misc_feature: GYAE6OF01CCM9T.45.36.D03.1.454.CMB.1.raw
  modified_base (394)..(394): a, c, t, g, unknown or other
  misc_feature (394)..(394): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagccaccctctcctgcagggccagtaggagtgtcagtaagtacttaggctggtaccaacagaaacctggaccagggcctcccgaggcctcctcatccatgatgcatccaacgacgggtccctgggccgtccccaggacctacgggttccgtggcaggtgggtctgggacagagttcactctcaccgtnagcagcctggagcctgatgtatttgctagtttacttctgtcagctacgtcgttccgccgaccgcccgtcgtccgtaccgtttccggggaccggggggaccgtaggggtcggaacggtagtacggaaggaccggaacgttgggtcggcgtcggaccacccgtacttccgttagttccttccgtacttccccg

SEQ ID NO: 111438 - DNA, 504 bp, Homo sapiens
  misc_feature: GYAE6OF01CUAE3.45.36.D03.1.454.CMB.1.raw
  modified_base (494)..(504): a, c, t, g, unknown or other
  misc_feature (494)..(504): n is a, c, g, or t
tcagacgcgatcgacacgaccggtgctcgatttagctgcgtcacgatctctcctgtgcagtaactttggtttccactgggtccgccaggttccaggcaagggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctggggcaaagggcctcggtcaccgtctccgcagcttccaccaagggcccatcggtcttccccctggccgccctgcctccaggagcacctcgtggggcacgagcggccctgggcctgcctggtcaaggactacttcctcgatcgcgtctgagcgggctgggcaggcgcgatagnnnnnnnnnnn

SEQ ID NO: 111439 - DNA, 565 bp, Homo sapiens
  misc_feature: GYAE6OF01C781G.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccactggagaaatagtgatgacgcagtctccagtcaccctgtctgtgtctccgagggganaccggccaccctctcctgcagggccagtcagtatgttagcaaccaattagcctggtaccaacagagacctgcccaggcctccaaactcctcatctctgtgtactctaccagggccactggtcgtccagacaggttcaagggcaggtggtctggacagagttcactctcacatcagcgctgcagtctagaagtatttaggatttattactgtcagactagtaataatctaacgtcggtaccgttaacgtacgttttcgggacccgggggtacaacggcgtaggaacgaacgttacgaaaacgtaaccgtaggtcgggaccgttaggacctaaccctagttacctcggttccttacgttaaccc

SEQ ID NO: 111440 - DNA, 767 bp, Homo sapiens
  misc_feature: GYAE6OF01A30FV.45.36.D03.1.454.CMB.1.raw
  modified_base (590)..(590): a, c, t, g, unknown or other
  misc_feature (590)..(590): n is a, c, g, or t
  modified_base (760)..(760): a, c, t, g, unknown or other
  misc_feature (760)..(760): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagatcgaccgaaacggtaaaattgttgtacgacacgtacgtcctaccgaggccctaccgtgttccttcgttcgtcctaccgggaaggggaacacgaccgacccctacccttcctccgtcgacggaccgggaccgtaagggtaaggtaggttcgtacgtaaaggttaacgttacgttacggtcgtaacggtaacccaaacgaaaccgtaaccgtcggaccgacggtccctacccggaggtccctccctactaccgtacctagtggtactcgacctactaacccgaaaggtcccgggtcccgtcggtccccgtaccgaacgtaccggtaccgggtttccggacggacgtcggggttcgggtacggtacgggaacgtaggtaccgtacctacgttccgtaaccgtaccgtacgacgaccgtacgtccggtagggacctccgtagtactacgtttntttcgacgtttacgttttccttcgtcgtcgacgtcgtacgtcccgtcccgaccgcccgtccgtccgtacggttcccggggttcggggaccggggtacgtggggtacgagcgtaacgggaacgtacggtaggttggacgtccgtacgactacttcgtcggttcttccgttntccccgg

SEQ ID NO: 111441 - DNA, 550 bp, Homo sapiens
  misc_feature: GYAE6OF01DXFME.45.36.D03.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (448)..(448): a, c, t, g, unknown or other
  misc_feature (448)..(448): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctggcactctggctcccagataccaccggagaaattgtgttgacacagtctccagccaccctgtctttgttccaggggaaanagccaccctctcctgcagggccagtcagggtnttaacagctacttagcctggtaaccaaacaaaaacctggaccaggcctcccaggctcatcatctatgacgcatcgaacagggccactggcactcccagccaggttcagtggcaggtgggtctgggacagacttcactctcaccatcagcagcctggaccctggaggtattttgacctaatttacctactgttacagcaggtcgtggccgacgngccgctcgtacgttcgggacgggtaggaccgaaggtcggagagtaccgaaacgtaacgttggtaggcctaggccaccgtatcttggtcctttcgcttccccg

SEQ ID NO: 111442 - DNA, 786 bp, Homo sapiens
  misc_feature: GYAE6OF01CHVRP.45.36.D03.1.454.CMB.1.raw
  modified_base (203)..(203): a, c, t, g, unknown or other
  misc_feature (203)..(203): n is a, c, g, or t
  modified_base (365)..(365): a, c, t, g, unknown or other
  misc_feature (365)..(365): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtactaggctggtaccaacagaaacctggaccaggcctccgaggcctcctcactcccatgatcgacactcccaaacgacgggtcccctgggcccgtaccccaagaccgtacgggtttccgnggctagggtcggggtctaggggaacaggtacgttcactctaccgaccgttcacggcacggtcccgtagggacgtccgtaggtacttcggtttaacgtttttcgaccgtttaaggtttttaacccgtttccgtttacggttaccgttaacggtaccgttaaccgggttccccggttttaccccgggaccccgttaacccggtccccggttacccgttaccccgggtttaacccggggttttcccgggggggacccggggggggtaacccggtacgggggggttacggggaaacggttacggtacgggtaaacgggtaacccggggtaaaccgttggggttaccgggtaccggttaccggtacccgtaacccgtaacggtttcccgttacggtttacccgtttccgtaacccgtttcccccgg

SEQ ID NO: 111443 - DNA, 563 bp, Homo sapiens
  misc_feature: GYAE6OF01BN1GH.45.36.D03.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctccaggctccncatccatgatgcatccaacncgggtccctggcctcccagactaggttccgnggcaggtcgggtctgggacaggagttcactctcaccgtcagcagcctggcgctgatgtagtttgctagtttacttcgttgtctagctagtccgttacccacccgaccgcccgtcctccgtaccggtttccggggccggggggtacccgaggggtcggaggagtggaacggacggaacgtgggtcggcgtcgaccaccgtcttcgtgttccttcgtcttcccg

SEQ ID NO: 111444 - DNA, 604 bp, Homo sapiens
  misc_feature: GYAE6OF01BHTAE.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggcctcctcatccatgatcgcactccaacgtacgggtcccctgggccgtccccaaggaccgacgggttcccgtagggctagggttcgggtctggggacaggtacgttcaccttctccgaccgtcacgcacgccgtgggacgtcctgattgtatttgactagtttacttcgtgtcagcacgtcgtcccgccgaccgccgtcctaccgtaccggtttccggggaccgggggtaccgaggggtcgggagtagtcggaacggtaacgtaacgttgggcggtcgtcgaccaaccgtcgttacgtagttccttcgtacgttcccg

SEQ ID NO: 111445 - DNA, 774 bp, Homo sapiens
  misc_feature: GYAE6OF01CBX1W.45.36.D03.1.454.CMB.1.raw
  modified_base (295)..(295): a, c, t, g, unknown or other
  misc_feature (295)..(295): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctccaggcaccctgtctctgtctccgaggggagacagccaccctctcctgcagggccagtaggatgtcagtaagtacttaggctaggtaccaacgagaaacctggaccaggcctccgaggctcctnactccatgatgcatccgaaacgtcgggtcccctagggcccgtaccccgaaggtaccgtacggggtttcccgtgggccgtagggttcgggggtacgtacgggggaaccaagggttacgtttccaaccgttccgtaccaaccggttcgaagccgaacggtcccgtagggacgtccgttaggtacgttagttaagttttttacggttaagtttttaaccgtttcgttacggtttacgtaacgtccgtaaccggtcccgttttcccggaccccgtacccggtccccggtacccgtttcccgttaacccgggttttacccgggggaccggggggggtaacccggtaagggggttacgggaacggtacggtacgggaaccgggtaacgggtaaccgttcgggtacgggtaccggtcggtacccgtaaccgtacgtttacccgttacggtttaccctttaccgtaccgtttccccgtttacccccg

SEQ ID NO: 111446 - DNA, 592 bp, Homo sapiens
  misc_feature: GYAE6OF01EZH2B.45.36.D03.1.454.CMB.1.raw
  modified_base (365)..(365): a, c, t, g, unknown or other
  misc_feature (365)..(365): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctctttaagaggtgtccagtgtcaggtgcaggtggtggaggtcggggggaggcgttgtccagcctgggaggtccctgagactctcctgtgcagcctctggattctccctcagttaactttcggttccacgtgggtcccgccgaggttccagggcgaaggggctgggaggtgggtcggccctcagtttccgaagngtaggaagtgagaaggcctactcagactccgagaacggcctcttcacactcctaccagacgacaacttaccaagaactcgtccttcttttgtactaatgtaatacgacctagtagtaggttagaggtacgacgttcttcgtacttagtttctgtcggtccgacgggggtactagttctagttaggtaggttcgttgggttacgttaggttacgtaagtactaaaccg

SEQ ID NO: 111447 - DNA, 511 bp, Homo sapiens
  misc_feature: GYAE6OF01B78GR.45.36.D03.1.454.CMB.1.raw
  modified_base (202)..(202): a, c, t, g, unknown or other
  misc_feature (202)..(202): n is a, c, g, or t
  modified_base (341)..(341): a, c, t, g, unknown or other
  misc_feature (341)..(341): n is a, c, g, or t
  modified_base (440)..(440): a, c, t, g, unknown or other
  misc_feature (440)..(440): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (507)..(508): a, c, t, g, unknown or other
  misc_feature (507)..(508): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctccaggctcctcatccatgatgcatccaacgagggtccctggccgtcccagacaggttccgnggcaggtgggtctgggacaggtacgttcactctcaccgtcagcagccgtggacgcctgatgtatttgctagtttacttctgtcagcagtcgttccgccncgccgctcgtacgttcgggcggggacngggtgngagtgagacgacgtgnggcngcactatctgtctnntcc

SEQ ID NO: 111448 - DNA, 610 bp, Homo sapiens
  misc_feature: GYAE6OF01ASSRY.45.36.D03.1.454.CMB.1.raw
  modified_base (313)..(313): a, c, t, g, unknown or other
  misc_feature (313)..(313): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctccaggcctcctcatccatgatgcatccaacngggtccctggccgtcccagacaggttccgtggctaggtgggtctggggacaggagttcactcgtcaccgtcacgtcacgtccgtggacgccgtgatgtattttcgcttacgtttacttcgttgtcgtagctagtccgtttcccgccgtaccgtcccgtcctacgtaccggtttccggggccggggggtaccgtaggggtcgggtacggtagttacggaacggtaaccggtaacgtgggttacggtccgtacggacccgtaccgtacgttccgttcgttccttccgtaacgttccccg

SEQ ID NO: 111449 - DNA, 593 bp, Homo sapiens
  misc_feature: GYAE6OF01BE5FP.45.36.D03.1.454.CMB.1.raw
  modified_base (202)..(202): a, c, t, g, unknown or other
  misc_feature (202)..(202): n is a, c, g, or t
  modified_base (347)..(347): a, c, t, g, unknown or other
  misc_feature (347)..(347): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctccaggctcctcatccatgatgcactccaacgcgggtccctggccgtcccagacctagggttcccgnggcaggtcgggtctgggacaggtacgttcactctcaccgtcagcacgcctggacgccgtgattgtatttgcttagtttacttcgtgtcagtctagtccgttccgccacgcccgtctccgtaccggtttccggggccgggggtaccgaggggtcggaggtagtacggaggtaaccggtaacgttgggtcggtccgtcggacccgtaacccgtacttccgttacgttcctttcgtaccgtttcccccg

SEQ ID NO: 111450 - DNA, 667 bp, Homo sapiens
  misc_feature: GYAE6OF01BOOY7.45.36.D03.1.454.CMB.1.raw
  modified_base (202)..(202): a, c, t, g, unknown or other
  misc_feature (202)..(202): n is a, c, g, or t
  modified_base (342)..(342): a, c, t, g, unknown or other
  misc_feature (342)..(342): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacagggtccctggccgtcccagaccaggttccgnggcctaggtcgggtctgggacaggtacggttcacgtctcgaccgttcgacgtcgagcccttgggacgtcccgtgacgttgtacgtttttcggcgtaacggtttttacttccgttgtaccgtaggtcccttaagggtcccgtttaccccgcccgtaacccggtcccggtccttacccgttaacccgggtttccgggggccgggggtaacccggtaggggttggggaactagggtcggaaacgggtaccggaaacgtttgggcggtccgtaggacccctaaccgtactttccggtcgttttaccttaccgttacgtttaccccccgg

SEQ ID NO: 111451 - DNA, 658 bp, Homo sapiens
  misc_feature: GYAE6OF01AS0F0.45.36.D03.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (343)..(343): a, c, t, g, unknown or other
  misc_feature (343)..(343): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggcctcccaggctcctcatccatgatgcatccaacgcgggtccctggcctcccagactaggttccgnggcaggtcgggtcgtggggacaggtacgttccacgtctacgaccgtcacgcgacgccgtggacgtccgtagacttgtagttttcggacttaagttttaccttcgttgtaccgtacgtccgtacgtccgtttcccgccgtaccgtcccgtccttaccgttacccgggtttccgggggacccggggggtaccgtacgggggtacgggtaacggtacgttacgggaacggtaaccggtaacggttgggtacgggtccgttacggaccctaaccgtacgttacccgttcggttaccctttccgtaaccgtttcccccgg

SEQ ID NO: 111452 - DNA, 633 bp, Homo sapiens
  misc_feature: GYAE6OF01EJH8B.45.36.D03.1.454.CMB.1.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (353)..(353): a, c, t, g, unknown or other
  misc_feature (353)..(353): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctaggtaccaanagaaacctggccaggcctccaggctctcatccatgatgcatcccgaacgacgggtccctaggcctaccccagaccgtacggttcccgnggcctaggtcggggtctgggaactaggtacgttccactcctaccgaccgtcacgccacgtccgtggactccgtagagttgtatttgacttagtttacttcgtgtacagtctacgtccgttccgccaccgtccgtcctcgtaccggtttccggggaccgggggtaccgtagggggttaggaacggtacgttacggaaacggtaccggtaaacgttgggttacgggccgttacggacccacgttacgttccgttagttcccgtttcgtacccgtttcccccg

SEQ ID NO: 111453 - DNA, 534 bp, Homo sapiens
  misc_feature: GYAE6OF01CU4HB.45.36.D03.1.454.CMB.1.raw
  modified_base (204)..(204): a, c, t, g, unknown or other
  misc_feature (204)..(204): n is a, c, g, or t
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
  modified_base (507)..(507): a, c, t, g, unknown or other
  misc_feature (507)..(507): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccaccctctcctgcagggccagtaggagtgtcagtaagtacttaggctggtaaccaacaagaaacctggaccaggcctcccaggctcctcatccatgatgcatccaacgagggtccctggccgtcccagacaggttccnggcagtgggtctgggacagagttcactctcaccgtnagcagcctggagcctgatgtattttgctagtttacttctgtcagcacgtcgttcccgccaccgccgctccgtacgtttcgggcgggggtaccgagggtggagagtggagacgaacgtgtggcncgcacctacttctgtcttctcttcccg

SEQ ID NO: 111454 - DNA, 547 bp, Homo sapiens
  misc_feature: GYAE6OF01DDLEU.45.36.D03.1.454.CMB.1.raw
  modified_base (201)..(201): a, c, t, g, unknown or other
  misc_feature (201)..(201): n is a, c, g, or t
  modified_base (340)..(340): a, c, t, g, unknown or other
  misc_feature (340)..(340): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaacagaaacctggccaggcctcccaggcctcctcatccatgatgcatccaacagggtccctggctcccagacaggttccgnggcaggtgggtctggggacagacttcactctcacaatcagcacgccctaccaacctagtaagtattttgactagtcttattactcgtacaactacgtacgtacagtagttcggccgtctacgtacgtttcggacggacgggaccgaaggtggagatacgaaacgtaacgtaggtggctacgcaccgattactgttcttctcttcccg

SEQ ID NO: 111455 - DNA, 648 bp, Homo sapiens
  misc_feature: GYAE6OF01EGLFF.45.36.D03.1.454.CMB.1.raw
  modified_base (406)..(406): a, c, t, g, unknown or other
  misc_feature (406)..(406): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagcccaccctctcctgcgaggccagtaggagtgtcagtaagtacttaggctggtaaccaacagaaacctggaccaggcctaccgaggcctcctcactacccatgatcgacactccaacgacgggtccctggccgtacccagacgtacggttccgtggctaggtcgggtcgtagggacaggtacgttcactcgtaccaccgtnacgcacgccgtggacgtctgattgtatttgacttagtttacttcgtgtctacgcacgtccgttccgccgtaccgtccgccgttacgtaccggtttccggggaccggggggtacccgtagggggttacgggaaggtacggtacgggtaaacggtaccggtaacgttgggtaccgggtccgttacgggacccgtaacccgttacgttacccgttagtttcccgtttaccgtacctttcccccgg

SEQ ID NO: 111456 - DNA, 821 bp, Homo sapiens
  misc_feature: GYAE6OF01DN5EN.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcgagggccagtaggagtgtacagtaagtacttaggctaggtaccaacgacgaaaccgtggccaggcctcccaggcctcctcattccattgatcgacactcccaacgtacgggtcccctagggcccgttacccgaaggtaccgtacgggttcccggtcgggaccgtaagggtcggggtacgtggggaacctaggtacgttcaccgttcgtaccgtacccggtcacggtccaacgggtcccgtacgggacgtcccgttaggtaacgtttcggtacgtttttacggacgttttaacggtttttacccgtttacgtttacggttacccgtacggtacccgttaaccgggtttcccggtttacccccggacccggtaaccccggttcccggtaccccgtttaccccgggtttacccgggttttccccgggggggaacccggggggggttaacccgtaacgggggggttcggggtaaacggttacggtacggggtaaacgggtaaccccggttaacgggttcgggttaccgggtcccgtaccgggtaacccgacccgttacgttcccggttacggtttcccttttccgaaccgtttttccccccgg

SEQ ID NO: 111457 - DNA, 576 bp, Homo sapiens
  misc_feature: GYAE6OF01B2C0X.45.36.D03.1.454.CMB.1.raw
  modified_base (202)..(202): a, c, t, g, unknown or other
  misc_feature (202)..(202): n is a, c, g, or t
  modified_base (349)..(349): a, c, t, g, unknown or other
  misc_feature (349)..(349): n is a, c, g, or t
  modified_base (452)..(452): a, c, t, g, unknown or other
  misc_feature (452)..(452): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggcctcctcatccatgatgcatccaacgagggtcccctggccgtccccagaccgaggttcccgnggcaggtgggtctgggacaggcgttcactctcgaccgtcagcagcctggacgccgtgatgtattttgcgttagtttacttctgtcagcacgtccgttccgccnccgtcccgtccgtccgtaccggtttccggggccgggggtaccgaggggtcggagtagtggacgtacggtaacgtgggtacggcgtcggccaccgtacttcgttcgttccttcgtacgttccccg

SEQ ID NO: 111458 - DNA, 543 bp, Homo sapiens
  misc_feature: GYAE6OF01COZJI.45.36.D03.1.454.CMB.1.raw
  modified_base (201)..(201): a, c, t, g, unknown or other
  misc_feature (201)..(201): n is a, c, g, or t
  modified_base (342)..(342): a, c, t, g, unknown or other
  misc_feature (342)..(342): n is a, c, g, or t
  modified_base (424)..(424): a, c, t, g, unknown or other
  misc_feature (424)..(424): n is a, c, g, or t
  modified_base (493)..(493): a, c, t, g, unknown or other
  misc_feature (493)..(493): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggaccaggcctcccaggctcctcatccatgatgcatccaacagggtccctggccgtcccagacaggttccgnggcgagtcgggtcgtgggacaggcgttcactctcaccgtcagcagccgtggacgcctgatagtatttgcagtttttttttcncgttgtcagtctacgtcgttccgccaccgccgctccgtcgttccgggacggggaccgtagggtggaggngtggagacgaacgtggtggcgtgcaccgtactcgtgtcttcgtcttcccg

SEQ ID NO: 111459 - DNA, 748 bp, Homo sapiens
  misc_feature: GYAE6OF01CD268.45.36.D03.1.454.CMB.1.raw
  modified_base (368)..(368): a, c, t, g, unknown or other
  misc_feature (368)..(368): n is a, c, g, or t
tcagacgcgatcgacacgaccggtgctcgatttagctgcgtcacgatctctcgttgggggaggaactgctcagttaggacccagagggaaccatggaacgccccagctcagcttctcttcctcctgctactctggctcccagataccaaccggaaaattgtgttgacacagtctcaggcaccctgtctctgtctccgaggggagacagcccaccctctcctgcgagggccaggtaggagtgtacaggtaagtacgttaggctaggtaaccaacaagaaacctggaccaggtcctccgaggcctcctcatccatgatcgcactaccaacgtacgggtccctggccgtacccaggaccgtacggttccgnggcagggtcgggtcgtaggggaactaggtaacggttccaacgttccgtaccgaaccccgttcgaacggccgtaacggtcccgttaggggaaccgtcccgttaggtaacgttcggtttaagttttacggacctttacggttttaaccttccgttacggtaccgtaggtacccgtaacgggttcccgttccccggaccgtacccggtcccggtccgttacccggttaccgggttttcccggggggacccggggggtaaccggtagggggttacgggaaggtacggttacgggaacggtaaccggtacggttagggtacgggccttacggacccgtaccgttacgtttaccgttcggtttcctttccgtaccgtttcccccgg

SEQ ID NO: 111460 - DNA, 590 bp, Homo sapiens
  misc_feature: GYAE6OF01EDGS4.45.36.D03.1.454.CMB.1.raw
  modified_base (202)..(202): a, c, t, g, unknown or other
  misc_feature (202)..(202): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctccaggctcctcatccatgatgcatccaacgacgggtccctggcctccagacgaggttcccgnggcaggtgggtcnggggacaggtacgttccactctccgaccgtnacgccagcctggacncctgattgtatttgacttagtttacttctgtcagctacgtccgttccgcctacgcccgtcttccgtaccggtttccggggaccgggggaccgtaggggtggacggtagtacggaacgacggtaacgttgggtaggccgttacggacccaaccgtacgttcgttacggttacctttcgacgtttcccccg

SEQ ID NO: 111461 - DNA, 688 bp, Homo sapiens
  misc_feature: GYAE6OF01B9EKE.45.36.D03.1.454.CMB.1.raw
  modified_base (204)..(204): a, c, t, g, unknown or other
  misc_feature (204)..(204): n is a, c, g, or t
  modified_base (273)..(273): a, c, t, g, unknown or other
  misc_feature (273)..(273): n is a, c, g, or t
  modified_base (437)..(437): a, c, t, g, unknown or other
  misc_feature (437)..(437): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccaggccaccctgtctctgtctccgagggganacacgcccaccctctcctgcgagggccaggtaggagtgtacaggtaagtacttaggctaggtaaccaanagaaacctggaccaggcctcccgaggcctcctcactccatgatcgcctactacccgaaacgtccgggtccctcgggcccgtacccgaagaccgtacggtttccgagaccgtagggtcgggtacgtaggggactaggtacgttccacgttccgtaccgacccgtnacggccacggccgttagggactccgttagacttggttacttttcgactttagttttaccttgtcgtacacggtccgtacggttccccgttacccgcccgacccgggtcccgtaccgtttacccggtaaccggggtttcgggggacccggggggtacgtacggggtagggaaggtacgtagggaacggaaacggtacgttggggtacgccgtacggaccctaccgttagtcctttcggttccttcgtacccg

SEQ ID NO: 111462 - DNA, 568 bp, Homo sapiens
  misc_feature: GYAE6OF01D2RQT.45.36.D03.1.454.CMB.1.raw
  modified_base (403)..(403): a, c, t, g, unknown or other
  misc_feature (403)..(403): n is a, c, g, or t
  modified_base (503)..(503): a, c, t, g, unknown or other
  misc_feature (503)..(503): n is a, c, g, or t
tcagacgcgatcgacacgaccggtgctcgatttagctgcgtcacgatcgtctcgttggggaaggaactcgcttcgagttaggacccagaggaaccatggaagccccagctcagcttctcttcctcctgctactctggctcccagataccaaccggaaaaattgtgttgacacagtctccaggcaccctgtctctgtctccgagggagacagccaccctcgtcctgcagggccagtaggagtgtcagtagtacttaggctggtaccaactagaacctggccaggctccaggctcctcgactccagtgatgcatccgaacgtcgggtccctggccgtcccaggacctaaggttccgtggctaggtgggtctaggggtacaggtacttcacgtctcaccgtcagcncgcctggacgcctgacttgtaatttcgactacgttttacttctgtcagccagtccgttccgcaccgccgtctccgtacggtttccgggacgggggtaccnggggttcggactagtcgagtacgtagtggaggtctcgacacctagtcctagtccttgcgttcccg

SEQ ID NO: 111463 - DNA, 535 bp, Homo sapiens
  misc_feature: GYAE6OF01EG6TZ.45.36.D03.1.454.CMB.1.raw
  modified_base (524)..(535): a, c, t, g, unknown or other
  misc_feature (524)..(535): n is a, c, g, or t
tcagacgcgatcgacacgaccggtgctcgatttagctgcgtcacgatctctcctgtgcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctggggcaaagggacctcggtcaccgtctccgcagccttccaccgaagggcccatcggtccttcccctggccgccctgcctccgaggacgccaccgtcgtggggcacgaggccggcccgtgggtctcggccctcgggtacaacggtactaccttcccgcgactcgcgttcgtgacggcgggctggcaacgggcgacgagtagnnnnnnnnnnnn

SEQ ID NO: 111464 - DNA, 230 bp, Homo sapiens
  misc_feature: GYAE6OF01BP50Z.45.36.D03.1.454.CMB.1.raw
  modified_base (227)..(230): a, c, t, g, unknown or other
  misc_feature (227)..(230): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnn

SEQ ID NO: 111465 - DNA, 553 bp, Homo sapiens
  misc_feature: GYAE6OF01CFX6C.45.36.D03.1.454.CMB.1.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacgngggtcccctggccgtcccagacgtaggttccgtggcaggtgggtctggggacaggtagttcactctcgaccgtcacgcagccgtggacgcctgatgtattttgcttagtttacttctgtcagcagtccgttcccgccgaccgccgtcctccgtaccgtttcggggcgggggtaccaggggtggagtagtggagacgtacgtggtaggcgtgaccacgtattcgtagtccttcgtcttcccg

SEQ ID NO: 111466 - DNA, 569 bp, Homo sapiens
  misc_feature: GYAE6OF01ADRDD.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggctccaggctcctcatccatgatgcatccaacgcgggtccctgggccgtccccagacctagggttccgtgggcaggtcgggtctggggacaggtacgttcactctacgaccgtcagcacgccgtggactccgtgatgtatttgcttagtttacttcgtgtcagctacggtcgttcccgacgccgccgtctccgtaccggtttcggggcgggggtaccaggggtcggagtagtaggacgtacggacgtggtcggctcggacccacgtacttcgtgttccttcgacgttccccg

SEQ ID NO: 111467 - DNA, 228 bp, Homo sapiens
  misc_feature: GYAE6OF01EHUV4.45.36.D03.1.454.CMB.1.raw
  modified_base (227)..(228): a, c, t, g, unknown or other
  misc_feature (227)..(228): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnn

SEQ ID NO: 111468 - DNA, 711 bp, Homo sapiens
  misc_feature: GYAE6OF01D7J3J.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagcccaccctctcctgcaggccagtaggagtgtcagtaagtactaggctaggtaccaacagaaacctggaccaggcctcccggctccctcacttccgttcctgggtcgccaacgaccaccgacgggacccacgttgtactccccgagcccgtaggttcaggtcggcgtaggtcgggtcgtgggacgtacgggttcccgtcgtaccgacgacgttcggaccgggtctaacggtagttaccgtaggtaaacgttagtttttacgacgtttaaggttttaacttaaccgttgttaccgtaacgttacctaaggtttactaccgtacgttacgggtaacggggtcctaacggtttacgggtttttccggaacccgggtaacggggtaacccgtaaggtacccggtagggtaacgtacgtaaacgtaaaccggtaacgttagggtcgtcgtacgacctaacccgtacgttaccgttcgttccttacgtaaccttcccgttccccgcttaacg

SEQ ID NO: 111469 - DNA, 811 bp, Homo sapiens
  misc_feature: GYAE6OF01C5STQ.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcgagggccagtaggagtgtacagtaagtacttaggctaggtaaccaacgagaaaccgtggaccaaggcctacccgaggcctccctcatcccaatcgaactcgacctactacccgaaacgtccggggttcccctgggcccgttaccccgaaggaaccgtacggggtttcccggtagggaccgtagggttcggggtacctagggggaacctaggtacggttccaaccgttccgtacccgtaaccggtcaacggcccgtaacgggtcccgtacgggtaacgtccccgttaggtacgttacggtttaacgtttttacgggaccgttttaacgggttttttaccctttccggtttacggttacccgtaacggtaccgttaacccgggttcccgtttacccccgggaccccgtaacccgggtccccgtccgttacccggttacccgggttttcccggggggaccgggggggtaacccgtaggggggttaccggtaagttacgggtacggaacggtaaccgggtaacggttcgggtacgggtccgtacgggaccctaccgtagttccgttacggttcctttaccgacgtttcccccg

SEQ ID NO: 111470 - DNA, 581 bp, Homo sapiens
  misc_feature: GYAE6OF01AZVUB.45.36.D03.1.454.CMB.1.raw
  modified_base (203)..(203): a, c, t, g, unknown or other
  misc_feature (203)..(203): n is a, c, g, or t
  modified_base (468)..(468): a, c, t, g, unknown or other
  misc_feature (468)..(468): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggctccaggctcctcatccatgatgcatccaacgcgggtccctgggcccgtcccaggaccgtagggttcccgtggcctaggtgggtctaggggacaggactttcaactcctacaacctatcagtccacgtccctcggaccctggtaggtactttcgcctaatttactactgtcagcgagcgtcgccgacgngcgtctcgtacgttcgggcggacgggaccgaagggtggaagtactaccgaaaacggtacgttggacggtcgtacgaccaccgtacttacgttagttccttcgtacgttccccg

SEQ ID NO: 111471 - DNA, 571 bp, Homo sapiens
  misc_feature: GYAE6OF01B7C73.45.36.D03.1.454.CMB.1.raw
  modified_base (356)..(356): a, c, t, g, unknown or other
  misc_feature (356)..(356): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaacagaaacctggccaggcctcccaggcctcctcatccatgatgcatccaacgcgggtcccctggccgtccccagaccgtacgggttcccgnggccaggtcggggtcctggggacaggtacgttccacttctccaccgtcacggcagccgtggacgcctgattgtattttgcttagtttacttctcgtcgagctacgtccgttccgccaccgccgtctcgtacgttcggacggacgggaccgagggtggagtacgtacgaaacgtacgtggtcggctcgaccacctattctgttcttcgtcttcccg

SEQ ID NO: 111472 - DNA, 713 bp, Homo sapiens
  misc_feature: GYAE6OF01BZ5R4.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacgttaggctggtaccaacacgaaacctggccaggcctcccgaggctcctcactccatgatgcatccaacacgggtccctggccgtccccagaccgtacgggtttcccgtgggccgtagggttcggggtcgttacggggaactaggtacggtttccaaccgttctacccgaccggttacacggcctaaggcccgttagggaccgtcccgtagggtaacttcggttaacgttttttcggacgttacggttttttaccgttacgtttcggttacccgtaacggtcccgtaacgggttccccgttttccccggccccgtaaccggtccccggtcccttaccggtacccggttttccgggggacccggggggtaccgtagggggtacgggacggtagtaggacgggtaaccgtacggttggtcggtcgtcgtaccaccgtacttcgttcgttcctttcgaacctttccccgg

SEQ ID NO: 111473 - DNA, 602 bp, Homo sapiens
  misc_feature: GYAE6OF01BFYQP.45.36.D03.1.454.CMB.1.raw
  modified_base (292)..(292): a, c, t, g, unknown or other
  misc_feature (292)..(292): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggctcccaggctccncatccatgatgcatccaacgacgggtccctggccgtcccagacaggttcccgtggcaggtgggtctggggacaggtacgttcactctcaccgtcacgcacgcctggacgcctgatgtatttgctagtttacttctgtcagtctacgccgttcccgccgaccgcccgtccgtccgtaccggttttccgggggaccggggggtacccgtagggggtgggtacggtacgtaggaacggtaaccggtaacgttgggtacgggtccgtacggtaccgtacccgtacttccgttacgttcttccgtactttccccg

SEQ ID NO: 111474 - DNA, 550 bp, Homo sapiens
  misc_feature: GYAE6OF01A1NRE.45.36.D03.1.454.CMB.1.raw
  modified_base (202)..(202): a, c, t, g, unknown or other
  misc_feature (202)..(202): n is a, c, g, or t
  modified_base (431)..(431): a, c, t, g, unknown or other
  misc_feature (431)..(431): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccagggganacagccaccctctcctgcagggccaggtaggagtgtcagtaagtacttaggctggtaccaacagaaacctggccaggctcccaggctcctcatccatgatgcactccaacacgggtccctgggccgtcccagaccgtagggttccgtggcaggtgggtctggggacaggacgttcactctcgaccgtcagcagccgtggacgcctgatgtattttgcttagtttacttntgtcagcagtccgttccgccacgccgtctccgtacgtttccggggcgggggtaccaggggtcggagtgtggacgacgacgtggtggctgccacgagttctcgttctctcttccgtcccg

SEQ ID NO: 111475 - DNA, 627 bp, Homo sapiens
  misc_feature: GYAE6OF01AONL9.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccgaggcctcctcatcccatgatcgcttccagccagggcccacgtggcactcccagccaggttcaggtggcgggttgggtttgcacgtagtacctttcgaccttctaccgaactaatcgacgccacgtaccctacccaacctagtaaacgttagttttacgactacgttacttaacttacctcgtaccaaacgtacgtaccgtacgaagtacgttcggacccgttaccgttccgttacgtttaccgggaccgggtaacgggtaccggtaagggtaggacgtaacgtacgaaacgtacgtcggtacggacgttacggacctaaccgtattccgttgttccgttaccg

SEQ ID NO: 111476 - DNA, 555 bp, Homo sapiens
  misc_feature: GYAE6OF01CCX1J.45.36.D03.1.454.CMB.1.raw
  modified_base (343)..(343): a, c, t, g, unknown or other
  misc_feature (343)..(343): n is a, c, g, or t
  modified_base (391)..(391): a, c, t, g, unknown or other
  misc_feature (391)..(391): n is a, c, g, or t
  modified_base (445)..(445): a, c, t, g, unknown or other
  misc_feature (445)..(445): n is a, c, g, or t
tcagacgcgatcgacacgaccggtgctcgatttagctgcgtcacgatctctcttggggagctctgggagacgagcccagcactggaagtcgccggtgttcctttcggtgatcatcactgaacacagaggactcaccatggactttgggctgacctgggttttcctcgttgctcttttaagaggtgtccagtgtcaggtgcaggtggtggagtcggggggagcgttgtccagcctgggagtccctgagactctcctgtgcagcctctggattctccctcagttaactttggtttccactcgggtccgccaggttccaggccaaggggctggagtggtggccctnatttccgaagatggaagtgagaagcctactcagactcgtgaacggccncttcaccatctccagacgacaattaccaagtaatctccttcttttgactaatanaatagcctgagagttagaggacagtctgttctattctgtcgaccgaggggactagttcgtagtacgtagttccgttggtttaccgtaggttacgttaaagtcgtaaaacc

SEQ ID NO: 111477 - DNA, 286 bp, Homo sapiens
  misc_feature: GYAE6OF01DVC10.45.36.D03.1.454.CMB.1.raw
  modified_base (259)..(286): a, c, t, g, unknown or other
  misc_feature (259)..(286): n is a, c, g, or t
tcagacgcgatcgacacgaccggtgctcgatttagctgcgtcacgatcgtctcttgggttttggggggaagaggaagactgacggtcctcccaggagttcaggtgctgggcaccttgggcacgggggagtgtgtcacaagatttgggctctgggcaccgtgggcagtggggggtagtgtgtcactaagattttggccctgggctgcctggtcaaggctacttcctcgatcgcgtctgagcgggctggcgaggcgcatgnnnnnnnnnnnnnnnnnnnnnnnnnnnn

SEQ ID NO: 111478 - DNA, 774 bp, Homo sapiens
  misc_feature: GYAE6OF01BPWQ5.45.36.D03.1.454.CMB.1.raw
  modified_base (204)..(204): a, c, t, g, unknown or other
  misc_feature (204)..(204): n is a, c, g, or t
  modified_base (393)..(393): a, c, t, g, unknown or other
  misc_feature (393)..(393): n is a, c, g, or t
tcagacgcgatcgacacgaccggtgctcgatttagctgcgtcacgatctctcgttggggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcgagggccagtaggagtgtcagtaagtacttaggctaggtaccaagacgaaaccgtggaccaagggccctaccgagggtcctccctacatcccaatcggaacttgaccacttccgaaaccgcgggttcccctgggacccgttaccccgaaggaccgtacgggtttcccgggnggtacgtagggttcgggtcgtagggaactacggtacgttacctacgtccgtaccgtaccgtacgacggtccgacggtccgtacggtaccgtcgttagtacgttaggttacgtttacgtacgtttacgttttaccgttcgttcgttacgtacggtaccgtacggtcccgttacccggacccgtacccggtcccggttcccgttacccgggttaccggggtttccgggggacccgggggttaacccgggtacgggggtacggtaacggtaacggtaccggggtaacggtaaccgggtacggttagggtaccggtacgttacccggacccgtaaccgttaccgttaccggttaccgtttacccttcccgtacccggtttccccg

SEQ ID NO: 111479 - DNA, 799 bp, Homo sapiens
  misc_feature: GYAE6OF01CPRIH.45.36.D03.1.454.CMB.1.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtactaggctaggtaccaanagaaacctggccaggcctccgaggctcctcatccatcgatcgcactccaacgtacggggtccctaggccgtaccccaggtaccgtacgggtttccgtcgggacgtacgggttcggggttccgtaggggaacctagggtacggtttccaacgtttccgtaccgtacccgttcgacggtaccgtacggtcccgttagggacgtcccgttaggaactttacggttaacgtttttacggaaccgtttaacgggttttaacctttaccggttacggttaccgtaaacggttcccgtaacgggttcccggtttaccccggtacccgttaacccgggttccccggttacccgtttacccgggttaaccgggtttttcccgggggacccggggggttaacccgtacggggggttacgggaaccggttaacggtaccgggtaacggtaacccgggtaaacggttgggttaacgggtccggtacggtacccgtaacccgtacggtttccgttaccggtttacctttccggtaaccgtttccccgg

SEQ ID NO: 111480 - DNA, 652 bp, Homo sapiens
  misc_feature: GYAE6OF01EOOST.45.36.D03.1.454.CMB.1.raw
  modified_base (210)..(210): a, c, t, g, unknown or other
  misc_feature (210)..(210): n is a, c, g, or t
  modified_base (358)..(358): a, c, t, g, unknown or other
  misc_feature (358)..(358): n is a, c, g, or t
  modified_base (461)..(461): a, c, t, g, unknown or other
  misc_feature (461)..(461): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctaggtaaccaacaagaaacctggaccaggcctcccgaggcctcctcatccatgatgcatccaacgcggtccctggccgtcccagacgacggttccgnggacgaggtgggtcgtagggactagtacgttcactcctacaccgtcagccacggtcctagggactccgttagagttgtattttcgactttaagttttaccttntcgtcagtcctacggtcccgtttcccgccgtaccggtcccgacttccgttaaccgggtttccgggggacccggggggtaccgtaggggggtacggaaggtaacggttcgggaaccggtaaccggtaacggttgggtccgggtacgttaccggacccgtaaccgttagttccggtttcgttccgtttacccg

SEQ ID NO: 111481 - DNA, 182 bp, Homo sapiens
  misc_feature: GYAE6OF01D0NCC.45.36.D03.1.454.CMB.1.raw
  modified_base (180)..(182): a, c, t, g, unknown or other
  misc_feature (180)..(182): n is a, c, g, or t
tcagacgcgatcgacacgaccggtgctcgatttagctgcgtcacgatctctcttgggtttgggggaagaggaagactgacggtcctcccaggagttcaggtgctgggcacagcggccctgggctgcctggtcaaggactacttcctcgatcgcgtctgagcggctggcaaggcgcatagnnn

SEQ ID NO: 111482 - DNA, 701 bp, Homo sapiens
  misc_feature: GYAE6OF01DM4J0.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtcaaagtgtcgcaccggatacttagcctggtaccagcagacgacctggccacgccctccgaggtcctccctcactctagtcggtcgcactcctccgacgggtcctcgtcggtccgtcccccggcgtaggttcaggtcggctaggtgggtctggggactaggtacgttcactctaccgaccgtcacgccgacgccgtgggacgtcccgttagtacgttggttaactttttcgacgtttacgttttaccgttcgttcgttacgacgtccgtaacggtcccgtttacccggacccgtacccggtcccgtaccgttacccggttaacccgggttttcccggggggacccgggggggtaaccccggttaggggggtacgggtaacggtaacggttacgggaaacgggtaaccgggtaacggttcgggtcgggtaccgttacggaccctaacccgttacgttccgttcggtttacccg

SEQ ID NO: 111483 - DNA, 602 bp, Homo sapiens
  misc_feature: GYAE6OF01C6DU8.45.36.D03.1.454.CMB.1.raw
  modified_base (205)..(205): a, c, t, g, unknown or other
  misc_feature (205)..(205): n is a, c, g, or t
  modified_base (351)..(351): a, c, t, g, unknown or other
  misc_feature (351)..(351): n is a, c, g, or t
  modified_base (381)..(381): a, c, t, g, unknown or other
  misc_feature (381)..(381): n is a, c, g, or t
  modified_base (449)..(449): a, c, t, g, unknown or other
  misc_feature (449)..(449): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctcggcccccagataccaaccggaaaaattgtgttgacacagtctccaggcaccctgtctctgtctccgagggganacagcccaccctctcctgcagggccagtaggagtgtcagtaagtacttaggctggtaaccaacagaaacctggccaggcctcccaggcctcctcatccatgatgcatccaaacgcggggtccctggcctcccagccgaggttccgnggcaggtgggctgggacagacgttcactcncaccgtcagcagcctggacgcctgatgtattttgcttagtttacttctgtcagctacgtccgttcccnccgacgtcccgcttccgtaccgtttccggggccggggggtaccgtagggggtggaaggtagtagggaacggtaccggtaacgttcgggtgggtacgtcggaccgtaaccctagttccgttcgttcctttaccacgtttccccgttacccccgg

SEQ ID NO: 111484 - DNA, 738 bp, Homo sapiens
  misc_feature: GYAE6OF01AX5YV.45.36.D03.1.454.CMB.1.raw
  modified_base (128)..(128): a, c, t, g, unknown or other
  misc_feature (128)..(128): n is a, c, g, or t
  modified_base (188)..(188): a, c, t, g, unknown or other
  misc_feature (188)..(188): n is a, c, g, or t
tcagacgcgatcgacacgaccggtgctcgatttagctgcgtcacgatctctcttgggaggaactgctcagttaggacccagagggaaccatggaagccccagctcagcttctcttcctcctgctactntggctcccagactaccaccggtaaaattcgtgttgacacagtctccaggcaccctgtctntcgtctaccgaggggacacacgcccaccctctccgtgcgacgggccaggtaggagtcgtcaagtaagtacttagggctggtaaccaacgagtaaacctggctaggcctacccgaggcttcccgtctatcccagtcgatcgacacgtacccgaaagtccgggtcccttgggacccgtacccaacgtacgtacgggtttccggtaggccgtaaggggtcgggttcacggggtaaccaggtacggttcctaaccgttccgtaccgtaacccggttccaacgtccggtaacgtccggtggtaccgtcgtacggttacgttacgttacgttttacgtccgttaagttttacccgtttcttacggtaccgtacgtacgtcgttacccggtcccgtaccggtccgtacccgtaccggttccgttacccgttccgggggtaccggggaccggtacgggtacggaagtggtaccggtacggaaccggtacggttcgtcggggtcctcgggtaaccgcccgttaccgttagtttacccgggtcttccggtacgttcccgg

SEQ ID NO: 111485 - DNA, 542 bp, Homo sapiens
  misc_feature: GYAE6OF01C0KCA.45.36.D03.1.454.CMB.1.raw
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (516)..(516): a, c, t, g, unknown or other
  misc_feature (516)..(516): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaaccaacaagaaaccgtggacccaggcctcccaggcctcctcatccatgatcgcactccaacgagggtccctggccgtcccagacgtacgggttccgtggctaggtgggtctgggacagcgttcactctcaccgtnagcngcctggacgtcctgatgtatttgctagtttactctgtcagtcagtccgttccgccgtacgccgtctcgtacgttcgggcggggtacgagggtgagtagtcggagacggagtggtcggcngacactcgtctgtctcgtcgttcccg

SEQ ID NO: 111486 - DNA, 534 bp, Homo sapiens
  misc_feature: GYAE6OF01BJHGE.45.36.D03.1.454.CMB.1.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggctcctcatccatgatgcatccaacngggtccctggcctcccagacaggttccgnggcaggtgggtctgggacnggagttcactctcacgtcagcagcctggagcctgatgtatttgctagtttacttctgtcagcagtccgttccgcaccgccgtctccgtacgtttccgggcgggggaccgaggggtgagagtgacgacggtaacgtggtcggcgtgacaccgtatccttgtccttcgtacttcccg

SEQ ID NO: 111487 - DNA, 517 bp, Homo sapiens
  misc_feature: GYAE6OF01EL0FY.45.36.D03.1.454.CMB.1.raw
  modified_base (385)..(385): a, c, t, g, unknown or other
  misc_feature (385)..(385): n is a, c, g, or t
  modified_base (429)..(429): a, c, t, g, unknown or other
  misc_feature (429)..(429): n is a, c, g, or t
  modified_base (480)..(480): a, c, t, g, unknown or other
  misc_feature (480)..(480): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (511)..(512): a, c, t, g, unknown or other
  misc_feature (511)..(512): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctaggtaccaacagaaacctggccaggcctccaggctcctcatccatgatgcatccaagcgggtccctggcctcccagacctaggttcccgtggcaggtgggtctgggtacagtacgttcactctcaccgtnaggcagcgtgcgcctgatgtatttgctagtttacttcgtgtacngtcacgtcgtccgccacgccgctcgtacgttcgggcggggacagggtgagngtgagacgagtgnggcngcactntctntctnntcccg

SEQ ID NO: 111488 - DNA, 666 bp, Homo sapiens
  misc_feature: GYAE6OF01CTTXH.45.36.D03.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (355)..(355): a, c, t, g, unknown or other
  misc_feature (355)..(355): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccaggtaggagtgtcagtaagtacttaggctggtaccaanagaaacctggccaggcctaccgaggcctcctcactccatgatgcatccaacgacgggtccctgggcctacccgagaccgtagggttcccgnggctaggtcggggtctggggacaggtacgttcaaccttcgtccgaccggtcaacggtcagtccgtacggacggtccctaggattggttacgttttggtacgttaacgtttttcgttacgtttcgtcgtacgtccgtaggttcccgttacccggcctacccgcccgtccttccgtaccggtttccggggaccggggggtaccgcggggttacgggaggtagtacgggaacggaccgggtaacgtgggtacgggtccgtccgggaccgtacccgttagttccgttacgtttccctttcgtacctttacccccg

SEQ ID NO: 111489 - DNA, 771 bp, Homo sapiens
  misc_feature: GYAE6OF01C1OAA.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacacgccaccctctcctgcgagggccaggtaggagtgtacaagtaagtacgttaggctaggtaaccaacgaacgaaaccgtggaccgaagggccctacccgaggtcctccctacactccatcgatcgactactaccgaaacgtcgggtccctcggacccgtcccgaggaccgtacgggttccggtcggacgtaggttcggggtacgtaggggaactaggtaacggttccaaccgttcctaccgaaccggtcgaacggccgacggtcccgtagggaccgtccgtaggtaagttcggttaagtttttcggaccgtttagtttttaccttcgttacgtacgacgtaccgtacggttcccggttacccgaccccgtaccggtccccgttaccgttacccgggttaccggggtttcccggggggggaaccggggggtaacccgtagggggggttaccggaaacggttacggtaccgggaacgggtaaccgggtaacggttggggtacggtccgttacggacccgtaccgttacgttccgttacggtttcccttacgtacccgtttcccccgg

SEQ ID NO: 111490 - DNA, 568 bp, Homo sapiens
  misc_feature: GYAE6OF01C49DX.45.36.D03.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaacagaaacctggccaggctcccaggcctcctcatccatgatgcatcccaacngggtccctgggcctcccaggacacgggttccgtggctaggtcgggtctggggacagtacgttccactctccaccggtcagccagccgtggcgctgatgtatttgcttagtttacttcgttgtcacgctacgtccgtccgccgaccgtcccgtctccgtccggtttccggggccgggggtacgtaggggtcggagtacggtacggacggaacgtacgtggtcggcgtcgccacgtctcgtgttcttcgtcgttcccg

SEQ ID NO: 111491 - DNA, 584 bp, Homo sapiens
  misc_feature: GYAE6OF01BJS7A.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaacctggccaggctccaggctcctcatccatgatgcatccaacgcgggtcccctggccgtcccagaccgtaggttccgtggcaggtggggtctggggacaggacgttcacgtctacgaccgtcagcagccgtggacgctgattgtatttgactagtttctctgtcagtctagtcgttccgcgacgccgtctcgtaccgtttcggggccggggtacgacgggtacgggtacggacgtcggaacggtacgtaacggtagggtcgggtccgttacgaccgtaccctacgttaccgttacggttcccttcgtaccttccccg

SEQ ID NO: 111492 - DNA, 923 bp, Homo sapiens
  misc_feature: GYAE6OF01C0KYK.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggacttgggctgaccttgggttttcctcgttgcttcttttaagaggtgtccagtgtcaggtgcaggtggtggaggtcggggggagcgttgtccaggcctggggagtccctgagactctcctgtgcagcctcgtggacttcctcccttacagttaaaccttttcggtttcccacgttcggggtcccgccgtagggtttcccgagggtccgaaacggggggtcctggggtaacgggttcgggggttcgggcccccttcgtaacggtttttacccggaaaggtacgttagggtaaaggttggaaacgggtaaacgggtaccccttaaccgttacgaacggtaacccgttcccgggtagggtaaaaccggggggcccccttaccgtttacccgacccgtaacgttacccgttacccgtaaacggaaacggtaaacctaaaacgttttaccccgaaaaaggttaaaaccgtttaccgggtttaccccttttaccgtttttttaacggtaaacccgttaaaaacgtttaacggtaaaacgtttaacgggtaccccgtttaagggtaaacggttaagggttttaacgggtaaacgggttaaccgtaacccgggttttaccgtttaccgggtttacctttaacgttttttcccggttacgggttacccgggttacccgggtaaacggggggggtaaacccttaacggttaccgtttaaagttcgggttaaacgggttccgtttacggggtttacgttaggtttaacgttaaacgttacccgttaaaaacccg

SEQ ID NO: 111493 - DNA, 603 bp, Homo sapiens
  misc_feature: GYAE6OF01DY8ID.45.36.D03.1.454.CMB.1.raw
  modified_base (204)..(204): a, c, t, g, unknown or other
  misc_feature (204)..(204): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctccaggctcctcatccatgatgcatccaacgcgggtccctggctcccagacaggttccgnggcaggtgggtcngggacagngttcactctcaccgtnacgcagccgtggacgtcctagtatgtattttcgcttacgtttacttctgtctagcagtccgttccgccgaccgccgtctccgtaccggtttccggggcgggggtaccgtaggggtacggacggtacgtagggaacgtaccggtaaacggttgggtacgggtccttacggacccgtacccgtaacgttccgttacggttaccctttccgtaaccgtttccccccgg

SEQ ID NO: 111494 - DNA, 522 bp, Homo sapiens
  misc_feature: GYAE6OF01B50LW.45.36.D03.1.454.CMB.1.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaactatacttggcctggtatcaatacaagcctggccacgggtccccgctcctcatctatgatgctcagcagggccatggcactcccagccaggttcagtggcggtggtctgggacngtcgttacnctcacatacacncgcctcagtcagtaagtntttgctagtttatactgtcactagtataagtaagtgtcctcggtggtacgttacggaccgaagggactaaaggtaggaaacgtcgaaagtacgtggtacggctacggtccacgtatcctgtcttacg

SEQ ID NO: 111495 - DNA, 273 bp, Homo sapiens
  misc_feature: GYAE6OF01CVLG4.45.36.D03.1.454.CMB.1.raw
  modified_base (270)..(273): a, c, t, g, unknown or other
  misc_feature (270)..(273): n is a, c, g, or t
tcagacgcgatcgacacgaccggtgctcgatttagctgcgtcacgatctctcttgggtttggggggaagaggaagactgacggtcctcccaggagttcaggtgctgggcaccttgggcacgggggaggtgtgtcacaagatttgggctctgggcaccgtgggcagtgggggagtgtgtcacaagatttgggctctgggcacagcggccctgggctgcctggtcaaggctacttctcgatcgcgtctgagcgggctggcaaggcgcatagnnnn

SEQ ID NO: 111496 - DNA, 511 bp, Homo sapiens
  misc_feature: GYAE6OF01C2X7A.45.36.D03.1.454.CMB.1.raw
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (503)..(511): a, c, t, g, unknown or other
  misc_feature (503)..(511): n is a, c, g, or t
tcagacgcgatcgacacgaccggtgctcgatttagctgcgtcacgatctctcctgtgcagtaactttggtttccactgggtccgccaggttccaggcaagggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctggggcaaagggccctcggtcaccgtctccgcagcttccaccgaaggcccatccggtccttccccnggccnccctgctccaggcgcacctcgtggggcacacggccggccctgggctcggccgtggtcgaaggactacactccctcgactcgcgtctgagcgggctggcaagggcgcatagnnnnnnnnn

SEQ ID NO: 111497 - DNA, 534 bp, Homo sapiens
  misc_feature: GYAE6OF01BSVVQ.45.36.D03.1.454.CMB.1.raw
  modified_base (341)..(341): a, c, t, g, unknown or other
  misc_feature (341)..(341): n is a, c, g, or t
  modified_base (416)..(416): a, c, t, g, unknown or other
  misc_feature (416)..(416): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctggcctcccagacaggttcccgnggcaggtgggtctgggacagagttcactctcaccgtcagcagcctggacgcctgatgatttgactagtttacttntgtcagctacgtcgttccgccaccgtcccgctcgtaccgtttccggggccgggggtaccagggtcggagagtggacgacgtaagtggcggctcgccactagtctgtccttgcttcccg

SEQ ID NO: 111498 - DNA, 610 bp, Homo sapiens
  misc_feature: GYAE6OF01BLRTR.45.36.D03.1.454.CMB.1.raw
  modified_base (345)..(345): a, c, t, g, unknown or other
  misc_feature (345)..(345): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcactccatgatgcactccaacgacgggtccctggcctcccagaccaggttccgnggcaggtgggtctgggacaggtgttcactctacgaccgtcagcacgccgtggacgtcctgatgtatttgacttagtttacttcgtgtcagtctacgtccgttacccgccgtaccgtccgccgttaccgtaccgggtttccggggaccgggggtaccgtagggggtggtacggtagtacggacggtaaccgggtacgttcgggtaggtccggtcggtaccaaccgttacgtcgttacgttccttcctacgttcccgttacccccgg

SEQ ID NO: 111499 - DNA, 656 bp, Homo sapiens
  misc_feature: GYAE6OF01E2QIJ.45.36.D03.1.454.CMB.1.raw
  modified_base (354)..(354): a, c, t, g, unknown or other
  misc_feature (354)..(354): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccgaggctcctcatccatgatcgcactccaacgacgggtccctgggccctacccaggaccgtacgggttccgnggctagggttcgggtcgtagggacaggtacgttccacttcccgtcgaccggtcacgcctacgccgtaggacgtcctaggtatgttaacttttgacttagttttaccttcgtcgtcgacgtctacggtcccgttccgcccgtacgcccgtcgttccgtaccggtttcccgggggaccggggggtaaccctagggggtcggaacggtagttacgggaaacggtaccgggtaaacgttggggtacggccgttacggacccgtacccgtagttccgttacgttccctttccgtaccgttttccccg

SEQ ID NO: 111500 - DNA, 569 bp, Homo sapiens
  misc_feature: GYAE6OF01C0EDC.45.36.D03.1.454.CMB.1.raw
  modified_base (205)..(205): a, c, t, g, unknown or other
  misc_feature (205)..(205): n is a, c, g, or t
  modified_base (342)..(342): a, c, t, g, unknown or other
  misc_feature (342)..(342): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagaaaccattggagaaatactgatgacgcagtttccagccaccctgtctgtgtctccaggggaaagngccaccctctcctgctgggccagtcagagtgttagcaaccacttagcctggtaccagcagaaacctggccaggctccaggcctcctcatccatgatgcatccaacacgggtccctggccgtcccagacaggttccgnggcaggtgggtctgggacaggtacgttcgactcctacaccgtnacgcacgcctagggacnccgtgtactagtattttgctagttttacttcgtgtcagctacggtccgttcccgccaccggtcccgctcgtaccgtttccggggcggggggtaccgtaggggtgggacgtagtacggaagggtacgaaaggtcggtcgggctggaccacctatccgttgtcttaccg

SEQ ID NO: 111501 - DNA, 704 bp, Homo sapiens
  misc_feature: GYAE6OF01D2EDB.45.36.D03.1.454.CMB.1.raw
  modified_base (200)..(200): a, c, t, g, unknown or other
  misc_feature (200)..(200): n is a, c, g, or t
  modified_base (414)..(414): a, c, t, g, unknown or other
  misc_feature (414)..(414): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccaggtaggagtgtcagtaagttacgttaggctaggtaaccaacacgaaacctggccaggcctcccaggcctcctcatccatgatgccataccaacgacgggtcccctggcccgtcccaaggtaccgtacgggttccggtggcctagggttcggggtctggggacaggtacgttcacttccgtacacccgtnagccgacgccgtagggacgtccgtagtacttggttaattttcgtacgttacggtttttaccttcgtttgtaccgtagtacccgtaggtcccggttacccgacccgtacccgtccccggtccgttacccggtacccgggttttaccgggggacccggggggtaaccgtaggggggtacgggaggtaacggttacgggaaccgggtaaccggtaaacggttgggtaccgggtccgtcggacccgtacccgtacgtttccgttacgttacccttccgtaccgtttacccccgg

SEQ ID NO: 111502 - DNA, 569 bp, Homo sapiens
  misc_feature: GYAE6OF01BLKOW.45.36.D03.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcagggccagtaggagtgtcagtaagtacttaggctggtaccaacagaaacctggccaggctcccaggctccncactccatgatgcatccaacgcgggtccnggcctccagacnggtccgngcnggtgggtctagggacngtagttcactctcaccgtnacgcagccgtggacgccgtgattgtattttgcttaagtttacttgtcgtcgtagtctacggtccgtcccgcgacccgccgtaccgttccgtaccggtttccggggaccggggtaccgaggggtcggaggagtgaacggacggtacgtgggcggctcgaccacgtacttcgtatcgttccgtacttccccg

SEQ ID NO: 111503 - DNA, 788 bp, Homo sapiens
  misc_feature: GYAE6OF01AKODF.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcacgggccagtaggagtgtcaggtaagtacttaggctggtaccaacagaaacctggccaggcctcccaggctcctcatcccatgatgacctatccaacgacgggtccctagggtcccgtacccaaggacctagggttcccggtggcctagggtcgggtcgtggggaacaggtacgtttccaccgttcctacccgtacccggtaccgaacggtccgtaacgggtcccgttacggggaacggtccccggttacggtaacggtttacgggttaacgttttttaccggaccggtttaaccggtttttaacccgtttccgttacggttacccgtacggtacccgtacggttccccgggtttaccccggacccgtaaccccggttccccggtaccgttacccgttaacccggggttttccggggaacccgggggggttacccgtaggggtacgggtacggtacggtacgggtaacggtaaccggtaccgggttacggtcggggtccgttacgggtacccctaacccggtacgttacccggtttaggttacccgtttccgtaccgtttaccccccgg

SEQ ID NO: 111504 - DNA, 759 bp, Homo sapiens
  misc_feature: GYAE6OF01CCWX6.45.36.D03.1.454.CMB.1.raw
  modified_base (321)..(321): a, c, t, g, unknown or other
  misc_feature (321)..(321): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcagggtggtgggaggtcggggggagcgttgtccaggccgtggggacgtcccgtgagacctctcctgtcgcagcctctggattcctccctcagttaactttcggtttccacgtcgggtcccnccgtaggttcccaggccgaagggctgggaggtcgggtcggcccctcgtagtttacccggaaggtacgtagggtaagtagggaaacggtaaacgggtcccttaaccgtacgaacggtaacccgttcccgggtagggaaaccggggtccccgtaccgtttaccgaacccgtaaccttccgtacccgaacggtaacgaaccgtaaaacttaccgaaacgtaacgttaccgttaccctttacgttttttacgaactaaaacgttacgtaaacgtacgtacccgtaggtaacggtaaggttacggaacggtaaccgtaccgttacgttacgttacttacgtttcgtagtaccggtaccggacgggggtaacctagttacgttagttacggtacggttcgttacgggtttacggttaaggttacgttaacgtaccgttaaaccg

SEQ ID NO: 111505 - DNA, 675 bp, Homo sapiens
  misc_feature: GYAE6OF01AY1EI.45.36.D03.1.454.CMB.1.raw
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaacagaaacctggccaggcctcccaggctcctcatccatgatgcatccaacacgggtcccctgggccgtcccaaggtaccgtacgggttcccgtgggcctagggttcggggtctggggacaggtacgtttccaaccgttcctaccgacccgtcgacgccgacgcccgttgggacgtcccgtagtacgtgtattttggccgttagttttaccttcgttgtccgtagtcgacggtccgttcccggacccgtaccggtcccgtccgttaccgtaccgggttttcccgggggaccggggggtacccggtagggggtacgggtacggtacggtacgggtacggtaaccggtaacggtcgggttacgggtcgtacggtaccctacccgtagttccgttcggttcccgtttaccg

SEQ ID NO: 111506 - DNA, 703 bp, Homo sapiens
  misc_feature: GYAE6OF01C6DTE.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctaggtaaccaacaagaaacctggaccaagggcctcccgaggcctcctcactccatgatcgcactccaacgagggtcccctgggccgtaccccaggtaccgtacgggttcccgtaggccgtagggttcggggtcgtaggggaacaggtacgttaccacctcgttccgaacccggttgacggccacggtcccgtagggacgtccttaggattggttattttcggacttacggtttttacctcgttgtacacgtccgtacggtcccgtttcccgcccgaccggtcccgtaccttccgtaccgggtttccggggggacggggggtaacccgtagggggtacgggaacgtacggtacgggaacggtaaccggtaacggttgggtacgggtccgtacggtacccgtaaccgtacgtttaccgttacggtttcccttaccgttaccgtttcccccg

SEQ ID NO: 111507 - DNA, 617 bp, Homo sapiens
  misc_feature: GYAE6OF01DW2GE.45.36.D03.1.454.CMB.1.raw
  modified_base (203)..(203): a, c, t, g, unknown or other
  misc_feature (203)..(203): n is a, c, g, or t
  modified_base (354)..(354): a, c, t, g, unknown or other
  misc_feature (354)..(354): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (529)..(529): a, c, t, g, unknown or other
  misc_feature (529)..(529): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgccaccctctcctgcagggccagtaggagtgtcagtaagtacttaggctaggtaaccaacaagaaacctggccacggcctcccgaggcctctcatccatgatcgcatccaacgcgggtccctggccgtacccagaccgcggttccgnggctaggtcgggtctgggacagtacgttcactcgtcaccgtnagcagcctggcncgtgacgttgtatttcgattacgttttactcgttgtccgagtccgtacggtcccgtttcccgcccgtacccgtcccgtccttaccggtaccgggttttcccgggggccggggggtaaccgngggggtggaacggtagttcggaacggtaccggtaacgtgggtcggcgtacgaccgtaccgtagtccgttgttccttctcgttaccccg

SEQ ID NO: 111508 - DNA, 697 bp, Homo sapiens
  misc_feature: GYAE6OF01DQKWM.45.36.D03.1.454.CMB.1.raw
  modified_base (251)..(251): a, c, t, g, unknown or other
  misc_feature (251)..(251): n is a, c, g, or t
tcagacgcgatcgacacgaccggtgctcgatttagctgcgtcacggaagtctctcgttgggggaggaactgctcagttaggacccagagggaaccatggaagccccagctcagcttctccttcctcctgctactctggctcccagataccgaccggtaaaattgtgttgacacagtctccaggcaccctgtctctgtcgtccgaggggagacgacgcccacccgtctccgtcgcgacgggtccagtacggngtcgtcagtaagtacttaggctaggtaaccaacaacgtaaaccgtggaccgaagggcctacccaggcctcctcactccatacgactcgactactacccaacgtacgggtccctggccgtaccagtaaccgacggttccgtggcgaggtcgggtcagggactaggtacgttcaacgtctacgaccgtacacgcgtacgcccgttaggaccgtaccgtggaaacttggttaattttcgtacgttaacgttttaccttcgttacgtacgacggtccgtacgggtcccgttacccgacccggaccggtcccgtccgttacccgtaccgggtttcccggggacgggggttacccgaggggttacggaaccgtaggtaccggaacggtacccgtaacggtggtaccggtcacggtacccaccgttatccgtacgttctcgtaccgttcccgg

SEQ ID NO: 111509 - DNA, 613 bp, Homo sapiens
  misc_feature: GYAE6OF01EDK0D.45.36.D03.1.454.CMB.1.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
  modified_base (409)..(409): a, c, t, g, unknown or other
  misc_feature (409)..(409): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacaagaaacctggccaggcctcccaggcctcctcatccatgatgcacgtccaacgacgggtcccctgggccttcccgagtaccgtacggttccgnggcaggtgggtcctgggacagtagttcactctcaccgtcagtcagccctggcncctgtactgttacgtttgccgttagttttaccttcgtgtcaggtcctaggtccgttcccgccgaccgcccgacgttccgtacggtttccgggggccgggggtactagggggttggacgtagtcggaacggtacggaacgttgggtacggccgttacggccctaacccggtattacccgtggtttcccttcgacgtttcccccgg

SEQ ID NO: 111510 - DNA, 591 bp, Homo sapiens
  misc_feature: GYAE6OF01ES5X1.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggaccaggcctcccgaggtcctcctcactccatgatgcactccaacgtcgggtccctggccgtacccagaccgtacggttcccgtggaccgtaggtcggggtctaggggacaggtacgttccacttctacgaactatcagcacgccctaccaacctagaacgttatttcgactagttacttattacgtacgtacaactagtcgtacagtacgttcgccgtctccgtacgttcgggacggacggacgtaaggtggacgtagtaacgaaacggtacgtaggtcggactcgacaaccgtactcttagttaccttctcttcccg

SEQ ID NO: 111511 - DNA, 571 bp, Homo sapiens
  misc_feature: GYAE6OF01ELTTU.45.36.D03.1.454.CMB.1.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (425)..(425): a, c, t, g, unknown or other
  misc_feature (425)..(425): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaagagaaaccgtggccaggcctccaggctcctcatccatgatgcatccaacgngggtccctggcgtccagacgtaggttccgngcaggtcgggtctgggacagtacgtcactcncaccgtnagcagctggacgcctgactgtatttcgctagtttactgtgtcngtctcgtcgttccgccgtaccgtccgtcctacgtccggtttccgggaccgggggaccgtaggggtcggagtacgtacggacgtaccgggtacttgggtacggtccgtcgacacccgtgttccgtagttccttacgccgtttccccg

SEQ ID NO: 111512 - DNA, 595 bp, Homo sapiens
  misc_feature: GYAE6OF01CNZRS.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagcccaccctctcctgcagggccagtaggagtgtcagtagacttaggctaggtaccaacagaacctggccaggcctccaggctcctcatcccatgatgactactccaacgcgggtccctggccgtacccagaccgtacgggttccgtggctaggtcgggtctggggaactaggtcgttacactcctcgaccgtcaacggcacgccgtggacgctgatgtatttgcttagtttctgtgtcagtcgagtccgttacccgcgtaccgccgtctacccgtacgtttccggggacggggtaccgtaggggtcgagtacgtcggagtaaccggtaggtggtaaggtccctacggaccctacgtactttccgtagttccctttcgaccgtttccccg

SEQ ID NO: 111513 - DNA, 630 bp, Homo sapiens
  misc_feature: GYAE6OF01AISB5.45.36.D03.1.454.CMB.1.raw
  modified_base (205)..(205): a, c, t, g, unknown or other
  misc_feature (205)..(205): n is a, c, g, or t
  modified_base (484)..(484): a, c, t, g, unknown or other
  misc_feature (484)..(484): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagactaccaaccggaaaaattgtgttgacacagtctccaggccaccctgtctctgtctccgagggganacacgccaccctctcctgcagggcccagtaggacgtgtcagtaagtacttaggctcggtaaccaacacgaaacctggaccaggtcctcccgaggcctcctcactccatgactgccactccaacgacgggtccctgggtcctcccgagaccgtacgggttcccgtgggccgtagggttcggggtcgtcggggactaggtacgtttcaacgttcgtaccgtaccggtcacgcgacgtccgtggacgtccgtagtactgtactttgctttacgtttctcgtntctagctacgcgttccgcctaccgccgtctcgtacggttccgggccgggggtaccgtggggtcggagtcggtacggacggaccggtaacgttgggtcggtcgttacgaccgtacgtacttcgttacgttccttcgtacgttccccg

SEQ ID NO: 111514 - DNA, 737 bp, Homo sapiens
  misc_feature: GYAE6OF01CWSZL.45.36.D03.1.454.CMB.1.raw
  modified_base (208)..(208): a, c, t, g, unknown or other
  misc_feature (208)..(208): n is a, c, g, or t
  modified_base (368)..(368): a, c, t, g, unknown or other
  misc_feature (368)..(368): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaaccggaaaaattgtgttgacacagtctccaggccaccctgtctctgtcctccgagggganacagcccaccctctcctgcacgggccagtaggagtgtcaaggtaagtactaggctaggtaaccaacaagtaaaccgtggccgaggcctcccgaggcctcctcatccatgatgctatcccaacgcgggtccctggccgtacccagaaccgtcgggttccgnggcgagggttcgggtcgtaggggactaggtacgttccactccgtacgacccggttcaacggtccacggccgttagggaccgtccgttaggtaacgttcggttaacgttttcggtaccgttagtttttacctcgttacgtactaccgtccgtaaccggtcccggtttaccccgcccgtaacccgtcccgttaccgttaccgggttacccgggtttacgggggacccgggggggtacccgttagggggtacggtaacggtacgtagggaaccgtaaccggtaaacggttgggttacgggtccgtacgggtaccccgtaaccgttacggttaccgtttccggtttacccgttcgttacccgtttacccccgg

SEQ ID NO: 111515 - DNA, 572 bp, Homo sapiens
  misc_feature: GYAE6OF01A5E6F.45.36.D03.1.454.CMB.1.raw
  modified_base (265)..(265): a, c, t, g, unknown or other
  misc_feature (265)..(265): n is a, c, g, or t
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaanagaaacctggccaggcctccaggctcctcatccatgatgcatccaacgngggtccctggcctcccagacgaggttccgnggcaggtgggtctgggacaggtacttcactctacactaatcagcacgcctaccaactagaagtatttcgactagtctacttactgtactacacgtcgtacagtattcggccgtctacgtacgtttcgggacgggtaacgggaccgtaagggtggaacgtacgtaccgaaacggtacgtaggtacggtcgtacgaccaccgtacgttactagttccttctacgttcccg

SEQ ID NO: 111516 - DNA, 611 bp, Homo sapiens
  misc_feature: GYAE6OF01CLG3V.45.36.D03.1.454.CMB.1.raw
  modified_base (303)..(303): a, c, t, g, unknown or other
  misc_feature (303)..(303): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtactaggctaggtaccaacagaaaccgtggaccaggcctcccgaggctcatcatctangacgcatcgaacgaggcctagtcggctactccccgagcccgtaggttcaggtggactaggtcggggtactggggactacggtacttcacgttctaccgacatcagcacgtccgtcggaccctggtacggttactttcgtaccgttaactttacctacgttgtcagtcgagtcggtcggacgaccggagtccgtcttaccgtacggtttccgggacgggtaacgggacgaaaggggttcggaacggtacgtaaccgaaacggtaccggtggtacggacgtacgaccacctacgttccgttcggttaccc

SEQ ID NO: 111517 - DNA, 669 bp, Homo sapiens
  misc_feature: GYAE6OF01B0BLN.45.36.D03.1.454.CMB.1.raw
  modified_base (346)..(346): a, c, t, g, unknown or other
  misc_feature (346)..(346): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaacagaaacctggccaggcctccgaggcctcctcatccatgatgcatccaacgcgggtccctggcctcccagactaggttccgnggccaggtgggtcgtgggacaggacgttcacgttcgtaccgaccgtcgacgtcgacgtccgtggacgtccgtaggacttggtacttttcggactttagttttaccttcgttacggtctacggtcctacggtcccgtttacccgccgaccgtcccgtccgttacgttacccgggtttccgggggaccggggggtacccgtagggggtacggaacgggtacgtacgggaaccggtaccggtaacggttcgggtcgggtccgttacggacccgtaacccgttaggttcccgtttacggttaccctttccgtaaccgtttcccccgg

SEQ ID NO: 111518 - DNA, 734 bp, Homo sapiens
  misc_feature: GYAE6OF01BRBMZ.45.36.D03.1.454.CMB.1.raw
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
tcagacgcgatcgacacgaccggtgctcgatttagctgcgtcacgatctctcttgggggaggaactgctcagttaggacccagagggaaccatggaagccccagctcagcctctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctaggtaccaanaacgaaacctggaccaggcctcccgaggcctcctnatccatgactgctactccaacgtcgggtccctgggcccgtacccgaggaccgtacgggtttccggcggaccgtaggggttcgggtcgtaggggaactagggtacgttcgacttcctaccgaccggttcaaggtccacggtcccgtagggacgtccgtaggtaacgttgttaagtttttcggactttaacggttttaccttcgttcgtacctaggtaccgtacgttcccggttccccgaccgtacccgcccggttccgttaccggttacccgggttttaccggggggaccgggggggtaacccgtagggggttacgggtaacggtacggttacggaaaccgggtacggtaacggttgggtaccgggtccgtacggtaccgtaaacccgttacgttccgttaccggtttacccttcccgtacgtttaccccccgg

SEQ ID NO: 111519 - DNA, 702 bp, Homo sapiens
  misc_feature: GYAE6OF01DCMNG.45.36.D03.1.454.CMB.1.raw
  modified_base (284)..(284): a, c, t, g, unknown or other
  misc_feature (284)..(284): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtcagatattagaacatactggcctggtatcaatacaagcctggccagggtccccgntcctcatctatgatcgtcttccagcgacgggccacgtggccaactccccaggtccaggtttcaggttgggccggggttaggggtttggactacgaggtaccttcaacgttccacaacaatcagcaacgccctaccaaccgtagaacgttattttcgacgtagttaccttaagtttaccgttacgtacctaaacgtacggtaccgtaaacgtaggttaacgtttaccgggtcccggtaccgttacccgttaacccggttttaccgggggaaccggggtaaaccggggtaacccgtaaaagggggttcgggaaagggtaaaccgttaaccggaaaaaacgggttaaacccggttacgggttacggggtacccgttacgggaacccgtaacccgtaacgttcccgtttacggtttaccccg

SEQ ID NO: 111520 - DNA, 669 bp, Homo sapiens
  misc_feature: GYAE6OF01C4EUC.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggccaccctgtctctgtctccgaggggagacacgcccaccctctcctgcgagggccaggtaggagtgtacagtaagtacgttaggctaggtaaccaacaagaaacctggaccaggcctcccgaggcctcccgtacactcccagtcgactcgacactcccaacgtacgggtccctggcccgtcccaggtaccgtacgggttcgcggcgtaggtcggggtcgtagggacgaggtacgttcacgtctccgaccgtcacgtccacggtccgtgggactccgtggtacttgttacgtttgacgtttacgttttcttcgtcgtcgagtccgtacggttccgttcccgacccgtccgtcccctcgttacccggttaccggttccggggggaccgggggtaccgtagggggtacgaggtacgtcgggaacgtaccgggtagtgggtacggtccgtacggtacccaccgttcgttacgttgttaccctcgtccgttacccccg

SEQ ID NO: 111521 - DNA, 770 bp, Homo sapiens
  misc_feature: GYAE6OF01DYE07.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagactaccaaccggaaaattgtgttgacacagtctccaggcaccctgtctctgtctccgagggganacagcccaccctctcctgcgacgggccaggtaggagtgtacaggtaagtacttagccttaggtaaccaaacaaaaccgtggaccaggcctccgaggctacatcatctagtgacgacactcgaacgacgggcctaacgtcggacactcccgagaccgtaggttccgaaggtcggacgtagggtcgggtacgtagggactaggtacgttaccgacctcgtaccgacccgttcgacggcctaaggtcccgttagggaaccgttccgtaggtaagttacggttacgtttttacggaccgtttaacggttttttaccgttcgttacggttaccgacgggtacctaaccgggttcccggtttaccccgacccggtacccggtcccgttacccgtttacccggttaccggggttttacccggggggacccgggggggtaacccttagggggggtacggtaaaccgggtacggttacggggaaaacgggtacccggttaaacgggttcggggtaccggtccgttaccgggtaccctaaccggttacgtttaccggttcgttaacccgtttacccg

SEQ ID NO: 111522 - DNA, 658 bp, Homo sapiens
  misc_feature: GYAE6OF01CHWS2.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggagacacgccaccctctcctgcacgggccaggtaggagtgtcagtaagtacgttaggctggtaccaacagaacctggccaggctccgaggctcctcactccatcgatcgaccactccaacgtacgggtcccctgggccgtcccaggaccgtacgggtttccgtcggcgtaggttcgggtcgtaggggacgaaggtacgttccacttcctccgaccgtcacgcgacgccgtcggacgtccgtgtatgttacgttttcgactttacgttttcctttcgtgttaccgtagtccgtaacggtccgttaccccgcccgtaccgaccgtccgtacccgttaccgggtttccggggacccgggggtacggacggggttacgggacgtacgtacgggacggtaaccggtacgttcgggtcggcgtcggtacaccgtcgttccgttagttcccttcgtccgttccccg

SEQ ID NO: 111523 - DNA, 680 bp, Homo sapiens
  misc_feature: GYAE6OF01EH6O5.45.36.D03.1.454.CMB.1.raw
  modified_base (203)..(203): a, c, t, g, unknown or other
  misc_feature (203)..(203): n is a, c, g, or t
  modified_base (400)..(400): a, c, t, g, unknown or other
  misc_feature (400)..(400): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgtttgacacagtctccaggcactctgtctctgtctccgaaggggngacgacgccgacccgtctccgtgcgacgggcccaaggtaggacgtcgtcgtaggttaagtacgttacggcttacgggtaaccaaacgaacgaaaccgtcggaccaggtcctaccgaggtcctccgtcactccagtcgacgtcgacactaccgaacgacgggttccctcggaccgtacccgaagaccgtaggttccgnggacgaggtcggtcgtgggactaggtacgttcacgtcgtcgaccggtcacgcctacgtcccgtaggacgtccgtacgtatcgttaacttttcgactttacgttttactcgttacgtcgagtctaccggtccgttaccgaccctacggcccgtccgttaccggtaccggtttcgggggaccgggggtactagggggttacgaacggttcgtaacgggacgtacgggtaagttcgggtcgtcgtcgaccgtaccgttacgtaccgtcgttcgtccgttaccg

SEQ ID NO: 111524 - DNA, 561 bp, Homo sapiens
  misc_feature: GYAE6OF01BMSKZ.45.36.D03.1.454.CMB.1.raw
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggcctccaggctcctcatccatgatgcatccaacgnggtcccnggccgtcccagacgaggttccgnggcaggtgggtctgggacaggattcgactctcaccgtcagcagcctggacgcctgatgtatttgctagtttacttctgtctagctagtccgtccgccgacgccgtcctcgtaccggtttccgggcgggggtaccgtagggtcggagacgtcggaaggacggtaacgttggtacggcgtcggacctaccgtattaccgtagttccttcgtacttccccg

SEQ ID NO: 111525 - DNA, 822 bp, Homo sapiens
  misc_feature: GYAE6OF01A8GQU.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggagtcggggggagcgttgtccagcctgggaggtccctgagactctcctgtgcagcctctggattcctccctcagttaactttggtttccacgttcgggtcccgccgaggttcccgaggcgaagggggctcgggagttcggggtcggccccttcgagttttcccggaagtagtcgggaaagtggaaggtaaacggtcccttaacgtaccgaaggtacccgtacccgggtagggaaacgggggtccccgtccgtttacccgaccctacgttaccctacccgtaacggtaacgaaccgtaaacgttacccgaaaggtaaacgttcgttaccctttaccgttttttacggaaccttaaaagttacggtaaacgttaacggtacccgttagggtaaacggttaagggtttaacgggtaacggggtaacccgtaaccgggtttacccgtttacggtttaccgtttaacgttttaccggttcggttaccgggtacccgggtaacgggggggtaacccttaaggtttacccggttaagttacggttaacgggtttaccggtttcggggttttaccggtttaagggttttaacggttaaaccgttaccgtttaaaaaccccg

SEQ ID NO: 111526 - DNA, 572 bp, Homo sapiens
  misc_feature: GYAE6OF01ANMH2.45.36.D03.1.454.CMB.1.raw
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
  modified_base (505)..(505): a, c, t, g, unknown or other
  misc_feature (505)..(505): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcacgggccagtaggagtgtcagtaagtacttaggctggtaccaacagaaacctggccaggcctcccgaggcctcctcactccatcgatgcatccaacgtacgggtccctggccgtccccgagaccgtagggttccgtggcaggtgggtctgggacagtcgttcactctacaccgtnagcacgcctggacgcctgacttgtatttgcttagtttactcgtgtcagcagtccgttccgccacgcccgtctcctacgtttccggggcgggggtacccaggggtggacgngtcggaacggacggtaacgttgggtggcttcggcctaccgtacttcgtagttccttcgcgttccccg

SEQ ID NO: 111527 - DNA, 740 bp, Homo sapiens
  misc_feature: GYAE6OF01CQF5H.45.36.D03.1.454.CMB.1.raw
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggactttgggctgacctgggtttcctcgttgctctttaagaggtgtccagtgtcaggtgcagggtggtgggaggtcggggggagcgttgtccagcctgggagtcctgagctctcctgtgcagcctcgtggtacttctccctagtaggttaacctttcggtttccacgttcggggtcccgccgtaggttcccaggtcgaagggggctgggtacggtggggtcgggaccccttcgtacgtttacccggaaggtagttagggaaagttcggaaggaaacgggtccctaactcgaacggtaccgttacccgggtaggaaaccggggccctaccgttacctaacccgacttacctaccgaagaacgtaaacctaaacttaaccgaaagtaaacttgttacccgtttcgtttttagacctaaagttacgaaacttacgtaccgtaggtaacgtaaggtttaaggaacggtaaccgtaacggttcttacggttacttaacgttttcgtacggttacggacccggtaagggggtaactacgttacgttagtacggtaacggttcgttacgggtttacgtaaggttacgttaaacgttaccgttaaacccg

SEQ ID NO: 111528 - DNA, 559 bp, Homo sapiens
  misc_feature: GYAE6OF01A3T83.45.36.D03.1.454.CMB.1.raw
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctattctgtgccgaggggactatctatgagtcgtggttcgtagtgtaatcaactactactactcatgacgtctgggacaaggacctcggtctaccgtctccgcacgtcttccaccgaacgggcccagtccggtccttcccccgtcggcccgcccctcgcctccgaggcgcctccgtccggg

SEQ ID NO: 111529 - DNA, 825 bp, Homo sapiens
  misc_feature: GYAE6OF01C6G3B.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtactaggctggtaaccaacagaaacctggaccaggcctcccgaggcctcctcactccatcgatcgacatcccaacgtaggggtcccctagggcccgtaccccgaaggtaccgtaacggggtttcccggtagggcccgtaaggggtttcgggggttaccgtacggggggtaaaccctaggttaacggtttcctaaccgttcccgttacccgaaccccggttcaacggtccgtaacggtccccgttacgggaccggtacccgttacggtacgtttacggttaacgtttttcggtaaccgtttacggtttttacccgtttacgtttacggttaccgtacggtaccgttaccggttcccggtttaccccggccccgtaacccgggtccccggttacccgttacccggttaccgggttttacccgggggacccggggggggttaacccggtacggggggttacgggtaacgggtacggttacgggaacgggtaaaccgggtaaacggttcgggttacgggtccgttacggtaccctaaccgtacgtttaccgttccggtttacccgttcgttacccgtttcccccg

SEQ ID NO: 111530 - DNA, 662 bp, Homo sapiens
  misc_feature: GYAE6OF01CUEZZ.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaaccaacagaaacctggaccaggctacccaggctcctcatccatgatgcatccaactacgggtccctaggccgtaccccagaccgtacggttccgcggtcagggttcgggtctgggacaggtacgttcactctcaccgtcacggcacgccgtaggacgtccgtgagtgtacgtttttcgacgttagttttacttcgttgttcagtcctacggtacccgtttcccggacccgtaccggaccccgtccgtaccgttaccggtttccgggggaccggggggtacccggtaggggtacggggtacgttacggtcgggaacgtaacgggtaaccggttgggttacgggtccgttaacgggtcctaacccgtagttccgttacgggttcctttacgtacgtttcccccgg

SEQ ID NO: 111531 - DNA, 591 bp, Homo sapiens
  misc_feature: GYAE6OF01BJHDJ.45.36.D03.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (348)..(348): a, c, t, g, unknown or other
  misc_feature (348)..(348): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccagtaggagtgtcagtaagtacttaggctggtaccaanagaaacctggccaggcctcccaggcctcctcatccatgatgcatccaacgcgggtccctggcctacccagacctaggttcccgnggcaggtgggtcgtgggacaggtagttcactctcgaccgtcagcacgccgtggacgcctgatgtagtttgacttagtttacttcgtgtcagctagtccgttccgccaccgcccgctccgtacgtttcggggaccgggggtaccgagggtaggagtacgtacgaaaccggtaacgttggtacgggcttcggaccgtacccgtagttccgttcgtttacccttaccttacgttcccgttaccccg

SEQ ID NO: 111532 - DNA, 709 bp, Homo sapiens
  misc_feature: GYAE6OF01AKM90.45.36.D03.1.454.CMB.1.raw
tcagacgcgatcgacacgaccggtgctcgatttagctgcgtcacgatctctcttgggggaggaactgctcagttaggacccagagggaaccatggaagccccagctcatcttctcttcctcctgctactctggctcccagataccaccggaaaaattgtgttgacacagtctccaggcaccctgtctctgtctccaggggagacagccacctctcctgcagggccagtaggagtgtacagtaagtacttaggctggtaccaacagaaacctggccaggctccaggctccctcatccagtgatcgcaactcccaacgacgggtccctggccgtccccagactacgggttcccgtggacgaggtcgggtctaggggaccaggtaacggttccaacttcccgtccgaaccggttcgaacggtccaacgggccgtcgggtacgacccgttaggacgttaggtaacgtttttcggaccgtttaacgttttaccctttacgtggttaccgtacgtaccgtacggtacccgtttcccgacccgtaccggtacccggtcctaccgggttaccggttacccggggtaccgggggggaacccgtaggggtcgggaaggtacggtaggtaacgggacggtaacggttgggttacgggcccttcggaaccgtacccgtacggttaccgtttaccggttaccttcggtcccgtttaccccgg

SEQ ID NO: 111533 - DNA, 606 bp, Homo sapiens
  misc_feature: GYAE6OF01CPV4L.45.36.D03.1.454.CMB.1.raw
  modified_base (203)..(203): a, c, t, g, unknown or other
  misc_feature (203)..(203): n is a, c, g, or t
  modified_base (346)..(346): a, c, t, g, unknown or other
  misc_feature (346)..(346): n is a, c, g, or t
  modified_base (390)..(390): a, c, t, g, unknown or other
  misc_feature (390)..(390): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctaggtaccaacagaaacctggccaggcctccaggctcctcatccatgatgcactccaagcggtccctggccgtcccagacctagggttccgnggcaggtcgggtctgggacaggtacgttcacgtctacgaccgtnacgcacggtcctgggacgccgtgactggttattttcgactagttttactcgtgtacagctagtcccgttccgcctaccggcccgtcttccgtaccggtttccgggggaccgggggtaccgaggggtaggacggacgtcgggaacgtaacggtaacgttgggcggccttcggaccctaccgtagttccgttagttcccttcgtaccgtttcccccgg

SEQ ID NO: 111534 - DNA, 582 bp, Homo sapiens
  misc_feature: GYAE6OF01ECOMQ.45.36.D03.1.454.CMB.1.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
  modified_base (576)..(576): a, c, t, g, unknown or other
  misc_feature (576)..(576): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctccaggctcctcatccatgatgcatccaacgngggtccctggcctccagacgtaggttccgnggcaggtcgggtctggggaccaggtacgttcacttcgtacaccgtcaagccacgtccgtgggacgtccttggattggttacgttttcgcttaagttttacctttgttcgtacgtagctacggtccgttccgcccacgtcccgtctccgtacggtttccggggccgggggtaccgaggggtggagtagtaggaacgacgtaacgtggtcggctagccacgtctcgttactcttcnctcccg

SEQ ID NO: 111535 - DNA, 586 bp, Homo sapiens
  misc_feature: GYAE6OF01EPOZS.45.36.D03.1.454.CMB.1.raw
  modified_base (345)..(345): a, c, t, g, unknown or other
  misc_feature (345)..(345): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacacgaaacctggccaggcctccgagctcctcatccatgatgcatccaacgcggtccctggcctaccagacgtacggttccgnggcgaggtcgggtctgggacagtcgttcactctcaccgtcagcagccctgacgcctagatgtatttgacttagtttctntgtcngcgtagtccgtccacgcgtcccgctcgtacggtttccgggggacggggtaccaggggtcgaagtcgtacggaacggtaaccgtacggtgggtacggccgttacgacccgtaaccgttcgttacttcccggtttactttcccgccgtttaccccccgg

SEQ ID NO: 111536 - DNA, 692 bp, Homo sapiens
  misc_feature: GYAE6OF01AGX77.45.36.D03.1.454.CMB.1.raw
tcagacgcgatcgacacgaccggtgctcgatttagctgcgtcacgatctctcgttgggggaggaactgctcagttaggacccagagggaaccatggaagccccagctcagcttctcttcctcctgctactctggctcccagataccacggaaaattgtgtgacacagtctccaggcaccctgtctctgtctccgaggggacacacgcccaccctctccgtgcgacgggccaggtacggagtgtacagttaagtacgttaggctacggtaaccaacgacgaaaccgtggccaaggcctacccgaggtcctacctacatcccatcgatcgacactccgaacgtcgggtccctgggaccgtaccgagtaccgtacgggttccgtggaccgtagggttcgggtacgtacggggaactacggtacgttccgaactccgtacgaaccggtcaacgtcgacgtccgtggacgtccgtagacttgttaacttttcggactttacggtttactcgtacgtccagtccgtcggtcccgttcccgaccgtaccgcccgttacgttacccggtacggggtttccggggggacggggtaaccggtaggggacggtacgaggttacggaacggtaccggttaggtcgggttacggccgttacggacctaccgtagttccgttcgttccctcgttaccgttccccgg

SEQ ID NO: 111537 - DNA, 572 bp, Homo sapiens
  misc_feature: GYAE6OF01DRPGM.45.36.D03.1.454.CMB.1.raw
  modified_base (279)..(279): a, c, t, g, unknown or other
  misc_feature (279)..(279): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggagtcggggggagcgttgtccagccgtgggagtccctgagctctcctgtgcagcctctggattctccctntagttaactttggtttccacgttggggtcccgcctaggttcccagggcgaaggggctgggagtgggtggccctnattccgaagntggaagtgagaggctactcagactcgtgaaggccgnttccaccatctccagacgaacaattaccaagtaactgttacctcttttacgactaaagttgtaatagacctgaagtaggttagaggtacacgttctgtcttatttcgtgtgccgagggggactatacgttatggtagttcgttggtttacgtaggttagtaagtcgtaaaccc

SEQ ID NO: 111538 - DNA, 729 bp, Homo sapiens
  misc_feature: GYAE6OF01EDY9U.45.36.D03.1.454.CMB.1.raw
  modified_base (423)..(423): a, c, t, g, unknown or other
  misc_feature (423)..(423): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggcccccagataccaccggaaaaattgtgttgacacagtctccaggcaccctgtctctgtctccgaggggagacacgccaccctctcctgcagggccaggtaggagtgtacagtaagtacgttaggctaggtaaccaacaacgaaacctggaccaggcctccgaggcctcctcactccatgatcgactactacccaacgtacgggtccctgggcccgtacccgagacgtacgggttccgtggaccgtaggtcgggtcgtaggggacagtacgttcacgtcctacgaccgtnacgcgtacgccgtaggacgtccgtagtagtagttactttcgtacgttagttttacttcgttcggttactacggtaccgtacgtccggtttacccgccgacccgtccgtaccgttaccggtaccgggttttacccgggggacccgggggggttaccggtacgggggtacgggtacggtaacggttacgggtaaccgggaacgggttacggtacggggttcgggtaccgttccgggaacccgtaacccggttacgttaccggtttaccggtttacccgtttacgttccccgtttcccgttacccccgg

SEQ ID NO: 111539 - DNA, 683 bp, Homo sapiens
  misc_feature: GYAE6OF01D45FO.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctccaggcaccctgtctctgtctccgagggganacacgccaccctctcctgcagggccagtaggagtgtcagtaagtacttaggctaggtaaccaacaacgaaaccgtggccagggcctccgaggcctcctcactccatgatcgcactaccaacgcgggtccctggaccgtacccgagacgtacggttccgaggtcgtaggttggggtcgtaggggacaggtacgtttccacgttcctaccgaccggtcacggacacgtccgtagggaccgtccgtgtacgttggttattttcggactttacggttttacctttcgtcgttacgacgtccgtaacggtcccgttacccgcccgacccgtcccgtccgttacccgtaccgggtttccggggggaccggggggtacccggtagggggtggaacggtagtacgggaacggtacggtaacggttgggtacggtccgtaccggacctaacccgtcgttaccgttgtttacccttcgtccgttacccccg

SEQ ID NO: 111540 - DNA, 596 bp, Homo sapiens
  misc_feature: GYAE6OF01ECIGI.45.36.D03.1.454.CMB.1.raw
  modified_base (347)..(347): a, c, t, g, unknown or other
  misc_feature (347)..(347): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctccaggcctcctcatccatgatgcatccaacgcgggtccctggcctcccagaccgtaggttccgnggctaggtcgggtctggggactaggtacgttcactccgtcaccgtcagcagccgtggacgcctgacttgtatttgcttagtttcttcgtgtctacgtctacgtccgttccgccgaccgcccgtcctccgtacggtttcccggggaccggggggtaccgaggggtacgggacggtagtacggaacggtaccggtaacggttggtcggcgtcgaccgtaaccgtcgtcgttagttcctttcgcgttccccg

SEQ ID NO: 111541 - DNA, 788 bp, Homo sapiens
  misc_feature: GYAE6OF01EDFMQ.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggcctcccagataccaaccggaaaattgtgttgacacagtctccaggcaccctgtctctgtctccgaggggacacacgccaccctcctcctgccgacgggccaggtaggagttgtacgaagttaacgtacgttaggcttacgggtaaccaaacgtacggaaaccctgggacccaacgggtccctacccgaagggtcccttcctactaactacccaatcggaacttcgaccaactaccccgaaacgtccggggttcccctcgggcccgtaaccccgaggaccggtacgggtttcccgaggccgtaggggtcgggtacgtacggggacctagggtaccgtttccgaccgttcccgtaccggtacccgtcgaacggtccgacggtccgtcgggacgttccgtagtacgttggttaacttttcggactttaacggttttacccttcgtttacggttaccgacgttaccgaccggtttaccccgggtttccccgacccgtcccgggtacccctcccgttccgggttaacccgggttttccggggggaccgggggtacccgtagggggtacgtaaggtacgttacgggaacgtaccggtacgtggggtacccgtcggtaccggctaaccgttcgtcggttattacccttcaccggtttccccg

SEQ ID NO: 111542 - DNA, 749 bp, Homo sapiens
  misc_feature: GYAE6OF01DYMQ0.45.36.D03.1.454.CMB.1.raw
  modified_base (202)..(202): a, c, t, g, unknown or other
  misc_feature (202)..(202): n is a, c, g, or t
  modified_base (348)..(348): a, c, t, g, unknown or other
  misc_feature (348)..(348): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctccaggctcctcatccatgatcgcactccaacgcgggtccctgggcctcccgagactacgggttccgnggcgtaggtcgggtcgtacggggatacgggtaacggttcctaaccgttccgtacccgacccggttcgaaccggtcccgaacggtcccgtagggaccggtcccgttgggtaacgttggttaacgtttttcggaccgtttaacggttttaccctttacgttcgttaccgtaggtacccgtacggttcccggtttccccgacccgtacccgtcccggtacccgtaccgttaccgggttttacccggggggacccgggggggaacgttacggggggtacgggtaacggtacgggtacgggtaaacggtaacccggtaacggttaggggttccgggtccgtaccgggtaccgacccgttaacgttccggttaccgtttacccggtttacgtcccgtttacccccgg

SEQ ID NO: 111543 - DNA, 825 bp, Homo sapiens
  misc_feature: GYAE6OF01APLRL.45.36.D03.1.454.CMB.1.raw
  modified_base (267)..(267): a, c, t, g, unknown or other
  misc_feature (267)..(267): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacacgccaccctctcctgcgacgggccaggtaggagtgtcagtaagtactaggctaggtaccaanacgaaaccgtggaccagcctacccaggcctcctcacttccagtgatcgacctactacccgaacgaccgggttaccctcgggcccgttaccccgaacggtaaccggtaccggggtttcccggtacggggaccgtagggggttacggggttccggtacgggggaacctacgggtaacggtttcccaacccgtttcccgtacccggtaacccggttaccgaacggtcccgaaccgggtcccggttacggggaccgtcccggttaggtaacgtttcggtttaacgtttttccggtaaccgtttaacggttttttaacctttcggtttacggttaccgtacggtaccgttacggttccccggtttaccccgacccggtacccggtccccggttaccgttacccgggttaccccggggtttttccgggggggaaccccggggggttaaccggtacggggggttacgggaacggtaccggtagggaaccgggtaaccggtacgggtcggtaccggtcgtcggtacccgacttacgttcgttacgttcccttcgccgtttaccccg

SEQ ID NO: 111544 - DNA, 527 bp, Homo sapiens
  misc_feature: GYAE6OF01A339N.45.36.D03.1.454.CMB.1.raw
  modified_base (341)..(341): a, c, t, g, unknown or other
  misc_feature (341)..(341): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatcgatgcatccaacagggtccctggctcccagaccaggttccgnggcaggtgggtctgggacaggagttcactctcaccgtcagcagcctggagcctgatgatttgctagtttacttctgtcagcagtcgttccgcacgccgctcgtaccgtttccgggcgggggaccgagggtcggagagtggacgacgaacgtggtaggctcgcacgtactctgttcttcgtattccg

SEQ ID NO: 111545 - DNA, 728 bp, Homo sapiens
  misc_feature: GYAE6OF01AB2QL.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgccaccctctcctgcgagggccaggtaggagtcgtacaggtaagtacgttaggctacggtaaccaacgagaaaccgtggaccaaggtcctcccgaaggtcctaccgtacactcccagtacgatcgaccactacccgaacgtacgggtccctgggtcccgtacccgaggtaccgtacgggttcccgtaggaccgtacgggttcgggtcgacggggactagggtacgttctaacgttccgtaccgtacccgtcgacggtcctaacggccgtagggacctccgtgtaacgttcggttaattttcggactttacggtttaccgttacgtcggttaccgacgttccgtacggttccccggttacccgcccgtacggtcccctacggtccggttaacccggggtttcgggggacccgggggtaactggggggtacctaggtacggtaccgggaaggtaccggtggtacggttcgggcgtaccgaccgtacgttcgttaccgttagttcccttcgtcctttacccccgg

SEQ ID NO: 111546 - DNA, 539 bp, Homo sapiens
  misc_feature: GYAE6OF01B7BX8.45.36.D03.1.454.CMB.1.raw
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctcctcatccatgatgcatccaangggtccctggccgtcccagacagggttccgnggcaggtgggtctggggacagagttcacgtctcaccgtcagcagctggagctgatgtattttgctagtttacttcgtgtcagcagcgttccgccgtaccgccgctccgtaccgtttcgggccgggggaccgaggggtcggaggtagtggaggacgtaacgtggtcggctcgacaccgtatcgtagtccttcagttcccg

SEQ ID NO: 111547 - DNA, 728 bp, Homo sapiens
  misc_feature: GYAE6OF01AYMMC.45.36.D03.1.454.CMB.1.raw
  modified_base (363)..(363): a, c, t, g, unknown or other
  misc_feature (363)..(363): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccaggtaggagtgtacagtaagtactaggctggtaaccaacgagaaacctggccaggcctccgaggctcctcatccatgatgcactccaacgtacgggtccctggccgttccccgagtaccgtacgggtttcccggngggacgtagggttcgggtacgtgggggaacagggtacgtttccaccgttcctccgtaaccgtcaacggcgtaacgcccgtgggaccgtccgtaggtacttggtaacgtttttggaccgtttaaggtttttacctttcggttacgtaccgtaggtccgtacggttcccggtttccccgcccgtacccgggtcccgttaccgttaccggttaccgggtttcccgggggacccgggggggtacctacggggggttcggaacgggtacgtacggggtaacggtaaccggtaaccggttgggtccgggtacgtccggacccgttaccgtacgtttccgttggtttaccctttccgtacgttttcccccgg

SEQ ID NO: 111548 - DNA, 708 bp, Homo sapiens
  misc_feature: GYAE6OF01CNH5E.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggcctccaggcctcctcatccatgatgacctatacccaacgtacgggtcccctgggcccgtacccgaaggaccgtacgggttcccgtgggcgtagggtcggggtcgtacggggaactaggtacgttccaacgtccgtaccgaccggtacgacggtccacggtcccgtgggacgccgttagacgttgttagttttcgacgttacgttttaccttcgttcgtcctacggtccgacggttcccgttaccgcccgtaccggtcccgtccgttacccggttaccgggtttccggggggacccgggggggtaaccgtacggggggttacggtacggtacggttacgggaacggtaacccggtaacggttgggtacggtccgtacggacccttaacccgtagttcccgttacgtttaccttccgtacgtttcccccgg

SEQ ID NO: 111549 - DNA, 558 bp, Homo sapiens
  misc_feature: GYAE6OF01C06XS.45.36.D03.1.454.CMB.1.raw
  modified_base (201)..(201): a, c, t, g, unknown or other
  misc_feature (201)..(201): n is a, c, g, or t
  modified_base (544)..(544): a, c, t, g, unknown or other
  misc_feature (544)..(544): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagagacctcggagaaattgtcttgacacagtctccagccattctgtctctctctccagggganacagccacctctcatgcagggccagtcagagtattagaacatacttggcctggtatacaatacaagcctggccacggggtccccggctcctcatctatgatcgtcttccagcgacgggccacgtcggcactcccagcctaggttcaggtcggtcgggtggggtttcgctacgagtacttcgacttctacacactcagcacgcctaccaaccgtgaacgtattttcgctacgttcttaacttctgtacaacgagtacgtactagtacttcggcctctacgtacgttcgggacggacgggtaacgtaagggtggaacgtaacgtacgaaacgtacgtggtacggngtcgctaacgtacg

SEQ ID NO: 111550 - DNA, 616 bp, Homo sapiens
  misc_feature: GYAE6OF01BVIP3.45.36.D03.1.454.CMB.1.raw
  modified_base (202)..(202): a, c, t, g, unknown or other
  misc_feature (202)..(202): n is a, c, g, or t
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
  modified_base (388)..(388): a, c, t, g, unknown or other
  misc_feature (388)..(388): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggcctcctcactcccatgactcgcactccaacgacgggtcccnggccgtcccagtaccaggttccgnggcgaggtgggtctgggacaggtagttcacgttccncgtaccgtcagcagtcctgggactcctagattagttagtttcgacttagttttactcgtgtcagctacggtccgttcccgacgtaccgtcccgtcgttccgtaccgggtttccgggggaccgggggtaccgagggggtaggaacgtggtacggaacggtacccggtagttcgggtacggtccttcgggacctaccgtcttacgtggttacccttcgacgtttcccccg

SEQ ID NO: 111551 - DNA, 621 bp, Homo sapiens
  misc_feature: GYAE6OF01E0UKL.45.36.D03.1.454.CMB.1.raw
  modified_base (293)..(293): a, c, t, g, unknown or other
  misc_feature (293)..(293): n is a, c, g, or t
  modified_base (489)..(489): a, c, t, g, unknown or other
  misc_feature (489)..(489): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtcctccaggggagacagcccaccctctcctgcagggccagtacggagtgtcagtaagtacttaggctggtaccaacagaacctggccaggctcccaggcctccncatccatgatgcatcccaacgtacggggtccctgggcccgtacccaggacctagggttcccgtagggcctagggttcggggtctaggggactagcgttcacttcctccgacgtcagcacgcctagggactccgtgtattgtattttcgcttacgttttactctcgtacagtctacgtccgtccgcctaccggtccnctcgtccggttccgggcgggggtaccgtaggggtcggaagtgtgggaacgtaccggaacgttgggtacggtccttaccggaccgtacccgtaacgttccgttacgtttcccgtttcgtaacccgtttccccg

SEQ ID NO: 111552 - DNA, 774 bp, Homo sapiens
  misc_feature: GYAE6OF01EMLI7.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgccaccctctcctgcgagggccagtaggagtgtcagtaagtacgttaggctaggtaaccaacagaaaccgtggaccaggcctcccgaggtcctcctcactccatgatgacataccaacgtcgggtccctgggccgtacccgagtaccgtacggttccggaggcgtagggttcggggtcgttaggggaacctaggtacggtttccaaccgttccgtaccgtacccgttcaacggccgtaacggtcccgttacgggaccgtacccgttggtaacgtttcggttaacgtttttcggaacctttaacgggtttttttacccttccggtttacggttacctaacgggtaccgttaaccggttccccggtttaccccgaccccgtacccggtccccggtacctttacccggggttaacccgggttttcccgggggggacccggggggtaaccggtagggggttacgggaaggtacggttacgggaaacggttaccggtaaacggttggggaccggtcgtacgacccgtaaccgtagtttccgttaggttaccctttcgtccgtttacccccgg

SEQ ID NO: 111553 - DNA, 596 bp, Homo sapiens
  misc_feature: GYAE6OF01DDK13.45.36.D03.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (348)..(348): a, c, t, g, unknown or other
  misc_feature (348)..(348): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactgtggctcccagatacctctggagaaatagtgatgacgcagtctccagccaccctgtctctgtctccaggggaaanacgccacctctcctgcctgggccagtaggagtgtcagtaagtactaggctgtaccaacagaacctgccaggcctcccagcctcctnatccatgatgcactccaacgacgggtcccctgggcctcccgaagacgtacggttcccgnggctaggtcggggtctacggggactaggacgtttcaactcctaccgacccgtcacgaccacggcccgtgggacgccctgaagttgtatttcgcttagttttactcgtgtcagctacgtccgttccgcctaccgcccgtctcgtaccgtttcggggccgggggacgtaggggtgaacggtgtacggaacggaccggtaaggttcgggcgggtactcggaccaccgtagtttccgttcgtcctttacccg

SEQ ID NO: 111554 - DNA, 735 bp, Homo sapiens
  misc_feature: GYAE6OF01CS729.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgtgacacagtctccaggcacctgtctctgtctccgaggggagacagcccaccctctcctggccagggccaggtaggagtcgtacagtaagtacttaggctaggtaccaacagaaacctggccaggcctccgaggcctcctcactccagtcgatgccaactcccgaaacggtacgggtcccctggggccgtaccccaaggaccgtacggggttcccgtaggggtacccgtaagggttcggggttctacgggggaacctaggtaacggtttcctaaccgttccgttaccgaccccggtactaacggccgtaacgtcccggttagggaaccgtcccgtttaggaacgtttggttacgtttttcggacgttacgttttactacgtttcgtacgacgtaccgtacgcccgtttcccgtaccgaccgtcccgaccgttaccgtaccggttttccgggggaccgggggttacccggacggggttacgggacggtacggtacggtacgggaaccggtaacgtcgggttacggccgtacggaccctacgaacgtttcgtcggtttacttccgtacgtttcccccgg

SEQ ID NO: 111555 - DNA, 762 bp, Homo sapiens
  misc_feature: GYAE6OF01DKN94.45.36.D03.1.454.CMB.1.raw
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (284)..(284): a, c, t, g, unknown or other
  misc_feature (284)..(284): n is a, c, g, or t
  modified_base (453)..(453): a, c, t, g, unknown or other
  misc_feature (453)..(453): n is a, c, g, or t
tcagacgcgatcgacacgaccggtgctcgatttagctgcgtcacgatctctcgttgggggaggaactgctcagttaggacccagagggaaccatggaagccccagctcagcttctcttcctcctgctactctggctcccagataccaaccggaaaaattgtgttgacacagtctccaggccaccctgtctctgtctccgagggganacncgcccaccctctcctgcgagggccaggtaggagtgtcagtaagtacgtaggctaggtaaccaacgacgtaaaccnggccaggtcctacccgagcctcctcactccatgactgcactaccgaacgtacgggtcccttcgggcccgtacccgaagtaccgtacggggttcccgtgggaccgtaggggttcggggtacgttacggggaactaggtacgtttacgaacccgttctcccgaacccggtnacggtacgtaccggtccggtacgggaccgtccgttggaatttgggttacttttacggtacgtttacgttttaccgtttcgtacggtttaccgaacggtcgtaacccgggttcccgttacccgggaccctacccggtcccggttacccttacggttaccccggggtttcgggggggacccgggggtacccgtaggggggtacgaacggttacgtgggaaccggtaacgggtacgttacggggtcggtccacgggtaacccctaccgttaacgtttccgttagttacctttacccgccgttttacccccgg

SEQ ID NO: 111556 - DNA, 848 bp, Homo sapiens
  misc_feature: GYAE6OF01BALQ7.45.36.D03.1.454.CMB.1.raw
  modified_base (202)..(202): a, c, t, g, unknown or other
  misc_feature (202)..(202): n is a, c, g, or t
  modified_base (821)..(821): a, c, t, g, unknown or other
  misc_feature (821)..(821): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtagttgacacagtctccaggcaccctgtctctgtctccgaggganacacgccaccctctctgcgacggctaggtacggagtcgtactaggttaacgttacgtacggtcgtacgggtaaccaaacgaaccggtaaaccgtcggaccgaacgggtcccctaccggacggtccttaccccttacaaccttacccaaggttacggaacgttcggaacctaaccgtaacccggaacgggttacccggggttcccgacgggtaccccgttaccccgaacggttaaccgggttccgggtttacccgggtacggtacggtaggggttcgggtacggtacgggacctacgggtacgttacctaccgttcccgtaccctaccggtacacggtaccgtacggtcccggtaggtaccgtccgtagtacgttaggtttacgtttacgtacgttttaaccgttttcgtccgtacggtataccgggtacgtaccgggttcccgttaacccggccctacccgggtaccccgttcccgtaccgggtttacccgggggtttaccgggggacccgggggttacgacggggggttacggacgtaccggttaggggaaacccgttacggaaggggttgtaccgggcggttaccgaaccgtacccgttaacttcccgggttttaancccgttttcccacgggttttccccccc

SEQ ID NO: 111557 - DNA, 733 bp, Homo sapiens
  misc_feature: GYAE6OF01B4O57.45.36.D03.1.454.CMB.1.raw
  modified_base (203)..(203): a, c, t, g, unknown or other
  misc_feature (203)..(203): n is a, c, g, or t
  modified_base (559)..(559): a, c, t, g, unknown or other
  misc_feature (559)..(559): n is a, c, g, or t
  modified_base (715)..(715): a, c, t, g, unknown or other
  misc_feature (715)..(715): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgcagggccagtaggagtgtacagtaagtacgttaggctaggtaaccaaacaacggaaaccgtgggacccagggcctcccgaggcctcctcactccatgactcgacactacccgaacggtcggggtcccctgggacccgtacccgacggaccgtacgggttcccgtgggactagggtcggggtcgtacggggaactaggtacgttccacgttcctccgtaccggtccaggcctaggtcccgtagggacctcctaggtagttcgttattttcggtacttacgttttaccttcgtagtccaggcctaccgggttccggttcccccacgacccgggttcccncgttacccgggttacccggggtttccgggggggacccgggggtaaccgttaggggggcgttaaggacgttcggggaaccgtaaccgggtaacggttcgggtacgggtcccttacgggaccccttaccgtacgtttcccgttagtttccccgtttanaacccgttttcccccggg

SEQ ID NO: 111558 - DNA, 686 bp, Homo sapiens
  misc_feature: GYAE6OF01CEDJN.45.36.D03.1.454.CMB.1.raw
  modified_base (203)..(203): a, c, t, g, unknown or other
  misc_feature (203)..(203): n is a, c, g, or t
  modified_base (368)..(368): a, c, t, g, unknown or other
  misc_feature (368)..(368): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtactaggctggtaccaacagaaacctggccaggcctccgaggcctcctacatccagtcgatcgactactacccgaacgtacgggtcccctaggtcccgtacccaggtaccgtacgggttccgnggcgtaggtcgggtacgagggactaggtacgttacacgttccacgaccgtcacgcgacgccgtggaccgtccgtagtacgttagttatttcgtacgtttacgttttacttcgttacgtcgtacgtccgtacggtcccgttcccgaccgtacccggtccgtaccgttccggtaccgggttttccgggggacccgggggtaccggtagggggtcggtaacggtagggtacggaacgggtaccggtaacggttcgggtacggtcgtccggtaacccaccggttacgttcccgttagtttcccttcgttccgtttacccccg

SEQ ID NO: 111559 - DNA, 591 bp, Homo sapiens
  misc_feature: GYAE6OF01AT4B7.45.36.D03.1.454.CMB.1.raw
  modified_base (347)..(347): a, c, t, g, unknown or other
  misc_feature (347)..(347): n is a, c, g, or t
  modified_base (380)..(380): a, c, t, g, unknown or other
  misc_feature (380)..(380): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggcttggtaccaagagaaacctggaccaggcctccgaggcctcctacatccatgatgcatccaacgcgggtccctggcctcccagccaggttccgnggctaggtgggtctcgggacagtgttcacttcncacgtcagcagcgtgacgcctgactgtatttcgcttagtttacttcgtgtcagctacgtcgtccgccaccgcccgtccttaccgtaccggtttccgggaccgggggtaccgtaggggtcggaggtcgtacggtaacggaccggtaacgtcgggtacggtcgttacggacccgtaccgtacgttccgttacgtccttaccgtacgttccccg

SEQ ID NO: 111560 - DNA, 869 bp, Homo sapiens
  misc_feature: GYAE6OF01E0UB6.45.36.D03.1.454.CMB.1.raw
tcagacgcgatcgacacgaccggtgctcgatttagctgcgtcacgatctctcttggggagctctgggagacgagcccagcactggaagtcgccggtgttccttcggtgatcatcactgaacacagaggactcaccatggactttgggctgacctgggttttcctcgttgctctttaagaggtgtccagtgtcaggtgcaggtggtggagtcggggggagcgttgtccagccgtgggaggtccctgagactctcctgtgcagcctctggacttcctccctactaaggttaaccttttcgggtttccccacgttcgggggtccccgccgtagggtttcccgagggcgtaaaggggggctggggagggttcggggtcgggcccccttagtacgttttacccggaaaggtagtagggaaacgttgggaacggaaacgggtccccttaacgttccgaacggtaccgttaccccgggtagggtaaaccgggggcccctacgtttacccgaacccgtaacgtcccgtaccccgaaggaacggtaacctaaacgtttaacccgtaaaggtaaaactttcggtttaccccgtttacgttttttacgtaaccgtaaaagttaacgtaaacgttaacggtacccgttaggtaaacggtaacgggtttaaggaacggggtaaaccgttaaccggtttaccgtttacggttaccgttttaaacgttttccggtttacggttaccgggtaacccgggttaaacggggggggtaaccgttaacggtttaccggttaaggttacgggtaacgggtttacccggtttacggggttttaccggttaaagggtttacggtttaaaacgttaacccgttaaaaaccccg

SEQ ID NO: 111561 - DNA, 713 bp, Homo sapiens
  misc_feature: GYAE6OF01EQP3D.45.36.D03.1.454.CMB.1.raw
  modified_base (468)..(468): a, c, t, g, unknown or other
  misc_feature (468)..(468): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcgaggtggtggaggtcggggggagtcgttgtccgagccgtgggacggtccctgagactctcctgtgcagcctctggacttctccctcagttaacttttcggtttccacgtgggtcccgccgaggtttcccagggccgaagggggccttggggacggttggggtcggccccttacgtacgttttacccggaaaggtagtacgggaaaggttggaacggtaacggtcccttaacgtcgaacggtacctcccggtaggaaacggggtcccncgtttaccaaccgatcctaccaagacgaactaaacttaccgaaagtaacgttcgttacccttcgtttttacgactaaatacgtaaactacgaccgttagtaaggtaggttaggaacgggtacctacggttacttacggttactttacgttttcgtacggttcggtacccggtaagggggtacctagttaccttagtcggtagttacgttcggttacggttaggttagttaacgtcttaaaacccg

SEQ ID NO: 111562 - DNA, 622 bp, Homo sapiens
  misc_feature: GYAE6OF01DZ0VI.45.36.D03.1.454.CMB.1.raw
  modified_base (298)..(298): a, c, t, g, unknown or other
  misc_feature (298)..(298): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccagcaccctgtctctgtctccgaggggagacagcccaccctctcctgcgaggccagtaggagtgtcagtaagtacgttaggctaggtaaccaacacgaaacctggaccaggcctcccgaggctcncatccatgatgcactcccaacgtcggtccctggccgtacccaggacgtacggttccggtggacgtagggtgggtcctagggggactaggaacgtttccaacttccgtacaccggtcagccgacgccgtggacgcctagattgtaatttcggcttaggttttctcgttgctagcacggtcgttcccgccgcgtcccgcttacccgtacggttccgggggaccggggtaccgaggggtcggagtagtacggaagaccggtaacgtgggttacggcttacggacctaccggtaacttcggtttacctccgtttcctaacgttccccg

SEQ ID NO: 111563 - DNA, 581 bp, Homo sapiens
  misc_feature: GYAE6OF01ELD25.45.36.D03.1.454.CMB.1.raw
  modified_base (240)..(240): a, c, t, g, unknown or other
  misc_feature (240)..(240): n is a, c, g, or t
  modified_base (362)..(362): a, c, t, g, unknown or other
  misc_feature (362)..(362): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
  modified_base (559)..(559): a, c, t, g, unknown or other
  misc_feature (559)..(559): n is a, c, g, or t
  modified_base (565)..(565): a, c, t, g, unknown or other
  misc_feature (565)..(565): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaccggaaaaattgtgttgacacagtctccaggccaccctgtctctgtctccgaggggagacacgcccaccctctcctgcgagggccaggtaggngtgtcagtaagtacgtaggctggtaccaacagaaaccgtggccaggcctcccaggcctcctcactccatgatgcactccaacgtacgggtccctggccgtcccagaccgtacgggttcccgnggctagggtgggtctgggacagtacgttcacgttcctcaccgtcacgcacgtcctggacgcgtgattgtagttttgcttagtttctctcgtcngtcncgtccgttcccgcgaccgccgtctccgtcggttccggggcggggtaccgnggggtggagngtcgaacggtacggtacgtgggcggtcgcggaccaccgtnttcgtnttcttcgcgttccccg

SEQ ID NO: 111564 - DNA, 232 bp, Homo sapiens
  misc_feature: GYAE6OF01ES7LR.45.36.D03.1.454.CMB.1.raw
  modified_base (229)..(232): a, c, t, g, unknown or other
  misc_feature (229)..(232): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggagtgtgtcacaagtatttgggctcgtgggcacagcggccctgggctgcctggtcaaggactacttcctcgatcgcgtctgagcgggctggcaaggcgcatagnnnn

SEQ ID NO: 111565 - DNA, 587 bp, Homo sapiens
  misc_feature: GYAE6OF01E3GIX.45.36.D03.1.454.CMB.1.raw
  modified_base (346)..(346): a, c, t, g, unknown or other
  misc_feature (346)..(346): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaacagaaacctggccaggctcccaggcctcctcatccatgatgcatccaacgcgggtccctggcctcccagaccgaggttccgnggcaggttgggtctgggacaggtacgttcactctcaccgtcagcagcctggacgcctgatgtatttgcttagtttacttcgtgtcagtcacgtccgttcccgccaccgtccgctccgtaccggtttccggggaccgggggtacccgaggggtcggaggtagtacggaacggtaccggtacgttgggtcgggccttcggaccctacccgtagttcccgttagttcctttccgacgttccccg

SEQ ID NO: 111566 - DNA, 1018 bp, Homo sapiens
  misc_feature: GYAE6OF01DFPIL.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcgttgggggggaggaactgctcagttaggacccagagggaaccatggaagccccagctcagcttctcttcctcctgctactctggctccagataccacggaaaattgtgttgacacagtctccaggcaccctgtctctgtctccgagggganacagcccaccctctcctgcgacgggccaggtaggagtgtacaggtaagttacgttaggctacggtaaccaacgaacgtaaaccgtggacccaggtcctacccgaggtcctcctacgacttccagtcggaacttcggacctaacgttacccgaaaccgtccggggttcccctacgggtacccgttaccccgaaggttaacccggtacggggtttaccccggtggggtacccgttagggggttcggggttacccgttacggggggaaccttaaacggggttaaccgtttaccgtacccgtttacccggtacccgttaaacccccggttcgaaaccgggtcccgtaaccggggttccccggttaagggggtaccccgttaaccccgggtttgggtaaaaccgtttttcggggttttaaaccgtttttttcggggaacccgtttttaaaccgggttttttttaacccgtttccggtttacgggttaacccgtaccgggtaaccccggtttaacgggtttccccccccgggtttaccccggaccccgttaacccccgggttaccccgggtttacccgttttaccccggggtttaacccgggggggttttcccggggggggaaaccccgggggggggttaacccggttaaggggggttacgggaaaccgtaacggtttaccggggaaaaccgggtttacccggtaaacggggtttcgggtaccgggggttaacccacccggggtaacccttaaccccggtttagtttaccccgggtttttaccggttcccctttaaccggtttccccggttaacccccccg

SEQ ID NO: 111567 - DNA, 658 bp, Homo sapiens
  misc_feature: GYAE6OF01D6MKS.45.36.D03.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcaggccagtaggagtgtcagtaagtacgttaggctggtacaacaagtaaaccgtggccaggcctccgaggccttccncactccatgatcgcatccaagtcgggtcctcggctccagacgtacggttccgtggctagggtcggtcgtaggacacggtacgttcaccgtcctacgaccgtacgacggtccacggtccgtagggtacgcccgtaggtactttaggttagtttttcggtaccttaaggtttttaccttcgttcggttactacggtcctaacggttcccgtaccggccgtaacccggtcccgtccgtacccggttacggggtttcccggggaccggggggtaccctagggggtaccggaagtacggtaggacggtaaccgacgtggtagggctacgacctacccgtatcccgttagttccttcgtaccttcccg

SEQ ID NO: 111568 - DNA, 829 bp, Homo sapiens
  misc_feature: GYAE6OF01C1NIF.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtactaggctaggtaaccaagagaaacctggaccaggcctcccgaggcctcctcactccatgatgcactccaacgtagggtccctacggccgtacccgaggtaccgtacgggtttcccgagggtcgtaagggttcggggttacgtcggggtaaccgaaggttaacggtttcctaacccggttcctaccgtaaaccccggtttcgaaacgggtcccgtaacgggtcccgttacgggggtaccgtaccccgtttagggtaaacggtttcggttttaacggttttttacggttaacccgtttaaagggtttttttaccctttacgtttaccgggttacctaacgggtccgtttaaccgggtcccggtttaccccggaccccgtaaccgggtccccgttacgttacccgggttaacccgggttttccgggggggacccgggggggttaacctagggggggtcggtaacgggtaacgtacggggtaaacggtaacccgggttaaggttgggttaccggggtctacccggaccgttaaccccgtagtttacccggttcggtttaacccttcccgttcccggtttaccccccg

SEQ ID NO: 111569 - DNA, 571 bp, Homo sapiens
  misc_feature: GYAE6OF01D9L1K.45.36.D03.1.454.CMB.1.raw
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagttaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctattctgtgccgaggggacatctatgagtctggttcgtagtgtaatctaactactactacctcatggacgtcgtggggacaaacgggacctcggtcgtaccgtctcccgcacgtccttccaccaacgggcccagtccggtccttcccccgtggcccgtcccctcgtcctacccgaggcgccaccgtccggg

SEQ ID NO: 111570 - DNA, 919 bp, Homo sapiens
  misc_feature: GYAE6OF01C6HTV.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggcaccctgtctctgtctccgaggggganacacgccaccctctcctgcagggccaggtaggagtgtacagtaagtacttaggctaggtaccaaacagaaacctggaccagggcctacccaggcctcctcaacttcccaagtgaacttgaccaactcccgaaacgtacgggtccccttagggcccgttaccccgaaggaccgtacgggtttcccggtaggaccgtagggttacggggttccgtagggggtaaccaagggttaacggtttcccaacgtttcccgtaccgtaacccggtacaacggtcccgaacgggtccccgttaggggacgtacccgttaggtaacgtttcggtttaagttttttacgggaccgtttaaacggtttttttacccttccgttaacgggttcccgtaaacggtcccggttaaacccgggtttcccgggttttaccccccgaaccccgtaaccccgggtcccccggttaacccgtttaccccgggtttaaaccccggggtttttaccccggggggggaacccgggggggggttaaacccccggttaaggggggggtttacccgggaaagggttaacccggtttaggggaaaacccggggtaaaccgggttaaaccgggtttcggggtaccggggttacccggttacggaacccccgttaaccgtaacggttttaccccgttacggggttttaccccttttaaaccggtacccgttttacccccccggg

SEQ ID NO: 111571 - DNA, 523 bp, Homo sapiens
  misc_feature: GYAE6OF01ANVYT.45.36.D03.1.454.CMB.1.raw
  modified_base (405)..(405): a, c, t, g, unknown or other
  misc_feature (405)..(405): n is a, c, g, or t
  modified_base (511)..(516): a, c, t, g, unknown or other
  misc_feature (511)..(516): n is a, c, g, or t
  modified_base (518)..(523): a, c, t, g, unknown or other
  misc_feature (518)..(523): n is a, c, g, or t
tcagacgcgatcgacacgaccggtgctcgatttagctgcgtcacgatctctcctgtgcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctggggcaaagggacctcggtcaccgtctccgcagcttccaccagggcccatcgtcctcccctggccgccctgcctccaggacncaccctcgtgggggccacgagccggccctgggcctgccctgggtcggacttaccgttcctcgatccggcgtccgtggcgccgggctcgggcaagggccgacagtgnnnnnncnnnnnn

SEQ ID NO: 111572 - DNA, 735 bp, Homo sapiens
  misc_feature: GYAE6OF01APLPJ.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatgcgagggccagtcagagtattagaacatacttggcctggtatacaatacaagccgtcggccgtacgggtccccgctcctctatctatgatcgccttcgagcgacgggccacgtcggcctacgtcccgagccgtagggttcagggtcgggtcgggttgggttcgcacgtagtaccttcgactctacaactaactcgacgacctacgtaccctaacccgtaaaccgttacggtaacgtttacgttttaggaccctttaacgttacctttaaacgtttaccgtaacggttaccaaaccgttaacgggtaacccgttaacgttaacggttaccggttaccgggtaccccgtaccgtttaacccggttaccggggttttacccggggaacccgggggttaaacgggggtaacccgggttaaaggggtacggggtaaaccggttaaacggttaaacccggaaaacggttaccggttacggggtaccgggtaaccgtacggtacccgtaacccgtttaacgg

SEQ ID NO: 111573 - DNA, 1007 bp, Homo sapiens
  misc_feature: GYAE6OF01BIIS4.45.36.D03.1.454.CMB.1.raw
tcagacgcgatcgacacgaccggtgctcgattttagctgcgtcacgagtctcgtcctcgtgcagtaactttaggtttccgacgtgggttcccgcctagggttccaggtcaaggggctggaggtagggtggccctcgatttcccgaagatgggaagttggagtaaggaccttacgttccagtactccgttagtaaaggggccggtcttccgacctattcctaccgagacgaacctaagtttcccgaaaggtaacgttcgggtaccgttccgttttttaggacctaaaagttcggtaaaggtaacggtccctaggaacggtaggtttacggacggtacccgtacggttcgttacggttaccttacttttccgttggttccggtaccccgtaaggggggactaacgtccgttaaggttcgaacggttcgttacgggttaccggttacgggttacgtaaacttaccgtaaaccgttaccggtaaccgttaaccgtacgtaggttcggggtacggttccggtacgggggtacgttaaaacggggtcccttaaccggggttccgtaacccgggttccggtaccccggtacgttacgggtacccctttaacccggtaaccggtaaacggggtcccctaacggttccccggggttacccgttttccccccccggtagggggaacccccgttcccccggttagtccccgttaacccggtaaccgggttaccggaccctaacccgggtaccggggttaaccgggggtaacccgtaaccgaacgggtaccccgggtaccggttaccggggtaccgtttacccgggtaccggtaccgggttaacgtaaaccggggtaacccgttttaaccccggttaccggttaacccggaccggggtacccggttacggttaccggtaccgggaccggggtacctacggggaaccggtaacgggtacgggaccggtaagtccgggaagccggttcacgtactaccgtgacgttgaggtcctacggtcg

SEQ ID NO: 111574 - DNA, 766 bp, Homo sapiens
  misc_feature: GYAE6OF01AOX51.45.36.D03.1.454.CMB.1.raw
  modified_base (199)..(199): a, c, t, g, unknown or other
  misc_feature (199)..(199): n is a, c, g, or t
  modified_base (690)..(690): a, c, t, g, unknown or other
  misc_feature (690)..(690): n is a, c, g, or t
  modified_base (743)..(743): a, c, t, g, unknown or other
  misc_feature (743)..(743): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccaggganacagccacctctcctgcgacgggccagtaggagtcgtcaggttaagtacgttaggcctagggtaacccaaacgacggtaaaacccgttgggacccaagggtcccttaccccgaaggggtccttaccccgtacctaacgttaccccaagtttcggaacttcggaccctaacgttacccccggaaaacgtacggggggttacccccctttgggaccccgttacccccgaacggtaaaccgtacgggggttttccccgtacggggaccgtaacggttcgggggttccgtaacggggtaaccgtagggtaacgttttccgaacccgtttccgtaccgtaacccgggtcaacggtcccgtaaggtcccgttagggacgtacccgttagaacgtttgtaacgttttcggacctaggttttacttacgttcggtactacgccgtagtccgttaccgtcgacgtcccacgttcgtaccggtttcgggcggggtaaccgngggttcggaacagttcggactaccggtacgtgtggccgttacgcgaaccgttntacgtgttcccttgccgttcccg

SEQ ID NO: 111575 - DNA, 651 bp, Homo sapiens
  misc_feature: GYAE6OF01DGTRO.45.36.D03.1.454.CMB.1.raw
  modified_base (424)..(424): a, c, t, g, unknown or other
  misc_feature (424)..(424): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacacgcccaccctctcctgcagggccagtaggagtgtcaagtaagtacttaggctaggtaaccaacgaagaaacctggacccaagggtcctacccgaggcctacctcacttccatcgatcgacactaccaaacgtcgggtcccctggccgtacccgaagaccgtagggttcccgagggctaggtggggtacctggggaacagtacgttcactctacaccgtnagcgagcctaggcaccgtgaacttggtattttcgacgttagttttactgttcgtaccaaggtccaagtcccgttccgccaacggtcccgtacttccgtacggttcggggccggggaaccgtggggtggtaagaagtggaacgtaaccggtaaacgttgggtacgggccttacgggtaccaaaccccgttgttacccgttggtttaaccctccgtacgtttacccccg

SEQ ID NO: 111576 - DNA, 779 bp, Homo sapiens
  misc_feature: GYAE6OF01BROYD.45.36.D03.1.454.CMB.1.raw
  modified_base (210)..(210): a, c, t, g, unknown or other
  misc_feature (210)..(210): n is a, c, g, or t
tcagacgcgatcgacacgaccggtgctcgatttagctgcgtcacgatctctcgttgggggaggaactgctcagttaggacccagagggaaccatggaagccccagctcagcttctccttcctcctgctactctcggcccccagactaccaaccggtaaaattgtgttgacacagtctccaggccaccctgtctctgtcctccgagggganacacgcccaccctcctcctgccgacgggccaggtaggagtgtactaagtaagtacgttaggcgtaggaaccaacgaacgaaacctggccaggcctcccgaggtcctcatccatccatgactcgacctactacccgaacgtccggggtcccctgggtacccgtcccgaacggtacgtaccgggttccggtaggcgtagggtcgggtaccgtaggggactaggtacgttccgaccttccgtaccgtaccgtcgacgccgtacggtccggtaggtaccgtacgttgagtttcggttaagttttcggaccgtttaacgttttccgttcggttagtaccgtacggtaccgttaccggttcccggttcccggaccctaaccggtaccccttaccggttaccggttaacccgggggtttcccggggggaacccggggggttaaccggtaggggggtaacggtaccgggtaacgtaaccggggtaacgtaaccgggttacggttacgggtccgggtccgtacggtaccctaccgttcgttaccgttaccggttactttacccggtaccgttaccccg

SEQ ID NO: 111577 - DNA, 550 bp, Homo sapiens
  misc_feature: GYAE6OF01D38NE.45.36.D03.1.454.CMB.1.raw
  modified_base (202)..(202): a, c, t, g, unknown or other
  misc_feature (202)..(202): n is a, c, g, or t
  modified_base (340)..(340): a, c, t, g, unknown or other
  misc_feature (340)..(340): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcagggccagtaggagtgtcagtaagtacttaggctggtaccaacagaaacctggccaggcctccaggctcctcatccatgatgcatccaagcggtccctggcctccagccgaggttccgnggcaggtggggtcctagggactaggtacgttccaacgttctaccgaccgtcagccacgccgtggacgcctgatgtatttgctagtcttattactgtacaactagcgtacagtagtcgccgtctcgtacgttcgggcggacgggaccgtagggtacgagacgtacgaaacgtatggtcgcgtagacctactacttctcgttcttcgtaccg

SEQ ID NO: 111578 - DNA, 646 bp, Homo sapiens
  misc_feature: GYAE6OF01DC070.45.36.D03.1.454.CMB.1.raw
  modified_base (202)..(202): a, c, t, g, unknown or other
  misc_feature (202)..(202): n is a, c, g, or t
  modified_base (346)..(346): a, c, t, g, unknown or other
  misc_feature (346)..(346): n is a, c, g, or t
  modified_base (613)..(613): a, c, t, g, unknown or other
  misc_feature (613)..(613): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggancagccaccctctcctgcagggccagtaggagtgtcagtaagtacttaggctaggtaaccaacagaaacctggccaggctccagctcctcactccatgatgcactccaacgcggtccctggccgtacccagaccgacggttccgnggcgtaggtcgggtactggggaactaggtacgttcacgtcctcgaccgtcagcgacgcccgtaggacgtccctggaattggttattttgaccgttaggttttaccttcgttcgtcacgtcgtacggtccgtttcccgacccgaccgtcccgtcttacccggttaccggtttccgggggacccgggggggtaaccctgggggtacgtaacgggtacgttacgggacggtaaccggtaaacgtgggtgggtcccgtggacccaaccgtnttacgtcggttaccttcgttaccgttacccccg

SEQ ID NO: 111579 - DNA, 710 bp, Homo sapiens
  misc_feature: GYAE6OF01C5H22.45.36.D03.1.454.CMB.1.raw
  modified_base (428)..(428): a, c, t, g, unknown or other
  misc_feature (428)..(428): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccaccctctcctgcgagggccaggtaggagtgtcagtaagtacgttaggctaggtaaccaacgaacgaaaacctggaccaacgggcctacccaggcctcctcactccagtgatcgcactacccgaacgtacgggtcccctgggtccgtacccgagacgtacgggttccgtaggcgtagggttcgggtcgtcggggacaggtacgtctacgtctcaccgtnacgcagccgtcgggcctgtagtgtattttcgcttagtttcttcgtgtccgagtctacggtccgttcccgccgtaccggtcccgtccgttaccgttaccgggtttccgggggaccggggggtacccgttaggggggtcgggaacggtaacggtacgggaacgggtaaccggtaaccggttcggggtaccggttaccgggttacggtaccccgttaacccgtacgtttcccggtttacgtttacccggttttaccctaaccgtttcccccgtttaaccccccgg

SEQ ID NO: 111580 - DNA, 748 bp, Homo sapiens
  misc_feature: GYAE6OF01ADBOD.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggagacagccaccctctcctgcagggccaggtaggagtgtcagtaagtacgttaggctaggtaccaacgagaaaccgtggaccacggcctcccaggtcctccctctacgtcccatgatcgacactaccgaacgccgggtaccctcgggcccgtacccgaaggtaccgtacgggttccgtcggcgtagggttcgggtacgtacggggactaggtacgttccgaacgttcctaccgtacccgtcgtacggaccgacggtcccgtgggaccgtccgttaggtaacgttgttaacgtttttggaccttttaacggttttcttcgttcggtaccgagtccgtaccgttcccggttccccgacccggtacccgtcccggtaccgttccccgtaccgggggttttacccggggaccggggggtaaccgtagggggtaacgggtacggtacgtacgggaacggaaccggttaaccggtgggttaccgggccgttaccggacccgtaaaccgttacgttacccgttacgtttcccgtttccgttaacccgtttcccccgg

SEQ ID NO: 111581 - DNA, 795 bp, Homo sapiens
  misc_feature: GYAE6OF01DKT8M.45.36.D03.1.454.CMB.1.raw
  modified_base (205)..(205): a, c, t, g, unknown or other
  misc_feature (205)..(205): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctcggcccccagataccaaccggaaaaattgtgttgacacagtcctccaggcaccctgtctctgtctcgagggganacagccaccctctcctgcagggccaggtaggagtgtacgagtaagtacgttaggctaggtaaccaacacgaaacctggaccaaggcctacccgagacctcctactattttacgtcggtttccttactacccgaggggtccctgttcggtactcccgagtcctaggtttcagtcgccgtaggtcggggtctaggggactaggtacgttcacgttctacgactatcaggcacgtcctagcgtaacgtgttaacgtaagttacttttacggtacgtttaaggttttactttacgttacgttaccgtaacgtacgtaacgtttaaccgttaacgtaaacgtttaacgttacgggttaccgtttaacgggtttaaccggtttacgggtttttaccggggaacccgggttaaacgggggtaaacccgtaacgggttaccggttaaaacgggttaaaaccgttaaaccggttaaaaaccggtaaacccgggttaagggttaccgggttaccggttaccggaaacccgttaaacccttaacgtttaccgttaccgtttaccgttttaccgtaaacccgtttccccgtttaacccccgg

SEQ ID NO: 111582 - DNA, 585 bp, Homo sapiens
  misc_feature: GYAE6OF01BMIBF.45.36.D03.1.454.CMB.1.raw
  modified_base (202)..(202): a, c, t, g, unknown or other
  misc_feature (202)..(202): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
  modified_base (563)..(563): a, c, t, g, unknown or other
  misc_feature (563)..(563): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggngacagcccaccctctcctgcagggccagtaggagtgtcagtaagtacttaggctggtaaccaanagaaacctgccaggctccgagcctccncatccatgatgcactccgaacgcgggtccctggccctaccaggacctacggttcccggnggctaggttgggtctacggggacaggtagttcacttcgtcgaccgtcagcgagtcccgtggacgtcctaggtattcggtattttcggacttaagtttttcctgtcgttaccgagtctaccggtcgttcccgccgacgccgtactccgtacggttcggggacgggtcgagggtgaacgtgtcggaagtcgtagtggtcgcttcgcctacgtntcgttgtacctcgtacttcccg

SEQ ID NO: 111583 - DNA, 673 bp, Homo sapiens
  misc_feature: GYAE6OF01ELMJ5.45.36.D03.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggcctccaggcctcctcatccatgatgcatccaacgacggtcctggcctcccagtacgaggttccgtggctaggtggggtctaggggactaggtacgttcacttcccgtcgaccggtcaaggtccgtacggtccgtagggacgtccgttagtacgttgtattttcggaccgtttagttttaccttcgttacggtctacgtccgtacgtcccggtttacccgccgtaacccggtcccgtcccttaccggttacccggttttccggggggacccggggggtaaccgtacgggggttgggaacggtggtacggaacgggtaaccggtaaccggtgggtacggtccgtacggacccgtaaccgtacgttccggttaggtttcccttcgtaccgtttcccccg

SEQ ID NO: 111584 - DNA, 824 bp, Homo sapiens
  misc_feature: GYAE6OF01CJH6B.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccagtggactttgggctgtaccgttgggttttcctcgttgtcttacgttttaaggaggtgtccaggtgtcgaggtgcgtagggtggtgggaggtcggggggagtcgttgtccgagtccgtgggacgtcctgacgctctcgtgtcgcacgtcctcgtggtacttccgtcctacgtagttaaccgttttcggttacctacggttcgggtcccgtaccgtacgggtttaccgacgggacggtaaacgggggtccgttaggggtacgggttcggggtccggtaccccgttacggtaacggtttttaacccggaaaggttacggtaacgggtaaagggttacggaaacggggtaacggtacccgtaacgtaccggaaacggtacccgttaccgggtacgggaaaccgggggtccctaccgttaccgaaccgtacgtaccgtaccgaacgtaacgtaaacctaacgttaaccgaacggtaacttacgttaccctttacgtttacgaactaaagttagtaacgtacgtacgtaggtaagtaggttaggaacggtacgtaccggttacgttacgtacttacgtttacgtaggtccggtacggtacggggtaactacggttacgttacggtacggtacggtttacggttacgggtttacggttaaggttaaaccgttaacgttaaccgtttaaacccg

SEQ ID NO: 111585 - DNA, 815 bp, Homo sapiens
  misc_feature: GYAE6OF01CVKX6.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggttttcctcgttgcttcttttaagaggtgtccagtgtcaggtgcgaggtggtggaggtcggggggaggtcgttgtccgaggccgtggggacggtccctgacgtactctcctggtgcagcctcgtggtacttcctccctacgtagttaaccgttttcggtttcccacgtcggggtcccgccgtacggttcccgaggacgaagggggtcctagggaggtcggggtcggcccgtcgtaacgtttaccggaagtacgtggaaacgtggaaggtaaacggcctaacgtcgaacgtaccgtccggtaggaaaccggggtcccgtacctttaccgacctaacgttaccgtacccgtaacgaacgtaaaccgtaaacgttaccgtaaaacgtaaacgttccgtttacccgtttaccgtttttacgtaacgtaaaacgttacggttaaaacgttaaccggtacccgttaggtaaacggttaacggttacggtaaacgggtaaccgtaaccggtttaccgttacgtttacgtttaacgttttccggttacggttaccggtaccgggtaacggggggtaacctaggttaccgttaaggttacggttacggtttacgttacgggtttacggttaaggtttaacgttaaacgttaaccgttaaaacccg

SEQ ID NO: 111586 - DNA, 620 bp, Homo sapiens
  misc_feature: GYAE6OF01BHAMI.45.36.D03.1.454.CMB.1.raw
  modified_base (202)..(202): a, c, t, g, unknown or other
  misc_feature (202)..(202): n is a, c, g, or t
  modified_base (362)..(362): a, c, t, g, unknown or other
  misc_feature (362)..(362): n is a, c, g, or t
  modified_base (385)..(385): a, c, t, g, unknown or other
  misc_feature (385)..(385): n is a, c, g, or t
  modified_base (424)..(424): a, c, t, g, unknown or other
  misc_feature (424)..(424): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgcccaccctctcctcgcgaggccagtaggagtgtcagtaagtactaggctggtaccaacacgaaccgtggaccaggcctccgaggcctcctcatcccatcgatcgcactacccaacgtacgggtcccgtcggccgtacccagacgtacggttccgnggctagggtcgggtcgtgggacngtacgttcactcctcgaccgtcacgcacgtcgtaggacncctgattgtatttcgacttacgtttctcgttcgtcgagtccgtcggtccgttacccgccgaccggccgttaccgttcgtccgggttttaccgggggaccggggacggtaggggtcgggagtaggttacggacgaaccggtacttaggcggttcgacgaccgtacctagttcttaggttccttcgtccttaccccgg

SEQ ID NO: 111587 - DNA, 906 bp, Homo sapiens
  misc_feature: GYAE6OF01BLFQE.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaaccggaaaattgtgttgacacagtctccaggcacctgtctctcgtctccgaggggacgacgacgcccaccctctcctgcgacgggccaggtaggacgtgtacgagtaacgtacgttaggcgtacggtaaccaacgaacgtaaaccgtcggaccgacggtcctaccgacggtcctccgtcactccagtgatcgacactaccgaacgtccgggtacccgtcgggacccgtacccgaaggtaccggtacgggttccggacggacggtagggtcgggtacgtcggggtaactacgggtaaccgtttacacccgttacgtacccgtaccggttacgaccgggtacgtaccggtaccccgggtagggtacccggtaccggttacgttacgttacggttttaacgttttcggtaaccggttttacgttttttaccgttaccggttcggttaaccgtaccgggtacctttaacccgggggttcccgtttacccccgggtaaccccgtcccgggtaccccgttacccggttaccccgggttttaacccgggggggtttacccggggggggaacccgggggggttaacccggtaggggggttaccggggtaaaccgttaggggtaaaccccgggggttaaaccggtaaaccccgggggtaggtttcccgggggttaaaccgggtccggttacccggtaacccgtaaacccggttttcggttcccggtttaccgttttaccccgtttacgaccccggtttttacccccgg

SEQ ID NO: 111588 - DNA, 746 bp, Homo sapiens
  misc_feature: GYAE6OF01BLP3G.45.36.D03.1.454.CMB.1.raw
  modified_base (379)..(379): a, c, t, g, unknown or other
  misc_feature (379)..(379): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcacctgtctctgtctccgaggggagacacgccaccctctcctgcgagggccagtaggagtgtcagtaagtacgtaggctggtaccaagaacgaaaccgtggaccgaaggcctaccgaggcctccgtacactccagtagactcgaccaactaccgaaacgtcggggtccctgggccgttacccgagtaccgtacggttccgnggacgtagggttcgggtacgtggggactacggtacgttccactcctacaaccgtatcgtacgcgtacgtccgtacgaccgtaggtaacggttactttcggaccttaactttaaccgtacgttcgtacctacgtacgaacggtcggtacggacccggtacgcggtaccgtccgtaccggttacccgggtttaccgggggacgggtaaccggggtaccgtaaacgggggtacgggtaaacgtaaaccggttaaacccggtaaaaaccgggtcggttaggggacccggggttactaacccgggtacccgttaaacccgtaccgtttcggttaacccgggtttacctttccggtaaccgtttaccccccgg

SEQ ID NO: 111589 - DNA, 775 bp, Homo sapiens
  misc_feature: GYAE6OF01E4BBF.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacacgcccaccctctcctgcgacgggccaggtaggagtgtacaagtaagtacgttaggctacggtaaccaaacgaacgaaaccgtcggaccaacgggcctacccgaggtcctccctacactccatgactcgacactaccgaacgtacgggtccctgggcccgtacccaacggtaccgtacgggttcccggtgggtaccgtacggggttcggggttaccggtacggggaacgtaacggtacggtttacctaccgttaccctacccgtaaccggttacgacgggaccgtaacgggtcccggttagggaaccgtcctaggtaacgtttggtttacttttcggacctttaggttttccttagtcgtaccgagaccgtacggttcccgtccgaccgtaccgtccgtccgttaccgttacggggtttccggggggaccggggtaccgtagggggacggtaacggtcggtaagggaacgttaaccgggtacggtttagggtacggtcccgttacggaccccttaaaccggtaccgtttcgttacccgggttttccttaccgtccccgtttacccccgg

SEQ ID NO: 111590 - DNA, 649 bp, Homo sapiens
  misc_feature: GYAE6OF01BH6W4.45.36.D03.1.454.CMB.1.raw
  modified_base (206)..(206): a, c, t, g, unknown or other
  misc_feature (206)..(206): n is a, c, g, or t
tcagacgcgatcgacacgaccggtgctcgatttagctgcgtcacgatctctcgttgggggaggaactgctcagttaggacccagagggaaccatggaagccccagctcagcttctcttcctcctgctactctggcctcccagacgaccgtccggaagaaattgtcttgacacagtctccagccattctgtctctctctcgaggganacacgccacctctcagtcgcgaggcctagtcgagtagtataagaactatacgttcggaccgtaggtactacaatacgaagccgtaggacccgacgggtccccgctacctcgtattactagtcgtacgtcgtcctaccgagccgacgggtcctacggtcgacaccgtccgagccgtaaggtccgtaggtcgggtcggttggttcgacctacgtacgtaccttcgaccgtctacgtaacaacgtcgacggtacacgtccctaactaacgtagtaacttagtttcgactttaagtactttaacgtcgtaacgtacaacgtacgtaccgtaacgtagttaccggtccgtacctacgttccgtaccgggttacggaccgggtaaacggtacggacggtcggaaagtacgaaacgaaacgtcgttcggacgtacgctaacgtcgtaacg

SEQ ID NO: 111591 - DNA, 846 bp, Homo sapiens
  misc_feature: GYAE6OF01A5NN5.45.36.D03.1.454.CMB.1.raw
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggactttgggctgaccttgggttttcctcgttgcttcttttaagaggtgtccagtgtcgaggtgcgaggtggtggaggtcggggggagcgttggtccaggccgtggggacgtcccgtgacgactctccgtgtcgcagcccttcgtggacttcctccccttgtacgttaaccgttttcggtttcccacgttcgggttcccgccgtacggttcccgaggccgaaggggccgtgggaggttcgggtcggtccccgttgtaacgttttacccggaaaggtcgttaagggaaaggtgggtaaggtaaccggtccttaaccgtacgtaacggtaacccgttaccggggtaacggtaaaccgggggtccccgtaccgtttacccgacccgtaacttcccgtacccgaaacgggtaaccgaaacccttaaacgtttaacccgaaacggtaaagtttccggtttacccgttttacgttttttaaccgaaccgttaaaacgttagtaaacgttacggtaaccgttaacggtaacggtaaggtttacgggaacggtaacgtaccggtttacgttacgttaccgtttaacgtttcgtttacggttacggtacccgggtaaggggggtaccttaacgttacgtttaacggtaggttaccggttacggtttacgggttttacgttaagggtttacggttaaacttacccggtttaaaacccg

SEQ ID NO: 111592 - DNA, 223 bp, Homo sapiens
  misc_feature: GYAE6OF01EVF8F.45.36.D03.1.454.CMB.1.raw
  modified_base (185)..(185): a, c, t, g, unknown or other
  misc_feature (185)..(185): n is a, c, g, or t
  modified_base (212)..(212): a, c, t, g, unknown or other
  misc_feature (212)..(212): n is a, c, g, or t
  modified_base (217)..(223): a, c, t, g, unknown or other
  misc_feature (217)..(223): n is a, c, g, or t
tcagacgcgatcgacacgaccggtgctcgatttagctgcgtcacgatctctcttggggggaagaggaagactgacggtcctcccaggagttcaggtgctgggcaccttgggcacgggggagtgtgtcacaagatttgggctctgggcacagcggccctgggctgcctggtcaaggactacttccngatcgcgtctgagcgggctggcaggcncatgnnnnnnn

SEQ ID NO: 111593 - DNA, 755 bp, Homo sapiens
  misc_feature: GYAE6OF01AGT5K.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagcccaccctctcctgcagggccagtaggagtgtcagtaagtacgttaggctacggtaccaacacgaacctggccaggcctcccgaggtcctcctcactccatgactgcactccgaacgtacgggtccctgggcccgtacccgaggtaccgtacgggttcccggtggacgtagggtcgggggtcgtgggggaactagggtacgtttaccacgttcctaccgacccggtccacggaccgtaccggccgtacgggaccgtacccgtaggtagttacggtttacttttcggtacctttaaggtttttacccttcggttacgttccgtacggtccgtaaccggtttcccggttcccccgaccccgtacccggtccccggttccgttacccgggttacccggggttttaccggggggacccgggggggtaacccggtagggggtcgggtaaggtacggtacgggaaccgggtaacggtaccgggttgggtacggtccgtacggtaccgtaacccgttacgttcgttaccgtttcgtttacctccggttcccccg

SEQ ID NO: 111594 - DNA, 719 bp, Homo sapiens
  misc_feature: GYAE6OF01AU660.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggagacngccaccctctcctgcagggccagtaggagtgtcagtaagtacttaggctaggtaccaacagaaaccgtcggccaggcctccgaggctcctcactccagtggactcgaccactccaacgtaccgggtccctcggtccttaccccgagtaaccgtcgggttcccgtacggtcgtaggttcggggtccgtacggggaacgtacggtacgtttccaacgttccctaccgtaacccggtcgacgcgtaaccggaccggttcgggaacgtccgttaggtacgttacgttaacgtttttcggacgtttaaccgttttacttcgttacggtaccgtacggtaccgtacggttcccgtcccggtacccgtaccggtcccgtccgtacctaccgggtttccggggaccgggggtacgacggggtggacggtagtacgaacggtaccggtaacgttcgggtacgggtcccgtacggtaccaaccgttacgttcccggttatttcccgtttacgtccctttacccccg

SEQ ID NO: 111595 - DNA, 526 bp, Homo sapiens
  misc_feature: GYAE6OF01B8GKK.45.36.D03.1.454.CMB.1.raw
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
  modified_base (487)..(487): a, c, t, g, unknown or other
  misc_feature (487)..(487): n is a, c, g, or t
  modified_base (512)..(512): a, c, t, g, unknown or other
  misc_feature (512)..(512): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggatgtcagttaagtacttaggctaggtaccaacagaaacctggccaggctccaggctccnatccatgatgcatccaancgggtccctggccgtcccagacctaggttccgnggcaggtgggtctgggacaggtacgttcacgtcctacgaccgtcaagcacgccgtggagcctgatgtattttgactagtttactctgtcagcagtcgttccgccacgccgctccgtacgttcggcggggacgagggtggagagngacgacgaacgtggtcgctgcactntctgtcttgctccg

SEQ ID NO: 111596 - DNA, 730 bp, Homo sapiens
  misc_feature: GYAE6OF01CPZF2.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccaggtaggagtgtcagtaagtacttaggctggtaaccaacagaaacctggaccaggcctcccgaggcctcctcatccatgatgcatccaacgtacgggtccctggccgtcccagaccgtacgggttccgtggctagggtcgggtcgtaggggactaggtacgttacaccgtccgtaccgaacccggttcgaacggtccgacggtcccgttaggggaccgtcccgtaggtacgttagtttacgtttttggacctttaggtttttaccttccgttagtacccgtaggtaccgtacggttcccggtttaccccgacccgtaacccggtcccggtaccctttaccggttacccggggtttttaccggggggaccggggggtaacccgttaggggggtacggaacggtacggtacgggtaacggtaccgggttaacggttcgggttacgggcccttacgggaccctacccgttagttccgttacgtttccttaccgtcccgtttccccg

SEQ ID NO: 111597 - DNA, 663 bp, Homo sapiens
  misc_feature: GYAE6OF01DNUKW.45.36.D03.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
tcagacgcgatcgacacgaccggtgctcgatttagctgcgtcacgatctctcttgggggaggaactgctcagttaggacccagagggaaccatggaagcccccagctcagctttcctccttcctcctgctactctggcctcccagactaccaaccggaaaattgtgttgacacagtctccaggcaccctgtctctgtcnccgagggganacacgcccaccctctccgtgcacgggccagtaggntcgtcagtaagtactaggctaggaaccaacgaaagtaacccgtggcccaggcctacccgaaggcctactccatccaatgatgacatccaacgcgggtccctgggcctaccaggtaaccncggtttccgaggcaggtcgggtcaggggactagtacggttcactcgtacaccggtanacgcgcgcgtacgacgtctagtagttgttacttagtacgttacgtttacttcgtacgtcgtacgtcgtacgtccgtcccgaccgtaccgtccgtaccgtcggttacccgggtttccgggggacgggggtacggacggggtacggaaggtacggttacggaaacgggtaaccgtaacggttcgggttcggtccgaccgtaccgaaccgttacgttaccgttacggtttcctaccgttcctcccg

SEQ ID NO: 111598 - DNA, 606 bp, Homo sapiens
  misc_feature: GYAE6OF01BOAU9.45.36.D03.1.454.CMB.1.raw
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
  modified_base (449)..(449): a, c, t, g, unknown or other
  misc_feature (449)..(449): n is a, c, g, or t
tcagacgcgatcgacacgaccggtgctcgatttagctgcgtcacgatctctcttggggaggaactgctcagttaggacccagagggaaccatggaagccccagctcagcttctcttccgggtcctgctactctggctcccagataccaccggaaaaattgtgttgacacagtctccaggcaccctgtctctgtctccgagggagacagccaccctctcctgcagggccagtaggagtgtcagtaagtacgttaggctggtaccaacagaaacctggccaggcctcccgaggctcctcactccatgatgcactccaacgcgggtccctgggtcccgtacccaggtacgtacgggttccgnggccgaggttcgggctgggaccagtacgttcactctcgaccgtnagtcacgcctggcgtcctagattgtattttgacttagttttacctntgtactagctacggtccgtcccgccaccgtcccgtctccggtaccggtttccgggggacccgggggtaccgtaggggtcggagtacgtcggaacggtaccggtagttgggcggtcgtcgaccgtacctacgtcgttcgtccttcgtccgtttccccg

SEQ ID NO: 111599 - DNA, 1003 bp, Homo sapiens
  misc_feature: GYAE6OF01D5AAI.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccaggcaccctgtctctgtctccgaggggacacacgcccacccttctccgtgcgacgggccaggtaggagtgtacaagtaagttacgttaggcgttacgggtaacccaaacgtaacggaaaaccgtcgggacccgacgggtccctacccgacgggtccttccccgtactaacttacccaagttcgacttacggtaccctaacgttaaccccgaaacggtacccggggttccccgtacgggtaccccgtaaccccgacggtaaccggtttaccggggttacccggttaccggggtaccgttaacgggggtttcgggggtacccggttacgggggaaccgtaacggttaaccggtttaccccgtaacgtttacccgtacccggtaaccccggttcgaaaccggtacccgaacgggttcccggtacggggtaacccggttccgtaggttaaacgttttccggtttaaacggtttttccggtaaccgttttaaaccgttttttaccgtttaccggtttacggtaaccgtttacggtaaccccggttacgggtttaccccggtttaacccccgggacccgttaccccggggtacccccgttaccccggtttaacccgggtttaaaccccgggggttttccgggggggggaaacccggggggttaacccgggttacggggggtacccgggaaaaggttaccgggtaacggggttaaaacggtacccggggttaacgggtttcggtacccggggtaccttaaccggtaaccccggttacctaaccggttttccggttaccgggttttaacctttcccgtacccgtttttaccccccgg

SEQ ID NO: 111600 - DNA, 587 bp, Homo sapiens
  misc_feature: GYAE6OF01BTXO9.45.36.D03.1.454.CMB.1.raw
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctcctcatccatgatgcatccaacncgggtccctggccgtcccagacctaggttccgnggcaggtgggtcgtgggacagtacgttcactctcaccatcgacgcgcctcgcgtagtcgtagtaagtagtttaggtacttttattacgtgtacagtctagtataatctacgtcggtaccgttacgtacgtttcggggcccggggtaactaggtacgtagggacgtacgtaacgaaacgtacgtcggtaggaccgtcgacctacctacgttcgttacgttaccttctaccgttcccgttaccccg

SEQ ID NO: 111601 - DNA, 529 bp, Homo sapiens
  misc_feature: GYAE6OF01A668E.45.36.D03.1.454.CMB.1.raw
  modified_base (518)..(529): a, c, t, g, unknown or other
  misc_feature (518)..(529): n is a, c, g, or t
tcagacgcgatcgacacgaccggtgctcgatttagctgcgtcacgatctctcctgtgcagtaactttggtttccactgggtccgccaggttccaggcaaggggctggagtgggtggccctcatttccgaagatggaagtgagaaggcctactcagactccgtgaagggccgcttcacccatctccagagacaattccaagaactgtcctctttttgcaaatgaatagcctgagagttgaggacacgtctgtctatttctgtgccagggggacatctatgagtctggttcgtagtgtaatcaactactactacctcatggactctggggcaaagggacctcggtcaccgtctccgcagcttccaccaagggcccatcggtccttcccctggccgccctgctccaggacgccaccgtcgtggggcacgagccggcccgtgggctcgccctggtccgaaggacctacttcccgtcgtactccgtcgtcctcgaggccgggcgtggccgaaggcgcgatagnnnnnnnnnnnn

SEQ ID NO: 111602 - DNA, 841 bp, Homo sapiens
  misc_feature: GYAE6OF01B3ZHQ.45.36.D03.1.454.CMB.1.raw
  modified_base (205)..(205): a, c, t, g, unknown or other
  misc_feature (205)..(205): n is a, c, g, or t
  modified_base (798)..(798): a, c, t, g, unknown or other
  misc_feature (798)..(798): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagactaccaaccggaaaattgtgttgacacagtctccaggccaccctgtctctgtcctccgagggganacacgccctaccctctccgtgcgacgggccaggtaggagtcgtcaaggttaacgtacgttaggcgttacggtaacccaaacgaacggtaaaacccgtcggacccgaacgggtccctaccccgaagggtcccttaccccgttaccaacgttacccgagttacggtaacttcggacctaaaccgttaccccgaaaacggtccggggttcccccgtagggtacccccggttaccccgaacgggtaacccgttaccggggtttacccggtacggggtaccgtaacggggtttccggggttacggtacgggggaaccgtacggttaccgtttaccacccgttcccgtacccgaacccggttcacgggtacctacgggtacccgttaggggtaccgtccgttagggttaacgttacgtttaacgtttttcggaccctttaacggttttttaccttccgtagttaccgtaacgtcgttaacccggtcccggttacccgaccctacccggtcccgtaccgttccggggttaccggtttccggggggaccggggttaaccgaggggtacgacgtaacgtgggaaccgtacggtagttcgggngccgtacgccgtacgtcgttcgttacgtccttgccctttcccg

SEQ ID NO: 111603 - DNA, 709 bp, Homo sapiens
  misc_feature: GYAE6OF01DNM3J.45.36.D03.1.454.CMB.1.raw
  modified_base (201)..(201): a, c, t, g, unknown or other
  misc_feature (201)..(201): n is a, c, g, or t
  modified_base (316)..(316): a, c, t, g, unknown or other
  misc_feature (316)..(316): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgccaccctctcctgcagggccaggtacggagtgtcaggtaagtacgttaggctggtaccaagacgaaacctggccaaggcctacccgaggcctccgtcacctatacgagcncgactaccaccgacggtaccgtcgcgtacccgcgacgtacggtaccggtcggcggtacggtacgggtcggtacggacgtaggtaacgttcgtacgtcgtacctacccggtaccgagtaccgaccggtacgtcggtaccggcgttccggtagttacgttagttttcgttaccgttaagtttaacgtttccgttagttccgagaccgttacgtcccggttacccgtacccgccgtaccgtacccgttaccgttaccgggtttcccggggaccggggggtacccggtcggggtagggacgtacgtcgggaaacgtaccgggtaagttaccgggtggttaccggccgtaccgtactaacgttcttacgttccggttcctaccgttccgttacccccg

SEQ ID NO: 111604 - DNA, 593 bp, Homo sapiens
  misc_feature: GYAE6OF01BI2TI.45.36.D03.1.454.CMB.1.raw
  modified_base (264)..(264): a, c, t, g, unknown or other
  misc_feature (264)..(264): n is a, c, g, or t
  modified_base (364)..(364): a, c, t, g, unknown or other
  misc_feature (364)..(364): n is a, c, g, or t
  modified_base (583)..(583): a, c, t, g, unknown or other
  misc_feature (583)..(583): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggacgacagcccaccctctcctgcaggccagtaggagtgtacagtaagtacttaggctggtaccaanacgaaactggccaggcctccgagctcctcatccatgatgcatccaacgcggttccggcctcccaagtacgtacggtccgagcgaggtgggtcgtggaacnggtacttcactcgtcaccggtcagctacgcgtcggacgacctggacttgtaattttcggtacgttaacgtttcttcgtgttcgacgtccgtcgtcccgttaccgcccgtaccgcccgtccgttccgtaccggtttcggggaccggggtacccggagggtccggaggtcgaggtacggaggtacgtggtacggctcgaccgacgtacgtcttgttccgtntcgttacccc

SEQ ID NO: 111605 - DNA, 816 bp, Homo sapiens
  misc_feature: GYAE6OF01AHBUJ.45.36.D03.1.454.CMB.1.raw
tcagacgcgatcgacacgaccggtgctcgatttagctgcgtcacgatctctcttgggaggaactgctcagttaggacccagagggaaccatggaagccccagctcagcttctcttcctcctgctactcgtggctcccagataccaccggaaaattgtgttgacacagtctccaggcaccctgtctctgtctccgagggacgacacgcccacccgtctcctgcgacgggcctaggtaggagtcgtacgagtaacggtacttaggcgtacggtaaccaacgaacgtaaaccctggaccctagggtccctcccggaacggtcctaccgtacctactacccgaagttcggtaacctcggacctaacgtaccccgaaaccggtaccggggttcccctacggggccccgttaaccgaccggtacgttaacgggttccccgtggtcccgtagggtcgggttaccgtacggggactaacggtacgtttccgaaccgttcgtacccgaccgttcgacgggtccacggtccgtacggaccgtacgtgtacgtacgttacgttacgtacgttacgtttacgttcgttacggttacgtacggtaccggttacgtacccggttacccgtcccgtaacccggtccggttcccgttacggttaacccggggtttccgggggaaccccggggtacgggttacgggtaccgggttacggaacggttacggtaacgggaacggtttaccgggtacgggtaccgggcgttaccgggtaacccgtaccggttcggttaacccgttaggttcccgttcgtaacccgtttcccccggg

SEQ ID NO: 111606 - DNA, 824 bp, Homo sapiens
  misc_feature: GYAE6OF01CIULQ.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctcgtctccgaggggagacacgcccacccctctcctgcgacgggccaggtaggagtgtacagtaagtacgttaggcgtacggtaccaacgaacgaaaccgtcggaccgaaggtcctacccgaggtcctcctacacgtcctatgactcgacacgtacccgaacggtacgggttcccgtacgggtcccgtacccgaacggtaccggtacgggtttaccggtcggggctaacggggttcggggtcggtacggggaacgtacggtacggttaccacgttcccgtaccgaccggtcaggtccgacgtccgttcggacggtccgtagtacgtaggttagttttcgaccgtttacgtttaccgtttacgtacggttacgtacggtcgtaccggttcccggttaccccggtacccgtcccggtaccccgttacccggttaccggttccccggggtttaccggggggaccccgggggggggttaaccgtaacgggggggtttacgggaacggggttaccggtaaccggggtaaaccgggtaacccggggttaaacggttcgggggttaccgggtacccgttccgggtaacccgtacccgttacggtttccgttaccgtttacccgttcgtacccgtttacccccgg

SEQ ID NO: 111607 - DNA, 796 bp, Homo sapiens
  misc_feature: GYAE6OF01CZ2JB.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgcccaccctctcctgcagggccagtaggagtgtcagtaagtacttaggctaggtaccaacagaaacctggaccagctccaggctctcatccgaattgatcgactacgtacccgaaacgacgggtcccctgggcccgttaccccgaggaaccgtacgggttcccggtggactacggggttcgggtacgtaggggaacctaggtacgtttccgaaccttccgtaccgtaacccggtcaacgccgtaacggtcccgtacgggtaccgccgttacggagttacggttatttttacggtacgttaccggtttttacgttccgttacggttacgtacggtaccgtacggttcccggtttaccccggacccggtaaccggtccccgttaccgttacccgttaaccggggtttttcccggggggacccgggggggttaacccgggtaccgggggtttaaggggaaccgggtaacgggtttaacgggaagggttaacccgggtaaaaccgttcgggggttaaccggtcggtaccggtacccgtaacccgttacgtttaccgttaccggtttcccgtttaccgtaccggtttacccccg

SEQ ID NO: 111608 - DNA, 655 bp, Homo sapiens
  misc_feature: GYAE6OF01BDQV3.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctccaggcacctgtctctgtctccgagggganacacgcccaccctctcctgcgacgggccagtaggagtgtacgagtaagtacgtaggctacggtaaccaacgaacgaaaccgtcggaccgacggtcctacccgaggtcctcctcactccatgatcgcactaccgaacgtcgggtccctggccgtaccgagtacgtacggtccgtggcgtagggtcggtcgagggtacgaggtacgtcacgtctcgaccgtcgagctcgtcgtggactccgtagtactgttagtttgacgttacgttttactcgtgtactaggtccgtacggtcccgttcccgacgtcccgtccgtccgttaccgggtaccggttccggggggaccggggtacgaggggtaggacgtaggtacggacgggttacggaacggttgggtacggcgtaccgacctacccgttcttaccggttcctttacccttcgtacccgttcccccg

SEQ ID NO: 111609 - DNA, 770 bp, Homo sapiens
  misc_feature: GYAE6OF01AP40Z.45.36.D03.1.454.CMB.1.raw
tcagacgcgatcgacacgaccggtgctcgatttagctgcgtcacgatctctcttgggggaggaactgctcagttaggacccaggagggaaccatggaacgccccagctcagcttctcttcctcctgctactctggcctcccagactaccgaacggtaaaattgtgttgacacagtcctccgaggccaccctgtcctctcgtctccgaggggacacacgcccacccttctccgtcgacgacgggaccagggtaggagtcgtactaaggttaacgttacgttaggcgttacggaaccaaacgaacggtaaaccgtcggaccacggtccctacccgaggtccctccgtacgactcccgaatgacttcgacctacgtacccgaaccggtccgggttcccgcgggtcccgtacccgacggtaccgttacgggttccggcggccgtagggttcggggtacgacgggtaacgtaggtacgttaccaccttctaccgaccgtacacgccgacggtccgtggacctcgtagtacttgttacgtttcgctttagtttacctcgtacgttcacgccgtacggttccctcccgggaccctaccgggtccctaccgttacccgggttaccggggttcccggggggaccggggttaccgggtacggggacggttaacggagggttacggaaacgggaccggttaacgggttcgggtaccggtccggtacgaccccttaacgtccgttaccgttacggtttcttacccgttccgttaccccccgg

SEQ ID NO: 111610 - DNA, 784 bp, Homo sapiens
  misc_feature: GYAE6OF01DTC4L.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccaggcaccctgtctctgtctccgaggggacgacacgccaccctctcctgcgacgggccaggtaggagtgtacgagtaagtacgttaggctaggtaaccaacgaacgaaaccgtcggaccgacggccctcccgaggcccttaccgtacactcccattcggaattcgacctacgtacccctaaaccggtacggggttcccctacgggtacccgtaccccgacggtaccgtacgggtttaccggtcgggacgtacggttcggggttacgtacggggaacgtacggtacgttccgtaacctccgtaccgtacccggtcgacgtaccgtacggtcccgtagggaccgtacccgttagtacgtttcgtttaagttttcggtacgtttaacgttttacgtttcgttcgtacgtaacgtccgtacgtcccggtttacccgcccgaccggtcccgtaccgttccggtaccgggtttacccgggggacgggggtacccgtagggggtaccggtaaggtacgtacgggaacggtaacccggtacgggttcgggtacgggtcctacggtacccgaccgtttacgtcccgttacggttttcccttccgttccgtttccccccgg

SEQ ID NO: 111611 - DNA, 766 bp, Homo sapiens
  misc_feature: GYAE6OF01CM59Y.45.36.D03.1.454.CMB.1.raw
  modified_base (308)..(308): a, c, t, g, unknown or other
  misc_feature (308)..(308): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccagcaccctgtctctgtctccgaggggagacagccaccctctcctgcacgggccaggtaggagtgtcagttaagtacttagggcttaggtacccaaacgacgaaaccgtggacccaaggcctcccgaggccttccnctactccatgactcgacctactacccaacgtacgggtccctcgggtccctaccccgtaaggaccgtaacgggtttcccgtgggtacgacgggttcgggggttcgtacggggtaacagggttacgttccaacgttcctacgtacccggtcacggctacgtccgttgggaacgtccgtagtacgttaggtttagttttcgaccgtttacgttttaccgtttcgttcgttaccgtaacggtccgtaaaccgggtcccgtttcccggaccccggtacccggttaccccgtcccgttaccccggttaccgggttttcccggggggtaacccgggggggtaacccgtagggggtacggagggtacgtaacggaacgggtaaccggtaacggttacgggtcgggtccgttacggtacccgtaccgtaacgttcccgttgttaccccttcgtaaccgtttcccccg

SEQ ID NO: 111612 - DNA, 772 bp, Homo sapiens
  misc_feature: GYAE6OF01BAWE9.45.36.D03.1.454.CMB.1.raw
  modified_base (197)..(197): a, c, t, g, unknown or other
  misc_feature (197)..(197): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccacggaaaattgtgtgacacagtctccaggcacctgtctctgtctccgaggganacagccacccgtctccgtgcgacgggccaggtaggacgtgtacgaagttaagtacgttaggccgttaggtaacccaaagaacgaaacccgtggaccaacgggtcctaccgacggtcctccgtacactaccagttcgatcgacctactaccgaacgtcgggtccctggtcctacccgagtaaccgtcggttccgtcggacgtcggtacgggtacgtacgggtaacgtacggtacgttccgaacttcgaccgtaaccgtcgagtaccgacggtccgtacggtacgtccgttacggtacgttacgtttacgtttcggtacctttaagttttaccgttcgttacgttaaccgcggtaccgtaccggttccggttacccgtacccgtacccggtacccgtccgtacccggttaaccgggttcccggggaaccggggggttacccgtacggggtccgggtaacggttaacgggtaccgtaaacgggtacccggttaacgtggggttaaccgtccgggttaccgtacccgtaacccgttaggttaccgttaccgtttaccgttccgttaacggtttcccccg

SEQ ID NO: 111613 - DNA, 739 bp, Homo sapiens
  misc_feature: GYAE6OF01ERIJR.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggtaaaaattgtgttgacacagtctccaggcaccctgtctctgtctccgaggggagacagccaccctctcctgcgagggccagtaggagtgtacagtaagttacgttaggctggtaaccaacgacgaaacctggaccaggcctaccgaggcctcctcactccatggatcgacactacccgaacgtcgggtccctgggacctacccgaaacgtacgggttcccgtaggacgtaggtcggggtacgtacggggactaggtacgtttccacgttccgtaccgaccgtcgacggtcgacggtcccgtgggaccgtccctagtacgttaggttattttcggactttaacgttttaccttcgtcgtacctaggtacctacggtcccgttacccgccgtaccggtcccgtcgttacccgtaccgggtttccgggggacccggggggtacgtacggggggtacggtaacggtacggtacgggtaacggtaaccggttaacgggttcgggtaccggggacgttaccggacccgttaaacccgtacggtttccggttactttacccggtttaccgttacccgttccccggtttacccccgg

SEQ ID NO: 111614 - DNA, 682 bp, Homo sapiens
  misc_feature: GYAE6OF01ERYQ6.45.36.D03.1.454.CMB.1.raw
  modified_base (380)..(380): a, c, t, g, unknown or other
  misc_feature (380)..(380): n is a, c, g, or t
  modified_base (547)..(547): a, c, t, g, unknown or other
  misc_feature (547)..(547): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccacccctctcctgcacgggccaggtaggagtgtacagtaagtacttaggcttaggtaaccaacaacgaaacctggaccaggtcctcccgaggtacctcctacactccatcgactcgcactacccgaacgtacgggtcccctggcctacccgagtaccgtagggtttcccgngggctagggttcgggtacgtcggggaactaggtacgttccaaccgttccgtaccgaccggtcaacgtccgacggtccgtcgggaaccgtccgtagtacgttaggttacttttcggactttaacgttttaccttcgtagtcgacgtcctacggttcccgtccgtaccnccggtcccgtccgtcggttaccgggtttaccgggggaccgggggtaaccgtaggggtacggaacgggagtacggacggtaacggtacgtgggtcggcgtacgcctacgtacttcgttacttcttcgacttccccg

SEQ ID NO: 111615 - DNA, 687 bp, Homo sapiens
  misc_feature: GYAE6OF01C1S75.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacgacgcccaccctctcctgcagggccagtaggagtgtcagtaagtacgttaggctggtaaccaacaagaaaccgtggaccagggcctacccaggcctcctcactccaatcgatgcactccaacgacgggtccctgggccgtcccgagaccgtaggttccggtaggcgtagggtcgggttcgtggggactaaggtacgtccactctacgaaccgtcaagctacggccgtaggcgtccgttgacttgttagttttcgacgtttaggtttaccttcgttgtactaggtcgtacggtcccgtttccgcccgtaaccggcccgttaccgttccgttaccgggtttccgggggaccggggggtaacccgtgggggttacgggtaacggtacggttacgggacgggaaccggtaaacggttcgggttacgggtccgtacggtacccaaccggtactttaccgttcggttccttcggtaacctttccccgg

SEQ ID NO: 111616 - DNA, 675 bp, Homo sapiens
  misc_feature: GYAE6OF01C8Y6U.45.36.D03.1.454.CMB.1.raw
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggacgacacgcccaccctctcctgcgcgggaccagtaggagtgtacgagtaagtacgttacggctacggtaaccaacgaacgaaaccgtggacccaacgggtccctacccgaacggtccttaccctcacgtaccaagtgactcgactaactaccgaacgtaccgggtcccctcgggcccgtacccgaacggaccgttacgggttccggtggcgtagggtcgggtacgngggaacaggtactcacttccncgacgtnacgcacggcgtacggacgcctgtattcggttatttcggactttacgtttacctcgttcgtactcgtacctacggtccgttccgacccgtaccgtccgtccgttaccgtaccgggtttccggggacggggtaccgggtacggggtacgggtacgcggtacggaacggacggtaacgtggtacggctcgaccacgtcttcgtcgttcctgtccgttacccg

SEQ ID NO: 111617 - DNA, 740 bp, Homo sapiens
  misc_feature: GYAE6OF01BTWIA.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgcgacgggccaggtacggagtgtacgaagttaagtacgttaggctacggtaacccaaacgaacgaaacctggacccaagggcctccaggtcctaccgtcactccagtcgagtcgcactaccgaaacgtcgggttccctacgggtacccgtacccgaacggtaccgttacgggttcccggtacgggcgtacgggttcggggttacgtggggaacgtaggtacggtttaccaaccgttccgtaccgtaaccgttcgaacggtccgaacggtccgtaggaactccgttagacgttagttaacgtttcggaaccgtttacgttttacgttcgttacgccttaaggcccttacggtcccgttcccgacccgtccggtaccgtaccttccggttaacgggtttccgggggaccgggggtaactacgggggttacgacggttacggtagaccggtaacgtacggttgggtacggtcctacggtaccgaaccgttcgttacctggttaccttccgttaacgttccccgg

SEQ ID NO: 111618 - DNA, 746 bp, Homo sapiens
  misc_feature: GYAE6OF01BVRRB.45.36.D03.1.454.CMB.1.raw
  modified_base (289)..(289): a, c, t, g, unknown or other
  misc_feature (289)..(289): n is a, c, g, or t
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggactttgggctgaccttgggttttcctcgttgcttcgttttaagaggtgtccagtgtcaggtgcagggtggtgggaggtcggggggagtcgttgtccagccgtgggagtccctgagactctctgtgcagcctcgtggtacttcctccctntaacgttactttcggttccacggtcgggtccctccgtacggttccaggtccggaaggggtctagggagtcgggtcgacccttgtacgtttaccggaagtacggttggaaaggttgaaggacgtcctacgtcgaagtaccgtccggaggaacgggtccctacttccgaacctacgtcctacccgaacgtaacgaactaacttaccgaagtaacgttcgttacctttacgttttacgactaaattacgtaacgttacgtaccgttagaaggtacggttacgggtaacgtaccgttaaccggtttacgttacgttaaccgtttacgttttcggttacgggttaccggaaccgggttaaccgggggtaacttacggtttacggttacggttacggttacggttacggttttacgggttacgggtttaaggtttacgttaaaaccgttacgttaaaaccccg

SEQ ID NO: 111619 - DNA, 711 bp, Homo sapiens
  misc_feature: GYAE6OF01ADQPI.45.36.D03.1.454.CMB.1.raw
  modified_base (333)..(333): a, c, t, g, unknown or other
  misc_feature (333)..(333): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagactaccaccggaaaattgtgttgacacagtctccaggcacctgtctctgtctccgagggacgacacgcccaccctctcctcgcgacgggcctaggtaggacgtgtacgagtaagtacgttaggcgtacggtaaccaacgacggtaaaccgtcggaccgaacggcctaccgacggtcctcctcgactccagtcgntacgacctacgtacccgaacggtaccggtcccgtcggccgtaccgagtaccggtacggttccgtggacgtacgggtcgggtcgtacggactacggtacgtcgactccgtaccgtaccgtcgacgaccgtacggtccgtaggacctcgtagtacttggtacttttcgacgtttaacgtttccttacgtcgacgtacggaccttacggtcccgttcccgaccgtccgtccgttaccgtccggttaccgggttccggggaccggggtacgtggggacggtaactcgggacgggtaacgaccgggttaacgtcggggtacgtccgtaccgaccttaaccgtcgtttaccggtactttacccggttactccccggttaccccg

SEQ ID NO: 111620 - DNA, 733 bp, Homo sapiens
  misc_feature: GYAE6OF01ESI4D.45.36.D03.1.454.CMB.1.raw
  modified_base (202)..(202): a, c, t, g, unknown or other
  misc_feature (202)..(202): n is a, c, g, or t
  modified_base (344)..(344): a, c, t, g, unknown or other
  misc_feature (344)..(344): n is a, c, g, or t
  modified_base (373)..(373): a, c, t, g, unknown or other
  misc_feature (373)..(373): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagactaccaaccggaaaattgtgttgacacagtctccaggcaccctgtctctgtctccgaggganacagcccaccctctcctgcgagggccaggtaggagtgtctagtacgtactaggctaggtaaccaagaacgtaaaccgtggaccacggcctaccgaggtcctacctacactccagtgactcgacactaccaacgtcggtcccnggccgtaccgaggtaccgtacggttccgnggacgtagggtcgggtacgtagggactaggtacgttcacgtctccgaccgtcacgcgtacgtcgtaggactccgtagtagttgtttacgttttaggttacgtttcttacgttcgtacgtagtacctaccgggttcccgtttaccccgcgtacccgtcccgtaccttaccggttacccggggtttaccggggaccgggggtaaccgttagggggtacggtacggtaccggtacggggtaaaccgtaaccggggttaaccggttgggtaccgggtaccttaccgggtaaacccgttacccgttaggttccccgtttacggtttaccctttaccggtaccccgttttccccgttaaccccggg

SEQ ID NO: 111621 - DNA, 747 bp, Homo sapiens
  misc_feature: GYAE6OF01CEUGN.45.36.D03.1.454.CMB.1.raw
  modified_base (205)..(205): a, c, t, g, unknown or other
  misc_feature (205)..(205): n is a, c, g, or t
  modified_base (554)..(554): a, c, t, g, unknown or other
  misc_feature (554)..(554): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaaccggaaaaattgtgttgacacagtcctccaggcaccctgtctctgtctccgaggganacacgccacctctcctgcgacgggccaggtacggagtcgtacgagtaacgtacgttaggcgtaggtaaccaaacgaacgaaaaccgtcggaccgaacggccttacccgaggtcctcctacaactccaagtagactcgaccaactaccaaacgtccgggtcctacggccgtacccgagaacgtcgggtccgtcggacgtacggtcgggtacggtagggacgtaaggtaccgttaccgaacgttccaaccggtaacccgttcgaacggccgaacggtccgttaggaacggtcccttaggagtttacgttaacttttcgggaaccttaggttttaacctgttacggttaccncggtacgaccggttccgtaccggcctacggtccgtccgtacggttaccggggttaccgggggaccggggtaacggtaggggtacggaacggttacggtacgggtaaaccggtacggtaaccgggtcggtacggccgttaaccggaccttaaccgttacttccggttactttaccgttccgtaccgtttccccg

SEQ ID NO: 111622 - DNA, 709 bp, Homo sapiens
  misc_feature: GYAE6OF01B0LPZ.45.36.D03.1.454.CMB.1.raw
  modified_base (203)..(203): a, c, t, g, unknown or other
  misc_feature (203)..(203): n is a, c, g, or t
  modified_base (386)..(386): a, c, t, g, unknown or other
  misc_feature (386)..(386): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggccaccctgtctctgtctccgagggganacacgcccaccctctcctgcagggccaggtaggagtgtcagtaagtacgttaggctaggtaccaacaggtaaaaccctggacccaagggtccctcccgaaggcctacctcaactcccaatcgaattcgactactccgaaacgacggggtcccctgggcctcccgaagaccgtacgggttccgnggctagggtcgggtcgtgggacaggtacgttcaccttcctacaccgtcacggccacggccgtgggaacgtccgtaggtacgtcgttacgttttcggctttaacgttttacgttcgttacggtccacggtccgtacggtcccggtttacccgaccgtaccggtacccgtcccgttaccgttaaccgggtttccgggggacccgggggtaccggtaggggtacggaacggtagtaccggacggtaaccggtacgttagggtacggtccgttacgcccgtaaccgtactttccgtacgtttcccttaacgtcccgtttacccccgg

SEQ ID NO: 111623 - DNA, 756 bp, Homo sapiens
  misc_feature: GYAE6OF01CMGGC.45.36.D03.1.454.CMB.1.raw
  modified_base (264)..(264): a, c, t, g, unknown or other
  misc_feature (264)..(264): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccaggtaggagtgtcagtaagtacttaggctggtaccaanagaaacctggccaggctccgaggcctcctcatccatgatgacactaccaacgtacgggtccctcgggacctccccgaaggtaccgtacgggttcccggtagggacgtagggttcggggtctagggggactaggtacggttccacgtcctaccgacccggttcgacggctacgggcccgtagggtaccgtcccgttaggtacgtttacggttatttttacggaccttttaggtttttaaccctttcggttagttaccgtacggtaccgtaacgggttccccgtttcccggacccgtacccgtaccccgtccgttaccggttacccgggttttccggggggacccgggggggtaacccggtagggggttaccggggtaagacggttacggtaacgggtaaccggtaacggttggggtacgggtcccgtacgggtaacccgtacccttaacggttaccgttccggttaccgtttaccgtacccggtttacccccg

SEQ ID NO: 111624 - DNA, 799 bp, Homo sapiens
  misc_feature: GYAE6OF01EO9AR.45.36.D03.1.454.CMB.1.raw
  modified_base (472)..(472): a, c, t, g, unknown or other
  misc_feature (472)..(472): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggacgacagccaccctctcctgcacgggccagtaggagtgtcagtaagtacttaggctggtaaccaacgtacgaaaacctggcccaaggcctacccgaggcctccctacacttcgtaatgggtcgctactcccttccgaacggggtccctcgttcgggtcttacccccgaaggtaccgtaacgggtttcccggtagggccgtaagggttcgggggtcgttacgggggaacctaagtaaacggtttcccaaccttccgttaccgaccccggttntaacggtaacggtcccgtagggtaaccgtcccgttagtacgttacgttaacgtttttcggaccgtttaacgttttacctttcgttacggttacctaaaggtcccgtaaggtcccggttttaccccgaccgtacccggtccccgtaccttccggttaccggtttcccgggggaccggggggtacccgtagggggttaggtaacgtacggttacggaacgggtaaaccgtaacgggttcgggttacgggtaccggttcggaccccgtaacgtaaccgttcggttacggtttaccccttacgttaacccgttcccccgtttaacccccgg

SEQ ID NO: 111625 - DNA, 927 bp, Homo sapiens
  misc_feature: GYAE6OF01AGRM4.45.36.D03.1.454.CMB.1.raw
  modified_base (184)..(184): a, c, t, g, unknown or other
  misc_feature (184)..(184): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccgttgggttttcctcgttgctcttttaagnggtgtccagtgtcaggtgcgaggtggtgggacgggtcgggggggaggtcggtttgtccgacggtccgtggggacggtcccgtggacgtacctcctccgttggtcgccacggcccttcgtcggtactttcccgttcccctacgtacggtttaaaccgttttcggtttaccccaccggtttcggggtaccccggtacccggtaacgggtttacccgaacgggtaccggtaacggggggtccgttggggtaacgggttcgggggttacccggtacccccgtttagttaaccggttttaacccggaaaggttacggttaaggggtaaaggttacgggtaaacgggtaaacggttaccccttaacgttaccggtaacggtaacccggttaccgggtaacggggtaaaccgggtccccgtacgtttacccgtaaccccgttaactacccgttacccgaacggtaacggtaacccttaaaccgttaacccgtaaacggttaaccgtttaccggtttaaccccttttacgtttttaacggaaccgttaaaacttacggtaaacgttaccggttacccgttaaggtaacgggttaacggttaccggtaacgggttaccgttaaccggttacgtttcgttacgtttacgtttcgtacggtaccgtaccgggtacggggtactagttaccgtgttacgggtacggttacgtttacgggtttacgttaagttacggttaaccttacgtaaacccg

SEQ ID NO: 111626 - DNA, 585 bp, Homo sapiens
  misc_feature: GYAE6OF01DCJ6N.45.36.D03.1.454.CMB.1.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (399)..(399): a, c, t, g, unknown or other
  misc_feature (399)..(399): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcacactgtctctgtctccaggggagacagccaccctctcatgcgaggccagtcagagtattagaacatacttggctggtatcaatacaagcctggaccagggtccccgntcccgtnagtctatgatgcttcagcaggccactggcagtccagcctaggtcaggtggcggtggttgctacagtacttcactcgtcacatcagcagccctacaacgtgtaaagtntttacgacgtacgttcttaagtttacctaggttacaaacgtacggtaccgttaaccgagttaacgttccggaccgttactaccgtaccggtttccgggacgggaaaccgggtaaccgtaagggttacggaacgtaacgtaccgaaacggtaacttgggtacgacgtacgccgtaacgtcgttaccg

SEQ ID NO: 111627 - DNA, 843 bp, Homo sapiens
  misc_feature: GYAE6OF01CN1BW.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtaggagtgtcagtaagtactaggctaggtaccaacagaaaccgtggaccaggcctccaggcctcctcactccaatcgatcgacatacccaacgtacgggtccctgggccgtacccaggaccgtacgggttcccggtggcgtagggttcggggtcgttacggggaactaggtacggtttaccaaccgttccgttacccgtaaccccggttccaacggtaccgacgggtacccgttacggggtaccgtaccccgttaggtaacgttggttaactttttcggaaccgtttaccggtttttaacctttccggtttacggttaccgtaacgggtcccgttaacgggttccccggtttaccccggtacccgtaaccccgggtccccgttacccgttttacccggttaacccggggtttttcccgggggggaccccgggggggggttaacccgttagggggggtaacggggtaaccggtaacgggttaacggggaaccgggttaaaccggggtaaccggtttggggtaaccggggttccgtaccgggtaaccccgtaacccgttacggttttacccgttaccggtttaccccgtttaccgtaacccgttttccccccggg

SEQ ID NO: 111628 - DNA, 842 bp, Homo sapiens
  misc_feature: GYAE6OF01CQWPX.45.36.D03.1.454.CMB.1.raw
  modified_base (205)..(205): a, c, t, g, unknown or other
  misc_feature (205)..(205): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaaccggaaaattgtgttgacacagtctccaggcaccctgtctctgtcctccgagggganacacgcccaccctctcctgccgacgggccaggtaggagtgtacgtagtaagttacgttaggcgtacggtaaccaacgaacgtaaaccgtggaccaacgggcctacccgaggtcctcctacactaccagtacgactcgacctactaacccgaaccggtacgggtaccctcgggaccccgttacccaaggtaccggtaacgggttccgtcggggtacgtacgggttcggggtacgtacggggaactaacgggtacgttacctaccgttacccgttacgaacccggttcgaccggaccgtacgggtacccgttacgggtaccgtaccgttgggtaacgttagtttacgttttagaccgttttacggttttttaccgtcgttacgtaccgtacggtacctaccgggttcccggttaccccgacccgttaacccggccccgtttacgttacccgggttccggggggtttacccgggggaccggggggttaaacgtacgggggttccgggaaaaggttacggttaccggggaaacgttaacccggggttaacgtttggggggaaccgttccgtaacccgggtacctaacccggtttcgttaccgggtttcttaacccgttaccgttcccgtttaaccccccgg

SEQ ID NO: 111629 - DNA, 692 bp, Homo sapiens
  misc_feature: GYAE6OF01DZ1JH.45.36.D03.1.454.CMB.1.raw
  modified_base (674)..(674): a, c, t, g, unknown or other
  misc_feature (674)..(674): n is a, c, g, or t
  modified_base (678)..(678): a, c, t, g, unknown or other
  misc_feature (678)..(678): n is a, c, g, or t
  modified_base (686)..(687): a, c, t, g, unknown or other
  misc_feature (686)..(687): n is a, c, g, or t
  modified_base (689)..(691): a, c, t, g, unknown or other
  misc_feature (689)..(691): n is a, c, g, or t
tcagacgcgatcgacacgaccggtgctcgattttagctgcgtcacgatctcgtcctgtgccagtaactttggtttccactgggtccgccaggttccaggcgaaggggcctggagtgggtcggcccctcgactttccgaagatggaagtgagaacggcctactcagactccgtgaaggccgcttcaccactctccagagactaacttccaagaatcgtccttcttttgacaaatgaatacgcctagagtagttcgaggaccgacgtctgtacttactttcgtgtcgaccggacggggtactacgttcgtagtgtacgttcgttacggttacgtaaggttacgttaactaacctaaccttaccttaaccttaccttcgtagtcggtacggttcggtacgggtaaccgtaaacgggtaccgtccggtaccgtacccgtccgtccgcgtacgtcctaccgaaccgtaaccggacctacgttccggtcccgttccccgtcggtcccgtccgtcgtcctaccgacgtacgccgtaccgtccgggtcgggaccacgaccggcccggtccgtcggtccgtcgtccgtacggtaaccgtaacgtaccttacgttcccgtcgtacgtccgtacgtcgtcggacggtccggtcgtcggtacgaccggtacgacgtaacgtgactnacgngcgtcacnncnnng

SEQ ID NO: 111630 - DNA, 881 bp, Homo sapiens
  misc_feature: GYAE6OF01APELL.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgtcttcttttaagaggtgtccagtgtcaggtgcaggtggtggaggtcggggggaggtcgttgtccgagtccgtggggtacgtccctggagtacctccgtccgtggtacgctacgtcccttcgtcggtactttccgtcccctcgtaaacgtttaaccgttttcgggtttcccaaccggttcgggttacccccgaccggtaacgggtttcccgaacggggtaccggaagggggtccgttagggggtacgggttccgggggttacccggtcccccgttacgttacgttttaccgggaaaacggttaggtagggtaaaggtacgggtaaacgggtaaaccggtccttaaccggtactacgggtaacccgttcccggtaggggaaaccgggtccctacgttacccgtaaccgtacgttaccctaccgaacggtaacgtaacccgtaaacttaaccgtaacggttaacgttaaccgtttcccgtttaccgtttttacaaaccgttaaacgtacggtaaacgttacgaccgttacgtaacggtaacgtacgggtaacggtaaccgtaaccggtttacgttaccgttacgtttaccgtttaccggttacgtaccgggttaacccggtaacgggggtacttacgttacggttaacgttacggtacgtttacgggtttacggttaccgttaaggttacgttaaacgtaccgttaaaacccg

SEQ ID NO: 111631 - DNA, 758 bp, Homo sapiens
  misc_feature: GYAE6OF01ENLW6.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctggggttttcctcgttgctctttagaggtgtccagtgtcaggtgcaggtggtgggaggtcggggggagcgttgtccaggccgtgggacggtcctgagactctcctgtgcagcctctgactctccctctagtactttcggttccacgtcggttacccgccgtacgggttccagggccgtaagggggcctgggtaggtcgggttcggaccctttcgagtttaccggaagacgtagggaacgtaggacggtaaacggtccttaacgtcgaacggtaccgtccggtacgggaaccgggtccgtacctttaccgaaccgtacttacccgtaccggaacggtaaacgtaaaccttaaacgtttaaccgtaaaggtaaccgtttaccggtttaccccttttaggaaccgtaaagtacggtaacgtacggtacgtacgggtaaggttacgggttacggaccggtacgttaccgttcgttacggttacttacgtttcggtacgggtacctacgatcgggtttaccagttccgttaaagtttcggtaacggtttaccgttacggggttttaccggttaaaggttacggtttaaaacgtacccgttaaaacccg

SEQ ID NO: 111632 - DNA, 539 bp, Homo sapiens
  misc_feature: GYAE6OF01B8V6E.45.36.D03.1.454.CMB.1.raw
  modified_base (291)..(291): a, c, t, g, unknown or other
  misc_feature (291)..(291): n is a, c, g, or t
  modified_base (368)..(368): a, c, t, g, unknown or other
  misc_feature (368)..(368): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctcctnatccatgatgcatccaacagggtccctggcgtcccagacaggttccgtggcagtgggtctgggacagagttcactcncacgtcagcagcctggagcctgatgtattttgctagtttacttctgtcagtcagtcgttcccgcctaacgcccgcttacgtacgtttcggtaccgggggggacctaggggtggacgatggaaggtacgaaacttaggtggcttgcaaccgtatactgtctttcattccccg

SEQ ID NO: 111633 - DNA, 661 bp, Homo sapiens
  misc_feature: GYAE6OF01EUQYU.45.36.D03.1.454.CMB.1.raw
  modified_base (369)..(369): a, c, t, g, unknown or other
  misc_feature (369)..(369): n is a, c, g, or t
  modified_base (438)..(438): a, c, t, g, unknown or other
  misc_feature (438)..(438): n is a, c, g, or t
  modified_base (474)..(474): a, c, t, g, unknown or other
  misc_feature (474)..(474): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtacagtaagtacttaggctaggtaccaacgagaaacctggccaagggcctacccgaggtcctcctcactccatgatcggcacgtaccaacgacgggtcccctggccgtcccaaggaccgtacgggttccggnggaccgtaggttcgggtcgtaggggacaggtacgttcactcgtaccaccggtcagccagtcctgggacnccgtgacttgttacttttggttacgttttaccgttntacgttcacggtactacggtccgttacccgcctaccggccgtacgttcccgtaccggttttaccgggggaccggggggttaccgtaggggtacggtaaggtacgtagggaacgtaaaccgggtacgtgggtacgtcgtcggccctaacgcgtttaccgtggttacccttacgtcttcccgtaccccg

SEQ ID NO: 111634 - DNA, 767 bp, Homo sapiens
  misc_feature: GYAE6OF01CWHAK.45.36.D03.1.454.CMB.1.raw
tcagacgcgatcgacacgaccggtgctcgatttagctgcgtcacgatctctcttgggggaggaactgctcagttaggacccaggagggaaccatggaagccccagctcagcttctcttcctcctgctactctggctcccagataccaaccggaaaaattgtgttgacacagtctccagcaccctgtctctgtctccgaggggagacacgcccaccctctcctgcgagggccaggtaggagtgtacaagttaagtacttaggccgtaggtaacccaaacgacggaaaaccgtgggacccgacggcctcccgaggtcctcctcactccgaagtgatcgacactaccgacggtaccgggtccctgggtcccgtcccgagaccggtacgggttccggcggtcgtagggtcggggtacgtagggacgtaggtacgttcaccgtccgtacgaccgtcgacgcgtacgtccgtggaccgtcgtagtattcgttattttcgtacgtttagttttacgttcgttacgtccgacgtccgtaacgtcccggtttacccgacccgtacccggcccggtcccgttaccggttacccggggtttacccggggggaccggggggttaccggtaagggggtacgggtaacggttaagggtaccgggtaacgggtaaaccggtaccggggttaggttacgggtacccttaccgggtaccccgtaacccggtacgttttccccggttaggtttacccctttcccggtaaccgtttcccccccggg

SEQ ID NO: 111635 - DNA, 226 bp, Homo sapiens
  misc_feature: GYAE6OF01A2ZKQ.45.36.D03.1.454.CMB.1.raw
  modified_base (219)..(226): a, c, t, g, unknown or other
  misc_feature (219)..(226): n is a, c, g, or t
tcagacgcgatcgacacgaccggtgctcgatttagctgcgtcacgatctctcttgggggaggaactgctcagttaggacccagacggaaccatggaagccccagcgcagcttctcctcctcctgctactctggctcccaggaactgtggctgcaccatctgtcttcatcttcccgccatctgatcgatcgcgtctgagcgggctggcaaggcgcatagnnnnnnnn

SEQ ID NO: 111636 - DNA, 761 bp, Homo sapiens
  misc_feature: GYAE6OF01BZDMJ.45.36.D03.1.454.CMB.1.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgcccaccctctcctgcgagggcctaggtaggngtgtcgagtaagttacgtaggctacggtaaccaacgaacgtaaaccgtggccaacgggtcctacccgacggtcctccgtaccactcccagtcggatcgacactacccgaaacgcgggttcccctaggcccgtaccgagaccgtacggttccggtggaccgtaggttcgggtcgtaggggacctagggtacgttccacttccgtaccgtaccgtacgacgtccgacggtccgttagggaccgtccgtaggtatttcggttaattttcggacgtttacgttttacgttcgttgtccgaggtccgtacggttcccggttacccgaccgtaccggcccgttccgttacccggttaccggggtttcccgggggaccgggggtacccgttagggggtaccggttaacgacgggttaaccgggaacggtaacccgggtaaacgggtttcgggtaccgggtccgttaccgggacccttaaccccggtagttcccgttacgggtttacccttcccgttacccgtttacccccg

SEQ ID NO: 111637 - DNA, 778 bp, Homo sapiens
  misc_feature: GYAE6OF01C93AG.45.36.D03.1.454.CMB.1.raw
  modified_base (237)..(237): a, c, t, g, unknown or other
  misc_feature (237)..(237): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctccaggccaccctgtctctgtctccgagggacgacacgcccaccctctcctgcgacggccaggtagngtgtcagtaagtacgtacggctacggtaaccaacgaacgaaaccgtcggacccacgggtcccttacccgacggtccttcccgtacacttaccagttacggactcggacctaccgttaacccgaaaccggtcggggttcccctcgggtacccgtaccccgaaggtacccgttacggggttcccggtggaccgtagggttcgggtcgtacggggaactaaggttaacggtttccaaccgtttccgtaccgtaacccggttcaaaccggtccgtaaccgggtcccggtagggtaacccgtccgttaggtaacgtttaggttaacgttttcgtaccgtttaacgttttaccgttcgttacgtccgtagtccgtacggtcccgttcccgcgtacccgtccgtaccgtccggtacgggtttccggggacgggggtacggtacggggtaggtacggtacggtacggtaaggtacgggtaaccgtgggtacggtcgtacgtacccgtaaccgttcgttcgttacggtttccttcccgttcgtcccccgg

SEQ ID NO: 111638 - DNA, 925 bp, Homo sapiens
  misc_feature: GYAE6OF01ES0IY.45.36.D03.1.454.CMB.1.raw
  modified_base (182)..(182): a, c, t, g, unknown or other
  misc_feature (182)..(182): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagnggtgtccagtgtcgaggtgcagggtgggtgggaggtcggggggagcggttgtccaggccgtggggacggtccctgacgactctcccgtgtgcacgcctcgtggtacttcctcccctgtaacgttaaccgttttcggtttaccaccgtttcggggtcccgaccgtacgggttcccgaacgggcggtaaacgggggcgttggggtacgggtttcggggtacccgggtccccgttaccgtacgtttttacccgggaaaggtacgttaaggggaacggttagggaacgggtaaaccgggaccctttaaccgtaccgtaacgggtacccgttaccccggggttaagggtaacccggggtccccgttaccctttacccggaacccgttaccgttaacccccgtacccggaacggtaaaccgtaaacccgttaaacgtttaacccgaaaacggttaaacgtttcccgtttaccccgtttttacgttttttaccgaacgttaaaagttaccggtaaacgttaccggtaccgttaagggtaacgggttaacggtttaagggaaccgggttaaccgttaaccggtttcgttacggtttacgttttaaccgttttcggttaccggttacggacccggggttacggggggtaaaccttaggttaccgttaaggttaccggttaacgggtttccgggtttacgggtttaccgggtttaaacggtttacggttaaaccgttaacccgttaaaacccg

SEQ ID NO: 111639 - DNA, 666 bp, Homo sapiens
  misc_feature: GYAE6OF01EVG57.45.36.D03.1.454.CMB.1.raw
  modified_base (206)..(206): a, c, t, g, unknown or other
  misc_feature (206)..(206): n is a, c, g, or t
  modified_base (592)..(592): a, c, t, g, unknown or other
  misc_feature (592)..(592): n is a, c, g, or t
  modified_base (638)..(638): a, c, t, g, unknown or other
  misc_feature (638)..(638): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcctcccagataccaaccggaaaaattgtgttgacacagtctccaggccaccctgtctctgtctccgagggganacagcccaccctctcctgcgacgggccaggtaggagtgtcgaagttaacgttacttaggcgttacggtaaccaaacaacgaaaccgtcggaccgacggtaccctcccgaggccttcctacactccgatcgtatcgaccactaccgtaacggccgggtccctcggacccgttacccgagtaccgttacgggtccgtaggacgtagggtcgggtcgtgggactaggtacgttcactcctcgtaccgtcgacgccgacgccgtaggaccgtcgtagtacgttgttacgtttcgtacgtttacgtttcctttcgttactgacgtccgtacgtcccgtcccgcctaccgtccgtccgtacgttccgggttccgggggaccggggtaccggngggtaggacggagtacggaacggtacgtacggtgcggtcgccgacnccgtacgttcgtattctcctcgtccccg

SEQ ID NO: 111640 - DNA, 768 bp, Homo sapiens
  misc_feature: GYAE6OF01C85RC.45.36.D03.1.454.CMB.1.raw
  modified_base (619)..(619): a, c, t, g, unknown or other
  misc_feature (619)..(619): n is a, c, g, or t
  modified_base (639)..(639): a, c, t, g, unknown or other
  misc_feature (639)..(639): n is a, c, g, or t
  modified_base (650)..(650): a, c, t, g, unknown or other
  misc_feature (650)..(650): n is a, c, g, or t
  modified_base (690)..(690): a, c, t, g, unknown or other
  misc_feature (690)..(690): n is a, c, g, or t
  modified_base (719)..(719): a, c, t, g, unknown or other
  misc_feature (719)..(719): n is a, c, g, or t
  modified_base (748)..(748): a, c, t, g, unknown or other
  misc_feature (748)..(748): n is a, c, g, or t
  modified_base (756)..(756): a, c, t, g, unknown or other
  misc_feature (756)..(756): n is a, c, g, or t
tcagacgcgatcgacacgaccggtgctcgatttagctgcgtcacgatctctcttggggaggaactgctcagttaggacccagagggaaccatggaacgcccccagcctcagtcttcctcttccctcctgctactcgtcgcctcccagtactaacccgaaacggtaaaattgttagtacgacactacgtcctccgacggacctaccctgtcctcgttcgtcctaccgggaggggacacgaccgacccctaccctcctccgtcggaccggtacgggaccgaggtacggtagttacgtacgtaaggttaacgttacggttacggtaccgtaacggtaaaaccaaaccggaaacgtaaacccggtcggtaacccgaccggtaccctacccggaccggtccttacctacctacctaccgtagtacgtacgtacgacctaaccgtaccgaaccggtaccgggtcccgtacggcccgtaaccgagtacccggttcggtcggtacggtaggtcggttcgggtaccggtaggtaacctacggttaccgttccaccggttcctaccgaccgtacacgccgtacgtcgtcggacgtacgtgtattgtttacttgactttctttctgtacnccgagttaccgcgttacccnccgcggtaccnccgttcgttaccgggtacgggtccgggggcgtacggcggngaacgttggaccggtacaacgggttacgnggtaccgcgttacaccgacttgttacgtntttcccgnttccccgtaccg

SEQ ID NO: 111641 - DNA, 722 bp, Homo sapiens
  misc_feature: GYAE6OF01CYMK7.45.36.D03.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
tcagacgcgatcgacacgaccggtgctcgatttagctgcgtcacgagtctctcttgggggaggaactgctcagttaggacccagagggaaccatggaagccccagctcagcttctcttcctcctgctactctggctcccagataccaccggaaaaattgtgttgacacagtctccaggcaccctgtctgtgtctccgagggagagngtcaccctntcctgcacggccagtcaaagtgttcgcaccgatacttagctggtaccagcagacgacctggaccaggccctcccgacggccttaccctcgacttctagtcggttgacgtactcctaccgagggtccctcgtcggtcgtccccgcgtaggttacaggttcggacgaggttcgggtacgtcgggactacggtcgtttaccacttccgtacccgacctagtaccgacgccgaacgccccgttagacctaacggttctagggtaaagttacgttttcggaaccgtttaattttaacgtttagtttcgtacgttagtactaatttaaacgttagtacgtccgtacgggaccctttaggggtaccccgtttaccggggacccgtaaggggtaccccgttaaggggttaacgaaaaacgttacccggtaaaaacggttaccggttacgggtaaccgggttacgtaccgggtaaccttaacccgggttacttaacccggtttggtttaacccccg

SEQ ID NO: 111642 - DNA, 717 bp, Homo sapiens
  misc_feature: GYAE6OF01CCGOC.45.36.D03.1.454.CMB.1.raw
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
  modified_base (474)..(474): a, c, t, g, unknown or other
  misc_feature (474)..(474): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacggaaaattgtgttgacacagtctccaggcaccctgtctctgtctccgagggganacacgcccaccctctcctgcgacgggccaggtaggagtgtacaggttaagtacgttaggcgtaggtaaccaacgagaaaccgtggccaggcctccgaggcctacctcactccagtcgatcgctactacccgaacgtacgggtccctggtaccgacccgaaggtaccgacgggtttcccggnggcgtacgggtcgggtcggtacgggacgtaggtacgtcctactcgtccgaaccgtcgacgtcgacggtccgtgggactccgtagtacggttnttaacgtttgacgtttacggtttacttcgtagtaccgtacgccgttaacggccccgtttacccgccgtaaccggtccccgttcggttacccgttaccgggggtttccgggggaaccgggggtaccgtagggggtacgacgggttagtaccggaaacgggtaccggttaacggttcgggcggtaccggttaccgccttaaaccggttgttcccgtacggtttccttcccgtaacgttcccccgg

SEQ ID NO: 111643 - DNA, 712 bp, Homo sapiens
  misc_feature: GYAE6OF01A0JGQ.45.36.D03.1.454.CMB.1.raw
tcagacgcgatcgacacgaccggtgctcgatttagctgcgtcacgatctctcttggggaggaactgctcagttaggacccagagggaaccatggaagcccagctcagcttctcttcctcctgctactctggctccagataccaaccggaaaattgtgttgacacagtctccaggccaccctgtctcgtgtcctccgaggggtacacgacgcccacccgtctccctggccgacgggccaaggtacggagtgtaccagttaacgtacgttaggaccgtaggtaccaacgaacgtaaaccgtggaccaaggcctccgaggctaccgtcatccatcgatcgcacgtaccaacgccggtcctggcccgtacacgtaccgtacggtccggtagccgtaggtcgggtcgtagggaactacggtgtccaacgttcgtaccgacgtctaggccgtaagcccgttgggaacctccgtagtacgttgtaagttttccgacgtttaaggtttcccttcgttagggccacggttaccgtacgtcccgttcccgaccggtcccggtccgtaccgttcggttaaccggtttaccggggggcgggaacccgtgggggtccgtaagaccggtacggtaaacgacccggttaggttcggggactccgggtaccgaacctttaaccgggcgttaccgtttaccgttaccttccggtacccgtttaccccgg

SEQ ID NO: 111644 - DNA, 733 bp, Homo sapiens
  misc_feature: GYAE6OF01BA290.45.36.D03.1.454.CMB.1.raw
  modified_base (450)..(450): a, c, t, g, unknown or other
  misc_feature (450)..(450): n is a, c, g, or t
  modified_base (560)..(560): a, c, t, g, unknown or other
  misc_feature (560)..(560): n is a, c, g, or t
tcagacgcgatcgacacgaccggtgctcgatttagctgcgtcacgatctctcgttgggggaggaactgctcagttaggacccagagggaaccatggaagccccagctcagcttctcttcctcctgctactctggcctcccagactaccaaccggtaaaattgtgttgacacgagtctccgaggccaccgtgtctctcgtctaccgaggggacacacgcccaccctctccgtcgcgacggaccgtaggtacggagtcgtacgtaaggttaagtacgttaggacgtacggtaaccaaacgaacgtaaaccgtcggaccgacggacctaccggacggtcctacctactacgtacctaatcgatcgactaacctaccgaacgtacgggtccctggtacccgtaccgacgacggtacggttccgacggtacgtagggttcgggtacgtacggaanacggttacttccgaccgttacctaccggaccgtacgacgaccgtacggtacccgtaggtacgtcgtataacgttgtttacgtttagtctttaagtttaccgtgtacgttnaacgtctccgtcgttacccgaccgtcgcccgtcgttacccggtaccgggttacggggccgggtacggtaacgggaacggtaaggacgtacggaaacggtaacccggtagtccgggttacggacgtaccgactacccgtacttacggttactacgtttccgaccgtttaccccg

SEQ ID NO: 111645 - DNA, 848 bp, Homo sapiens
  misc_feature: GYAE6OF01CBBX6.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaacccaccggtaaaaattggtgttgacacagtctccaggccaccctgtctctgtctccgaggggacacacgccaccctctcctgcgacgggcctaggtacggagtgtacgtagtaagtacttaggccgtaggtaacccaaacgaacggaaaccgtggaccgaacgggtcctacccgaggtcctccctcgaactccaagtgacgtacgctaactaccgaaacgtacgggttcccgtggacccgtccgaagtaccggtaccgggttcgtcggacgtagggtccgggtcgtaacgggacgtaggtacgtccgtaccgttacctacccggaaccgttacgacgccgtaacggtcccggttagggaccggtaccgttacggacggttacgttagtttttacgtaccgtttaacgttttacgtttccgttcgtaccgtacgtaccggtacccggttccggtttccccggaacccgtcccggtacccgtccggttacccggtaacccgggtttaccggggacccggggggggtaaccgtaacggggggttacgggaacgggttaacggtacgggtaaaccggggtaaaccgggtaaccgggtttacggggacccggggttaacggttacccgggaaacccggtttaaccggtaacccgtttacccggttaccggtttaacccgtttcccgtaacccggttttacccccccgg

SEQ ID NO: 111646 - DNA, 875 bp, Homo sapiens
  misc_feature: GYAE6OF01E3NJC.45.36.D03.1.454.CMB.1.raw
  modified_base (126)..(126): a, c, t, g, unknown or other
  misc_feature (126)..(126): n is a, c, g, or t
  modified_base (168)..(168): a, c, t, g, unknown or other
  misc_feature (168)..(168): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggnggcgttgtccagccgtgggaggtccctgagactctcctggtncagcctctggattctccctcagttaacttttcggtttccacgtcgggttcccgccgacggtttcccaggcgaacggggtctgggagtggggtcggtccctctacgttttccgaagtagtggaagtgaaggacggtcctacgtcgaagaccgttcccggtaggtaacgggcccgtccgtttaccaccactcctacccagacgaacctaacttaccaaagaactccgttaccttttcttttttacgtactaaacgtgtaaacgttacgaccgtaggaaggtacggtttaggaacggtaaccgtaccggttctttacgttcgtttaactttcgttggtaccggaccggtaacgggggtacctattacgttaggtcgttaacggttcgtttcggtttaccggttaagtttacgttaacgttaccttaaaccttaccttaaccttacccgtacgtaacggttaccggtaccggttaccgggtacggggggtaaccgtaaaccggggtacccgtacccgggttcccgtaacccggttcccgtccccggaccgtaaccgtcccgtttacccgaaacccggtaaccgggtaccccccgttaacggtttccccgggtttacccccgttccccccgggtccggtccccgttacccccggttcccgtacccggttaccccggaaccgggtaaccgtcccggtcccggttacccggggg

SEQ ID NO: 111647 - DNA, 620 bp, Homo sapiens
  misc_feature: GYAE6OF01AMWHM.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgccagggccagtaggagtgtcagtaagtacttaggctggtaccaacgagaaacctggccaggtcctcccgaggctcctcatccatgatgcatccaacgacgggtccctggccgtacccgagaccgtacgggttccgtggctaggttcggggtctcgggacaggtacgttcactctcaccgtcagcagcctgggactccgtgattgtacttttcgacttagtttacttcgtcgtacacggtctacggtccgttacccgccgtaccgtcccgtccgtccgttaccggtttccggggaccgggggtaccgtaggggtcggacggtacgtacggaacggaccggtaacgtgggtcggtcgtcggaccgtacccgtacgttccgtacgttccttcgtacgttccccg

SEQ ID NO: 111648 - DNA, 682 bp, Homo sapiens
  misc_feature: GYAE6OF01B1JB0.45.36.D03.1.454.CMB.1.raw
  modified_base (166)..(166): a, c, t, g, unknown or other
  misc_feature (166)..(166): n is a, c, g, or t
  modified_base (351)..(351): a, c, t, g, unknown or other
  misc_feature (351)..(351): n is a, c, g, or t
tcagacgcgatcgacacgaccggtgctcgatttagctgcgtcacgagtctctcttgggggaggaactgctcagttaggacccagagggaaccatggaagccccagctcagcttctcttcctcctgctactctggctcccagactaaccaaccggaaaattgtgttnacacagtctccagcacctgtctctgtcctccgaggggacacacgcccaccctctcctgcgagggccaggtaggagtgtacgagtaagtacgttaggctacggtaaccaacgacgaaaccgtggacccaaggcctacccgaggtcctcctacactccatgatcgccactacccgaagcgggtcccnggtccgtacccaggacgtacgggttccgacgtcgaggtcggtcgtagggacagtcgttacacttccgacctaccgtcacgtccgacgtccggtaggaccgtccgtaggtaacttgttaacgttttcgcgtttaacgttttacttcgttacgtctacgtccgtacgttcccgttaccgccgtaccgtccgtaccgtcggttacccgggttccgggggacgggggtacccgtaggggccggtaaggtacgtacgggaacggtaaacggtccggttaggtcgggtcctacgaccgtacgttacgttcgttacgttccttcccgactttccccgg

SEQ ID NO: 111649 - DNA, 947 bp, Homo sapiens
  misc_feature: GYAE6OF01DK0QI.45.36.D03.1.454.CMB.1.raw
  modified_base (192)..(192): a, c, t, g, unknown or other
  misc_feature (192)..(192): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
tcagacgcgatcgacacgaccggtgctcgatttagctgcgtcacgatctctcttggggggaggaactgctcagttaggacccagagggaaccatggaagccccagctcagcttctccttcctcctgctactctcggctcccagactacccgaaccggtaaaaattgtgttgacacagtcctcaggcaccctntctctgtctccgaggganacncgcccacctctctgcgacggccgagtaggagtcgtactaagtaacgtacgttaggtcgtacggtaaccaaaccgaacgtaaacccgtcgggacccgtaacggtaccctacccgacggtcccctacctaccacttaccgtaatagactcgacctaaccgtacccgaaaccggtccggggttccctaccgggtacccgtaaccccggacgtaacccggtacgggttccccggtagggtaccgtacggggttacggggttaccggtaacggggtaacaacgggtttaccgtaccctaaccgttcccgtaccccggtaaccggtccgacggaccgtaccggtaccggttacgggtaccggtacccgtaggttacgttaacggtttacgttttaacggtaccgttttaacgttttacccgttacggttaccggttaccgtaccggtaccggtaaccggttaccccgggttaccccggtacccggtacccggtacccggttacccgtttcccggggttaacccggggttttcccgggggggaacccgggggttaacccggggtagggggttaaccggggtaaaggtaaccggggtaaccgggtaaacggggttaaccgggttaaaccgggttacggggttaccggggtaaccgttacccgggtaaacccgttaacccgggttaacgtttcccggtttaaccggttttcccgtttaacccgttacccggtttaccccccgg

SEQ ID NO: 111650 - DNA, 690 bp, Homo sapiens
  misc_feature: GYAE6OF01CFYK0.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctcgaggganacagcccaccctctcctgccgagggccaggtaggagtgtcagtaagtacgttggactggtaccaacacgaaaccgtggccacgggcctcccgaggcccttcctcgactccatacgatgcctaactaccgaaacgtcggggttcccctgggccccgtacccgaggtaccgtaggtttcccggtggccgtaggtcggggtctgggacacggtacgttcactccgtacgaccgttagacgcacgtcgtcggacgtccttaggcttagtacttttacgctttacgttttacttcgttacgtaccgtagtacccgtacgtcccggtttacccgccgtacccgggtcccacgtttcccggtaccgggtttccgggggaacccggggtacccggtaggggttcgaacggtacgtacgggaacgtacggtaacgttgggtaccggtcgtacgggacctaccggtacttcgtaccgtttcttcccgtcctttaccccg

SEQ ID NO: 111651 - DNA, 716 bp, Homo sapiens
  misc_feature: GYAE6OF01CIY0V.45.36.D03.1.454.CMB.1.raw
tcagacgcgatcgacacgaccggtgctcgatttagctgcgtcacgatctctcgttgggggaggaactgctcagttaggacccagagggaaccatggaacgccccagctcagcttctcttcctcctggcactctggctcccagactaccaccggagaaattgtgttgacacagtctccagccctacccttgttctttcgttaccgaaggggaaacgcgcccacctctccgtgcgagggccagtcgagggtataacagtctacgtcgctaggtaaccaaaacgtaaaaccgtcggaccacggtcctacccgaggtcctcactactactcgtaagtcgaccgcacgtaccgaacgacgggaccagtccggaccacgtacccgacgtccgaggttacgaggtacggtccgtagggtcgggtcggtagggactacgtaccttacgtacctttccgacctaactactacgacggcctacgtcccggtacgggtaccctagggttaacggtttctttacccggactttaacgttttaccgtacgtttcgaacggtagccgtacgggtcgggtacgacccgggtacgccgtcgtacccgtacggtacggttccgggggacgaaccggggtaacgtagggtagtaaccgaacgttaaaccgtaaacgggtggttcgggctaccgcgacttcccgtattcccgttatccttaagtcccgttacccg

SEQ ID NO: 111652 - DNA, 652 bp, Homo sapiens
  misc_feature: GYAE6OF01DB84G.45.36.D03.1.454.CMB.1.raw
  modified_base (442)..(442): a, c, t, g, unknown or other
  misc_feature (442)..(442): n is a, c, g, or t
  modified_base (594)..(594): a, c, t, g, unknown or other
  misc_feature (594)..(594): n is a, c, g, or t
  modified_base (633)..(633): a, c, t, g, unknown or other
  misc_feature (633)..(633): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctcaggcacctgtctctgtctccgaggggagacacgcccaccctctcctgcgagggccagtaggagtgtacaagtaagtacgtaggctaggtaaccaacgaacgaaaccgtggaccaacgggtcctacccgaggtcctccctacactccatcgactcgaccactacccgaacggtacgggtcccctagggccgtacccgagaaccgtacggttccggtaggcgtacgggtgggtacgtggggaactagtcgttccacgtcctacgacccggtanacggccagtccgtaggaccgtccgttagacgttgttagttttcgtacgtttacgtttacctcgttactccgagtaccgtacgtcccgttacccgcgaccgtccgtaccgttacgttccgggttcggggacggggtacgtacgggtaggacgngtaggacgacgtacgtggtcgctacgcgtacgtcttcgngtttcctagtccgttcccg

SEQ ID NO: 111653 - DNA, 919 bp, Homo sapiens
  misc_feature: GYAE6OF01DHQR3.45.36.D03.1.454.CMB.1.raw
  modified_base (111)..(111): a, c, t, g, unknown or other
  misc_feature (111)..(111): n is a, c, g, or t
  modified_base (198)..(198): a, c, t, g, unknown or other
  misc_feature (198)..(198): n is a, c, g, or t
tcagacgcgatcgacacgaccggtgctcgatttagctgcgtcacgatctctcgttggggagctctgggagacgagcccagcactggaagtcgccggttgtttccttcggtnatcatcactgaacacagagactcaccagtggtactttgggcttacgtccgttgggttttcctcggttgtcctttacgttttaaaggnggttcgtcctaggtcgtacgtaggtcgacggtagggttgggtggggtacggggtcggggggagtcggttcggtaccgacggtccggtggggtaccgtcccgtaggacgtcctccttccgtggtcgcctacgtccttcgtcgttaccttccgtcccgtagttaacgtttacgtttccggtaccgtacggttcgggtacccgccggtacggttaccgacgggtacggtaacggggtcggttacgggacgggttcgggtccgttccccgttacgttaacggtttaaccgggaaaggttacggttaacgggtaaagggttacggaaaccgggtaaccggttacccgtaaccggtacggtaaccggttaacccggttaccgggtaaccgggtaaacccgggttcccgttaccttaaccccggtacccttaccggttaacccgtaaccggaacggtaaacccgttaaacgttaaccccgttaaacgaaaccggtttacgtttacccggttttacctttaccggttttaaagaaaccgttaaacgtacgttaaacggttacgaaccgtttaaggaacgttaggtaaccggaacgttacgttaccggttactttacgttacggtttacgttcggtacgggtacgtaaccggggaaggttactacgttaacgtggtacggttacgtttcggttacggttacgttagttaaacgttagtaacccgttaacg

SEQ ID NO: 111654 - DNA, 817 bp, Homo sapiens
  misc_feature: GYAE6OF01C9O4A.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgagtctctcttgggggagaactgctcagttaggacccagagggaaccatggaagccccagctcagcttctccttcctcctgctactctggctcccagactaccacggaaaattgtgttgacacagtctccaggccacctgtctctgtctccgagggganacagcccaccctctcctgccagggccaggtaggagtcgtacaggttaacgtacttaggctaggtaaccaacaacgaaacctggacccaaggcctacccgaaggtcctacctacacgtcccaattcggataggcctaacgtacccgaaacggtacgggtccccgttagggcccgttaaccccagggtaaaccctacggggtttcccgtacggggccgtaacgggttcgggggttaccgtaggggacctaaagggtccggtttacaacccgttccgttaacccgacccggttactaacgggacgttaaccgggtcccgttacggggaccggtacccgttaggtactttacggtttaacgtttttcggtaccgtttacggtttttaacctttcgttacggttacgtacggtaccgttaccggtacccgtttccccggaccgttaaccccggacccggtacccgtttacccgttaccgggttttaccgggggcccgggggggttaacccgtacgggggttagggtaaccggtaggacggtaaccggaacggtaaacgtcgggttacggtccgtacggtacctaccggtacttccgttcgttacttccgtcgttacccg

SEQ ID NO: 111655 - DNA, 941 bp, Homo sapiens
  misc_feature: GYAE6OF01C8HRI.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttccctcctgctactctgctcccagataccaaccggaaaattgtgttgacacagtctccgaggcaccctgtctctgtctccgagggganacacgcccacccttctcctgccgacgggccaggtaacgggagtacgtacgtaaggttaaacgttaccgttaggccgttaggtaaaccccaacgaaaggtaaaacccgttcgggacccgtaacgggccctaccccgaaggcccttaccctacctacttacccgagttacgactacgtaccgaacttaccccggaaacggttaccggggtcccccgtcgggtaccccggtaccccgacggtaaccggttaccggggtttccggtcgggtcgtaccggggtttagggggtacccggttaggggaaccgttacggttaaccgtttccgaacccgtttaccgtacccgaaaccccggttcgaaccgccgtacggtacccgtacgggaccgtaccgtaggtactttacgggtttacttttcgtaaccgtttacggtttttacctttacgttacggttaccgtaacggtcccgggttaacggtcccccggtttacccggaccccgtaaccccgggtccccggttaccccgtttacccgggttaccccgggggtttaaccggggggtccccggggggggggttaacccgtaggggggttaccgggtaaacgggtacggtaaccgggtaaaggggtaacccggtaaccgggttacgggttcccggtacccggttaaccggaacccgttaccggtttaaccggtttcccgttacccgtttccgtttaccctcccggttttacccccg

SEQ ID NO: 111656 - DNA, 780 bp, Homo sapiens
  misc_feature: GYAE6OF01B17K4.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccacctctcctgcgagggccagtaggagtgtacaagttaagtacgttaggctaggtaaccaacagaaacctggaccaggcctccgaggcctcctcagtccatgatcgcactccaacgtacggtcccgtggacccgtacccaggaccgtacgggttccggtaggccgtaagggtcggggtaccgtaggggaactaggtaacggtttccaaccgtttccgtacccgtaacccgtacgaacgcccgtaacggtccgtacgggacgtccgttaggtacttaggttattttcgacgtttacggttttacttccgttacggttaccgtacggtaccgtaacggttccggtttaccccggaccgtaacccggtccccgtccgtttacccgttaacccggggttttcccggggggacccgggggggttaacccggtacggggggtacggtaacgggtaaccggttagggaaaccgggtaaccgggtaaccggttaggggtcgggttacccggtacgtaccccgtaaccgtttaaccgttccgtttaccggtttaccctttcgtaacccgttttcccccgg

SEQ ID NO: 111657 - DNA, 781 bp, Homo sapiens
  misc_feature: GYAE6OF01BTJTY.45.36.D03.1.454.CMB.1.raw
tcagacgcgatcgacacgaccggtgctcgatttagctgcgtcacgatctctcttggggagctctgggagacgagcccagcactggaagtcgccggttgtttccttcggtgatcatcactgaacacagaggactcaccatggtactttgggctgtaccttgggttttccctcgttgtcttacttttaaggaggttgtccgagttgtcgagggtgcgtagggtgggtgggagggtcggggggaggtcgttgtccgaggtccgtggggacggttcccgtgacgtaccttcctccgtgtgcacgtcctcgtggtacttccgtccctgtaacgttaacgttttcggttccctacggttccggggtccccgaccgtacggttaccgacgggaccggtaaggggtccgtaggggtacgggttcggggttccggccccgttacgtacgtttaccggaaggtaacggttagggaagtaggaacgggtaaccggtacctaaccgtacgacggtccgtccggtagggacggtccctacttaccacctacgtccgtacgaagacgtaactaactacgaagtacgttccgttacctttagtttacgaacttaagtacgttaaacgtcgtaccgtgtaaggtacgttaggacggtactacggtttacttagttacgttactttccggtgttaccggacgggtacgggtaacgttacgttacggttaggttcgtaacggtttacggtttacgggttaacgtttaaggttaactttaaacgtacccgttaaaacccg

SEQ ID NO: 111658 - DNA, 863 bp, Homo sapiens
  misc_feature: GYAE6OF01DT2UF.45.36.D03.1.454.CMB.1.raw
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagatacccaaccggaaaattgtgttgacacagtctccaggccaccctgtctctgtctccgagggganacncgcccaccctctcctgcgagggccaggtaggagtgtacagttaagtacgttaggctaggtaaccaaacgaacgaaaccgtcgggaccacggtccctacccgaggtccctccgtacaccttccaagttcgtaactcggactaaccgttaaccccgaacggtccggggttcccctacgggccccgtaaccccgaggtaaccgtaccgggttccggtggacgtaggggttcggggtacgtacggggactaggttacgttccgaaccgttccgtacccgtaaccggtcgaaccggacgtacggtaccgtcgggaccgtcccgttagtacgttacggtttagtttacggttacgtttacgttttacttcgttacgtccgacgttaccgtaccggttccccgttacccggtccccggtacccgtaccccgttacccggtttacccgggtttaccccgggggttttaccgggggggaccccggggggggttaacccgggtacggggggttacgggtaacgggttaacgggtaaccggggtaacgggtaaacccggtaacgggttccgggttaacgggtcccggttaacccggtacccgtaaacccgttcggttaacccggtttcgtttaaccccgtttccgttacccgtttaccccccggg

SEQ ID NO: 111659 - DNA, 798 bp, Homo sapiens
  misc_feature: GYAE6OF01C765J.45.36.D03.1.454.CMB.1.raw
  modified_base (69)..(69): a, c, t, g, unknown or other
  misc_feature (69)..(69): n is a, c, g, or t
tcagacgcgatcgacacgaccggtgctcgatttagctgcgtcacgatctctcttggggaggaactgctnagttaggacccagagggaaccatggaacgccccagctcacgcttccttccttcctcctgctactctggcctcccagactaccgaacggtaaaattgtgttagacactagtcctaccgacggcctaccctgttcctctcgtccgtaccggagggagaccaccgcccaccctctccgcgaccggacggaccgtaggtaggagttcgtacgtaagttaacgttacgtacggtcgtaacgtaaccaacgaacggtaaaccgtcggaccgacggtaccctccgacggtacctacccgtctactccgtatcgagtcgacctaaccgtaccgaacccggtacggtcccgtacgtcccgaccacgtacggtaccggttcggacggcgtagggtcggtacggaggacgtacggtacttcgactaccgtaccgaccgtactcggacgtacgtcgtacggacggtaccgtagtacttaggtttcttacgtcgtttacgtttccgttgtacgtacgcggtccgttaccggtccgtacccgccgtacccggtcccttacccggttacccggttcccggggttaccggggggaccgggggtaccgggtaacggggtacgggtaacggacgtacgggaacggtaccgggttaaacggtccgggttaacgggtcccgtaccgggtaacccttacgttacggttacccgttacgtttccgaaacccgtttcccggtttaaccccgg

SEQ ID NO: 111660 - DNA, 724 bp, Homo sapiens
  misc_feature: GYAE6OF01A3H87.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtactaggctggtaccaacagaaacctggaccaggctcccgaggctcctcatcccatgatgccatcccaacgacggggtccccttgggacccgtccccaggaccgtacgggtttccctggaaccgtaggttcggggtaccgtgggggaacctaggtaaacggttttcccaaccgttcccgttaccgaaccccggttccgaacggtcccgaacggtcccgttgggacgccgtagtacgttcggtattttcggacgttacgttttaacctcgtttaggtacctaggcctacggtccggtttacccggccgtaaccggtcccgtccgttaccgttaacccggttttccgggggacccggggggtacccggtagggggtcgggtaacggtacggtacgggaaccgggaccggtaacggttcgggtacgggtccgtcggtaccacccggtacttccgttacttcccgtttcgtaccgttccccg

SEQ ID NO: 111661 - DNA, 657 bp, Homo sapiens
  misc_feature: GYAE6OF01CYACS.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctctgctactctggctcccagataccaccggagaaattgtcttgacacagtctccagccattctgtctctctctccgaggggacacacgccacctctcatcgcgagggccagtcaagtagtattagaacatacgttggccttggtactacaataacgaacgccgtagggcccggacggggtcccccggcttccctactatctaatgtatcgtccttccgacgccgtacgggcccacgtcggccacgtcccagccgtaggttcgagggtgggtcgggtggggtttgctacgacgtcctttccgacttcctaaccaacgtactcgacgtcaccgtcctacctaacgtgtaagttcgtttgactagttacttaattacctagttacaacgtacgtacgttaacgtaggtaccgttacggtccgtaccgttaccgttaaccggttaccggggaccgggtaacgggtaacccggtaaggggtaggaaacgttacggaaacgtaaaaccggtagttacggtaggtacgtacgaccgtaccgtacg

SEQ ID NO: 111662 - DNA, 703 bp, Homo sapiens
  misc_feature: GYAE6OF01ETWPD.45.36.D03.1.454.CMB.1.raw
  modified_base (117)..(117): a, c, t, g, unknown or other
  misc_feature (117)..(117): n is a, c, g, or t
  modified_base (207)..(207): a, c, t, g, unknown or other
  misc_feature (207)..(207): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (353)..(353): a, c, t, g, unknown or other
  misc_feature (353)..(353): n is a, c, g, or t
  modified_base (524)..(524): a, c, t, g, unknown or other
  misc_feature (524)..(524): n is a, c, g, or t
tcagacgcgatcgacacgaccggtgctcgatttagctgcgtcacgatctctcttggggaggaactgctcagttaggacccagaggaccatggaagccccagctcagcttctcttccncctgctactctggctcccagtagacctccggagtaaattgtcttgacacagtctccagccctacctgtcttttcgttccgaaggggaaancgccctaaccctctccgtagcgacgggcctagtacggagggttntaaacnggtaccttaacttaggccttacggtaaccaaaaccgaaaaaccgtcggaccgtacggacctacccgaggtcctacaactcaagtactacgtgaacncaacgtacgaaccgtagggtccctaggccgtaccagacgtacggttaccgaggcgtcggtcggtcgtacgggacaggtacgttaccgactaccgtaccgtacggtacacgtccgtacgtccgtaggtaccgtcctaggtacttcgttaagttttcgacttaaggttttacncgttagtactacgaccggttactccggttacccgacgtaccgcctcgtcccggttaaccgggttccggggacgggggtaaccgtggggtacgtaggacgttaggaacgacgtagtcggtacggcgacgtacccactacgtcttccggtacttccaacgtttccctccggtacgttaccg

SEQ ID NO: 111663 - DNA, 790 bp, Homo sapiens
  misc_feature: GYAE6OF01CXOD7.45.36.D03.1.454.CMB.1.raw
  modified_base (187)..(187): a, c, t, g, unknown or other
  misc_feature (187)..(187): n is a, c, g, or t
tcagacgcgatcgacacgaccggtgctcgatttagctgcgtcacgatctctcttggggagctctgggagacgagcccagcactggagtcgccggtgtttccttcggtgatcatcactgaacacagaggactcaccatggactttgggctgtaccgttgggttttcctcgttgtcttcgttttaaagnggtgtccagtgtcaggtgcaggtggtggaggtcgggggagtcgttgtccgagccgtggggacgtccctggagtacctctccgtgtcgacacggtccttcgtggtactttccgtaccctactacgtttaaaccgttttggttacccctaccggttcggggtccccgtaccgtaacggggttccccgaaggggtaccgtaaagggggtccgtggggtagtcggggttcgaccccttgtaacgtttaccggaaagcgtaggtaacgtaggaagtaacggtccctaaacttacgacgtaacccgttccggtaagggaaccggggtcccacgttaccaccgtaacgtacccgtacccgaaacgtacgtaaactaaacgtttacccgaaaagtaacgttaccgttacctttacgttttacgaacgtaaacgttacgtaaagtaccgtaccgttaggtaaagtacggttaaggacggtactacggttcgtaccgttcttacgtttacgtggtacggaccgggtaggggtaactagttacgtaacggttacgttacggttacgttacgggtttaacccttagggttaaacgttaaacttacgtaaaacccg

SEQ ID NO: 111664 - DNA, 795 bp, Homo sapiens
  misc_feature: GYAE6OF01A6ONE.45.36.D03.1.454.CMB.1.raw
  modified_base (614)..(614): a, c, t, g, unknown or other
  misc_feature (614)..(614): n is a, c, g, or t
  modified_base (644)..(644): a, c, t, g, unknown or other
  misc_feature (644)..(644): n is a, c, g, or t
tcagacgcgatcgacacgaccggtgctcgatttagctgcgtcacgatctctcttgggggaggaactgctcagttaggacccagagggaaccatggaacgccccagctcagcttctcttcctcctgctactctggcctccagactacccaaccggtaaaattgtgtgacacagtctccgaggcctacctgtctctgtcctccgagggacacacgccctaccctctcgtcgcgacggcctaaggtacggacgtcgtacgtaaggtaacggttacgttaacgggccgttaacggtaacccgaaaacgaacggtaaacccgtcggacccgaacgggtccctaccggacggtcccttacccgtacacgtacccgtagtacggaactcgacctaacgacccgtaaaccggtcgggtcccgtacgggtacccgtacccgaacgtacggtaccgggttccggacggtccggtagggtcgggtacgtacggggaccaggttaccgttaccgaacgttccgtaaccgtaccgtacgacggtccaccgggtaccgtggggaacccgtccgtagttaacggttcgttcgtttaacctcggtttaaacggtttctcggtggtaaccngtacccgtggttacccccggttccacccgngttccccgtacggtcccgggtttacggggtcccggggggaccgggtaatggggaacggtactacgggaaccggtaaccggtacggtccggtgggtccggacggtaccgccttaccgtcgtttcgaaccgtttcgtaaacccgcgtttcccg

SEQ ID NO: 111665 - DNA, 713 bp, Homo sapiens
  misc_feature: GYAE6OF01CKEK7.45.36.D03.1.454.CMB.1.raw
  modified_base (185)..(185): a, c, t, g, unknown or other
  misc_feature (185)..(185): n is a, c, g, or t
  modified_base (276)..(276): a, c, t, g, unknown or other
  misc_feature (276)..(276): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcacatggactttgggctgaccttgggttttcctcgttgcttacgttttaagnggttgtccagtgtcgaggtgcgtagggtggtgggaggtcggggggagtcgttgtccgaggccgtggggacgtcctgacgtcctctccgtgngcagcctacgtggtacttcctccctagtacgttaacgttttcggtccaggtcgggtcccacgtaggttccgagggacgaaggggctagggacggtcgggtacgccctgtaacgtttaccggaagtacgtggaagtggaacgaacggtcctactacgagtaccgcggtaggaaccgggtccctacttaccgaacctacgtaccgtaccgaaggtaaccgaaacgttaaacttaaccgaaacgttaacgtttaccgtttacccttttacgttttacgaactaaagtacgtaaactacgtaccgtaggtaacgtaggtacggaacgtaccgtacgttcgttagttacgttatttcggtagtaccggacgggtaacgggtactagttcgtagtcgtagttacggttcggttacggttagtaagttaactacgttaaacccg

SEQ ID NO: 111666 - DNA, 772 bp, Homo sapiens
  misc_feature: GYAE6OF01AUWD8.45.36.D03.1.454.CMB.1.raw
tcagacgcgatcgacacgaccggtgctcgatttagctgcgtcacgatctctcttggggaggaactgctcagttaggacccagagggtttttttttaaccatggaagccccagctcagcttctcttcctcctgctactctggctcccagataccaccggaaaaattgtgttgacacagtctccaggcaccctgtctctgtctccgagggagacagccaccctctcctgcagggccagtaggagtgtcagtaagtacttaggctcggtaaccaacagaaacctggaccaggcctcccgaggcctccgtcactccatgatcgcactccaacgtacgggtccctggccgtcccaggaccgtacgggttcccggtggaccgtaggtcgggtcgtaggggacaggtacgttcaccgttcctacgtaaccgtcgacgtcgaacggtcccgtagggaccgtccgtaggtacgttacggttaacgttttcggaccgtttaacggttttacctttccgtttacggtaccgtacggtaccgttaaccgggttcccggtttaccccgtacccgtaccccggtacccgttcccgttacccgggttacccgggttttaccggggggacccgggggggttaacccggtacgggggttacgggaacgggttacgtaacgggaaccggggtaccggtaaaccggttcgggttaacgggtcccgttacgggtaccccgaccgtttaacgttcccggttacgttaccgtttcccgtaacgtttcccccccg

SEQ ID NO: 111667 - DNA, 721 bp, Homo sapiens
  misc_feature: GYAE6OF01BKLRA.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtactaggctggtaccaacagaaacctggaccaggcctacccgaggcctcctcactccatgatcgacatcccaacgcgggtccctgggccgtccagtacctagggttcccgtggctagggttcgggtacgtcggggaacagtacgttccactccgtccaccggtcgagccgacggtcccgtgggaccgtccgtagtaacgttcggtaattttcggacctttacggttttacctttcgttcggtactaacggtcgtaacggtcccgtttccccggacccgtacccggaccccggtccttaccggttacccgggttttccgggggggacccgggggggtaacccggtacggggggtaacggggtaacggtacggttacgggaaacgggtaaccgggtaaacggttggggtaccgggtccgttaccggaccctacccgtacgttcccgttacggtttcccttcgtacctttccccccgg

SEQ ID NO: 111668 - DNA, 832 bp, Homo sapiens
  misc_feature: GYAE6OF01C1T80.45.36.D03.1.454.CMB.1.raw
tcagacgcgatcgacacgaccggtgctcgatttagctgcgtcacgatctctcttggggagctctgggagacgagcccagccacgtggaagtcgccggtgtttccttcggtgatcatcactgaacacagaggactcaccatggactttgggctgaccgtgggttttcctcgttgctacttttaagaggtgtccagtgtcaggtgcgtagggtgggtggaggtcggggggagtcgttgtccgaggccgtggggcgttcccctggacgtacttccgtcctggtcgctacgccgtgttacggtacttccctacccgtcgtaagtttaacgttttcggttcccaaccggtttcggggtcccgccgtacgggttccaagggcgtaaggggtcctaggggtagttcggggtcgtaccccgttgtaacggtttacccgaaggtacgtaggtaaggttcggaacggtaaccggtacccttaaccgtaggtaaccgtaccggtaccgggttacggaaaccgggggtcccctacttaccgaacccgtagtcccgtaaccgaaggtacgtaaacctaacgttaacctaaagtacgttaccgtttacccgtttagttttaccggaataacgttaacgtaacgttactacccggtaaggtaacgtagggttacaacggggtactacgttgttacccgttaggtttacctttacggtttaccggtcggttaaccgggtaccgggtaacgggggttaaccttacggtaaccggtttaggttacgggtaacccggttttcggttaccgggtttaagggtttacgggttaacgtttaaccgttaaacccg

SEQ ID NO: 111669 - DNA, 769 bp, Homo sapiens
  misc_feature: GYAE6OF01DD5CB.45.36.D03.1.454.CMB.1.raw
  modified_base (431)..(431): a, c, t, g, unknown or other
  misc_feature (431)..(431): n is a, c, g, or t
  modified_base (454)..(454): a, c, t, g, unknown or other
  misc_feature (454)..(454): n is a, c, g, or t
  modified_base (724)..(724): a, c, t, g, unknown or other
  misc_feature (724)..(724): n is a, c, g, or t
tcagacgcgatcgacacgaccggtgctcgatttagctgcgtcacgatctctcttggggaggaactgctcagttaggacccagagggaaccatggaagccccagctcagcttcttcttcctcctgctactctggcctcccagactacccaaccggaaaaattgtgttgacacagtcctccaggccaccctgtctctcgtctccgagggggacacacgccctaccctcctccgtgacggacgggccaaggtaggacgtggtacgtaaggttaaagtaccgttaggtacgtaacgggtaacccaaaacgaacggtaaaaccgtcggacccgaaggccctcccgacggtctaccctcaactccagtacgaacgtcgacctaactacccgaaacgtccgggtcctcggacccgtccgacgtaacgtccggtacggnggcgtacgggtggtcggacgganaggtacgtcgacttcgaccgtaccgtcgacgtaccacggtccggtagggacctccggtagtagtttcgttaacgttttggtaaccgttttagtttaccgtttccgtgggtaccctacggtaacccgttccggttacccgtccccgtacccgtaacccggtccgttacccggtacggttcccgggggttacccggggacccgggggtaccggtaggggtagtaaccgggtagtccgggaaagtacccggtagttcggggtacgcggttacncccgtaaccgtcgtttccttagttcccgttctcccggttaccccg

SEQ ID NO: 111670 - DNA, 611 bp, Homo sapiens
  misc_feature: GYAE6OF01AIUX3.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccagcaccctgtctctgtctccagggganacagcccaccctctcctgcacgggccaggtaggagtgtcagtaagtacttaggctggtaaccaacagaaacctggccaggcctcccaggcctcctcatcccatgatgcactcccaacgtacgggtcccctggcccgtcccacgaccgtacggttcccgtggctaggtcgggtctggggacaggtcgttcacgtctccaccgtcgagccgagtcctgggacgtccgtagtcgttacgtagttttcgcttacgttttactcgttcgtccagtaccgtacgtcccgttacccgccgtccggcccgtccgttcccgtccgggtttccggggccgggggtaccgtaggggtcgaggtcgtaggacgacggtacgtggtcggtcgtcgcaccgtgtccgtgttccttgcttccccg

SEQ ID NO: 111671 - DNA, 753 bp, Homo sapiens
  misc_feature: GYAE6OF01C31OG.45.36.D03.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (224)..(224): a, c, t, g, unknown or other
  misc_feature (224)..(224): n is a, c, g, or t
tcagacgcgatcgacacgaccggtgctcgatttagctgcgtcacgatctctcgttggggggaggaactgctcagttaggacccagagggaaccatggaagccccagctcagcttctcttcctcctgctactctggctcccagactaccaacggaaaattgtgtgacacagtctcaggcaccctgtctctgtcnccgagggganacgacgccctaccctctccgngccgacgggacctaaggtagggtagtgtacgtaagttaacgtacgttaggaccgtaggtaacccaaacgaacggtaaaccgtcgggaccaacggtccctacccgaggtccctcctactacctaccgatacgatacgactaccgtaccgaacggtccggtccgtacggaccgtaccgacggacgtaccgggttcgacggacgtagggtcgggtacgacgggtaagtacggtacgtcgaacttcccgtaccggtaccgtcgaagtacccggacgtaccggtaggtaccgtcgttacgtagttacggtttattttcggaacggttttattttacgtttcgtacggttaccgaagttaccgttaacgtaagttaccgtaagttaccgtaggttccgttaaggttaccggtttagggttccgggaacgtacggggaacctaggtcgttaaaaccggaattaaacggaaacgttcggttacggcggtacccgtagtacccgtaagttcctagtttacgtcccttaacgttccccg

SEQ ID NO: 111672 - DNA, 849 bp, Homo sapiens
  misc_feature: GYAE6OF01AEWQ0.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgtaccttgggttttcctcgttgtctctttaagaggtgtccagtgtcaggtgcgaggtggtgggaggtcggggggaggcgttgtccagccgtggggacggtcctgacgtactcgtcctgtcgcacgcctcgtcggtacttcctccctacgtaacgtttaaccgttttcggtttacccacgttcggggtccccgcccgtacggttcccgaggtccggaagggggtccgtagggtacgggttcggggtcggtcccccgttcgtaacgtttacccggaagtacggttagggaaggtacggaaggaacggtccctaacgtaccgaacggtacccgtcccggtaagggaaaccggggtcccgttaccttacccgaacccgtacgttacccgtacccgtaacggtaacgtaaaccctaaaccgttaacccgtaaacggtaaaccgtttacggttaccccttttaccgtttttacgtaaaccttaaaagttacggttaaacgttaacgtaccgttaagggtaaggttaacggttacgggaacgggtaaccgtaaccggtttaccgttacggtttaccgtttacgttttcgtcggttaccggtaccgggtaacgggggtaactacgtttacgttaggttacggttacggttcggtttacgggtttaaccggttaaggtttaaccgttaaagttaccgttaaaccccg

SEQ ID NO: 111673 - DNA, 792 bp, Homo sapiens
  misc_feature: GYAE6OF01B16MB.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctccgtctccgacgggaggacacgccgacccgtcctcctcgcgacgggaccgaggtagggtagtgtacgtagtaagttacgtacggtcgtacgtaccgaacgaacgtaaccgtacggaccgaccgaccgtacccgaccggtccgtccctaccgtacctaccacgtagtacgtactaccgaacctaacccgtaacggtacccgggttcccggtccggacccgtaccccgacggtacggtaccggttccgggtcggacggtacggtcgggtggtacgggagtacggtacgttccgtactaccgtaccgtaccgtcgtaccgacgcgtaccgggtcggtaccggtccgttagtacggttacgtttaacgttttcggttaacgttaaccgtttttacggtttcctaggtttcccgaacggtccgtacggtaccccggtttcggacccccgtaccgtcccgttaccggttacccgttaccgggggtttacccggggggaccggggtacccgggtggggtacggacggtacggtacggaaggtaccgtaggtcgggtcggtagcccgtacaccgttacgtcgtttaccttatccttacccggtcccgttacccg

SEQ ID NO: 111674 - DNA, 645 bp, Homo sapiens
  misc_feature: GYAE6OF01BRF37.45.36.D03.1.454.CMB.1.raw
  modified_base (202)..(202): a, c, t, g, unknown or other
  misc_feature (202)..(202): n is a, c, g, or t
  modified_base (358)..(358): a, c, t, g, unknown or other
  misc_feature (358)..(358): n is a, c, g, or t
  modified_base (425)..(425): a, c, t, g, unknown or other
  misc_feature (425)..(425): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgcccaccctctcctgcagggccaggtaggagtgtcagtaagtacgttaggctcggtaaccaacgacgaaaccgtggcccaaggtcctccaggcctcctcatccatgatgcactcaacgcgggtccctggccgtacccagacgtcggttccgnggcaggtcggtcgtacgggactacggattcactccgtacaccgtcagtccaggcccgtagggtaccncgtagtattgttatttcggaccttaacggttttcctcgttgtacctagtacgtacggttccttccccggaccacccggtcccggtaccgttaccgtccgggtttccgggggacccggggacgtagggggtcgaggtacggtacgaagggtacggtaacgttgggaggtccgtaccgaaccgacccgttagttcccgttgttcccgttccacgtttccccg

SEQ ID NO: 111675 - DNA, 812 bp, Homo sapiens
  misc_feature: GYAE6OF01EWOMC.45.36.D03.1.454.CMB.1.raw
  modified_base (200)..(200): a, c, t, g, unknown or other
  misc_feature (200)..(200): n is a, c, g, or t
  modified_base (424)..(424): a, c, t, g, unknown or other
  misc_feature (424)..(424): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagactaccaacggtaaaattgtgttgacacagtctccaggcacctgtctctgtctcgaggganacacgcccaccctctcctcgcgacggaccgaggtacgggagtcgtacgtaagttaacgttacgttacggcgttacggtaaccaaacgaaccggtaaacccgtcggacccgacggtccctacccgacggccttaccctctaacgtcccagtacgactcgaccactacccgaacggtccgggtaccgtcggacccgtacccgacggtaccggttacggttcccggnggtaccggtagggttcgggttacggagggtaccgacggttaacgttccctaacgttcccgtaccggtaaccgtcgacggtccgtacgggtcccgtacgggtaccgtccgttaggtacttacggtttacttttcgggaacttttacggttttaccttcggtacgttaccgtacggtaccgttaccgggttccccgttaccggacccggttaccgtccccggtacgttacccgggttaaccgggggttcccgggggtaccgggggtaaccgtagggggttaccggaagggttaccgtaaacggggaacgttaacccgggtcggtagggttccggacgtccgaccgttacgtacgtttccgttacgttaccttccgtcccgtttaccccgg

SEQ ID NO: 111676 - DNA, 808 bp, Homo sapiens
  misc_feature: GYAE6OF01B1MC3.45.36.D03.1.454.CMB.1.raw
tcagacgcgatcgacacgaccggtgctcgatttagctgcgtcacgatctctcgttgggagctcgtgggagacgagcccagcacgtggaagtcgccggttgtttcctttcggtgatcatcactgaacacagaggactcaccagtggtacgtttggctgtaccgttgggttttcctcgttgtcttacgtttaagaggtcgtccagtgtcgaggtgcgtagggtggtgggacgggtcgggggaggtcggttcgtccgacggtccggtcggggacggtcccgtaggaccgtcgttccgtccgttgtcgcgtacgtcccttcgtcggtaccttccctcccgttagtacgttacgtttcggttccgtacggtcgggtccgaccgtcggttaccgacggacggtaagggtcgtagggtacggtcggtcggtcccttcgtaacgtttacggaagtagtaggtaacgtaggaacggtaacggtaccctaacgtaccgtaacggtaccgttcgggtaacggtacgggtacccttaccgttaccgaacccgttacgtacccgtaaccgaacggtaaccgtaaaccgttaaaccgttaaccgtaaacgttaacgtttaccgtttaccgttttacgttttaacgaacttaaagtacgtaaagttaccgtacgtaggtaacgtagttacgaacggtacgtacgttacgttcgttacttacgtttcgtggtacgtacgggtacgggtacttacgtacggttgttacggttaacgtttcggttcggtttacggtaaggttaacgttaaacgtaccgttaaaccc

SEQ ID NO: 111677 - DNA, 820 bp, Homo sapiens
  misc_feature: GYAE6OF01C83VY.45.36.D03.1.454.CMB.1.raw
  modified_base (237)..(237): a, c, t, g, unknown or other
  misc_feature (237)..(237): n is a, c, g, or t
tcagacgcgatcgacacgaccggtgctcgatttagctgcgtcacgatctctcttgggggaggaactgctcagttaggacccagagggaaccatggaagccccagctcagcttctcttcctctgctactctggctccagactaccaaccggtaaaattgtgttagacacagtctcagccacctgtctctgtctccgagggagacacgccaccctctcctgcgtagggccgaggtaggngtggtcgtaaggtaagttacgtaggtcgtacggtaaccaacgaacgtaaaccgtcggacccgaacgggcctacccgacggtcctaccgtcacttaccagtacgagtcgacctacctacccgaaccggtacggtcccgtcggtaccctaccggacgaccgttaccgggttccggtacgcggtacggttcggggtacgtacgggaaccgtaggtaccgttcaccgttcctaccgaccgttacgacggtccgtaacggtcccggtacggtaccggtaccgttaggtacgtttacgtttacgttttacggttaaccgtttacggtttttccgttaaccggtttcgtaccgtacggtcccggttaccgttacccggtaccccggtcgtaaccccggtacccggttaccgtttaccgggttaccggggtttccggggggaaccggggggtaccgttacgggggtaacgggtacggtacgggtaagggacccggtaacggttaaacgggtgggttacggtccgtacggtacccggtaccgttaaccggtttcggtttaccgtttcccgttacgttccccgtttaccccgg

SEQ ID NO: 111678 - DNA, 838 bp, Homo sapiens
  misc_feature: GYAE6OF01B7PSY.45.36.D03.1.454.CMB.1.raw
  modified_base (414)..(414): a, c, t, g, unknown or other
  misc_feature (414)..(414): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctcggctcccagatacccaaccggtaaaaattgtgttgacacagtctccaggccaccctgtctctgtctccgagggagacacgcccaccctctcctgccgacgggcctaggtaggagtgtacaggtaagtacgttaggcgttacggtaacccaaacgaacgaaaccgtcggacccgagggtccctcccgaaggtcccttcccgctactaccctatcggaatcgacctaccgtaccgaacggtacggtccccgtggcccgtacccgaggtaccgtacggttccggngtaccgtggtcgggtcgtacgggacgtacggtacgttccgaaccgtcgtacccgtccgttacgacggtccgtacggtcccgtacgggacgtcccgtaggttacgttacgtttacgttttggtaacccgtttagttttacccgttcgtttaacggtcgtaacggtacccgttacgggttaccccgggtttaccccgaccccggtacccggttacccggttacccgttaccccggggtttaacccggggtttcccgggggaacccgggggggtaacccggtttacgggggtaacggggttaacgtaccgggtaacgggaaacccggtttaccggaaaccgggtttgggtaccgggtacgttaccgtaacccgacccgtttacgttcccggtttacgttacccttaccggtcccgtttaccccccgg

SEQ ID NO: 111679 - DNA, 724 bp, Homo sapiens
  misc_feature: GYAE6OF01AW9D7.45.36.D03.1.454.CMB.1.raw
  modified_base (369)..(369): a, c, t, g, unknown or other
  misc_feature (369)..(369): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggccaccctgtctctgtctcgagggagacagccaccctctcctgcgagggcctaggtaggagtcgtctaagtaacgtacttaggctacggtaccaacagtaaacctggaccaggcctaccaggcctcctcactccatcgatcgacactaccgaacgtacgggtccctggccgtacctacgaccgtacggttccgnggactagggtcgggtcaggggacaaggtacgttccgacttccgtaccgtaaccggtcacggtcccgacggtcccggttgggaactccggttagaacgtttcggttaacgttttcggaactttacggttttaccttacggttcggaccgtaacgggccggttaacgtcccggttaccccacggccccgtacccggtcctttacccgggttaccgggtttccgggggccggggttaaacccggtgggggtagggtacgtaggttcccggaaaggtacccggtaagtcggggtaacggtcccgaacggcccgtttaaccgcgttaccgttaggttccttacggtaacctttccccggg

SEQ ID NO: 111680 - DNA, 858 bp, Homo sapiens
  misc_feature: GYAE6OF01EI105.45.36.D03.1.454.CMB.1.raw
  modified_base (639)..(639): a, c, t, g, unknown or other
  misc_feature (639)..(639): n is a, c, g, or t
  modified_base (651)..(651): a, c, t, g, unknown or other
  misc_feature (651)..(651): n is a, c, g, or t
  modified_base (824)..(824): a, c, t, g, unknown or other
  misc_feature (824)..(824): n is a, c, g, or t
tcagacgcgatcgacacgaccggtgctcgatttagctgcgtcacgatctctcgttgggggaggaactgctcagttaggacccagagggaaccatggaacgccccagctcagctttcctccttccctcctgcctactctcggcctcccagactaaccaaccggaaaaattgtgttgacacagtctccaggccaccctgtctctcgtctccgagggacacgacgcccaccctctcctgcgacgggcaggtaggagtgtacaagttaacgttacgttacggcgttacggtaaccaaacgaacggtaaaccgtcggacccgaacggtccctacccggaggtcccttaccctcgtaactccgagtacgacgttaccggacctaaccgtaacccgaaaccggtccgggtccccgttacggaccccgttacccgaacggtaccggtacgggttttccccggagggaccgttagggggttcggggtaaccggttagggggaaacctacgggttaaccgtttaccgaccgtttacccgtaccggaacccggttagaccggtaccgtaccggggttacccgtagggacccggttccgttaggtaaacggttttcgtttacgttttaggacccgttttaacgttttaccncgggttttaacnccggtaaccgtcggttccggttacccccggtcgaccccgacccggtccccggtacgttaccccgggtttcccgggttacggggggggaccccgggttaacggtaggggttacgggaacgttaccggaggtaacccggtacggtacggttgtacgggcgtaccgactaaccgtnttccgttaacgtcttaaccgtcccgttaaccccg

SEQ ID NO: 111681 - DNA, 672 bp, Homo sapiens
  misc_feature: GYAE6OF01AI336.45.36.D03.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggcacctgtctctgtctccgagggganacagcccaccctctcctgcgacgggccaggtaggagtgtacagtaagtacgttaggctggtaaccaacagaaaccgtggaccaggcctcccgaggcctccncactccatgatgactactccgaacgcgggtccctcgggcccgtcccaaggaccgtagggttcccggtaggcgtagggtcgggtcgtagggtacaggtcgttacacgtcctaccgaccgtcaacgtcgacggtccgacgggtacgtcctaggtattacgttacgttttcgtaccgtttacgttttaccgttcggttacgttacgtacgtcgtacgtccgttccccgccgtacccgtcccgtaccgtccgttaccgggttaccggggccgggggtactacggggggtaggtacgtaggtcggaacggtacggtacggtgggtacggcgtaccggtcacctgttcgttccggttcttccgtcccttccccgg

SEQ ID NO: 111682 - DNA, 744 bp, Homo sapiens
  misc_feature: GYAE6OF01EMMEC.45.36.D03.1.454.CMB.1.raw
  modified_base (208)..(208): a, c, t, g, unknown or other
  misc_feature (208)..(208): n is a, c, g, or t
  modified_base (335)..(335): a, c, t, g, unknown or other
  misc_feature (335)..(335): n is a, c, g, or t
  modified_base (420)..(420): a, c, t, g, unknown or other
  misc_feature (420)..(420): n is a, c, g, or t
  modified_base (716)..(716): a, c, t, g, unknown or other
  misc_feature (716)..(716): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctgctcccagactaccaaccggaaaaattgtgttagacacagtctccaggccaccctgtcctctcgtctccgagggganacacgcccaccctctcctggacgacgggaccaggtaggagtgtacaaggtaagttacgttaggcgtacggtaaccaaagaacgtaaaccgtggacccaaggtccctacccgtaaggtcctcccgtanaacttcccagtacgatcgacctactacccgtaaacggtccgggtccgtcggcccgtacccgaagtaccggtacgggttacccggnggacgtacgggttcgggcgttaggacgtacgttacgtctaccttccgaccgtaccggtacgacggtaccgacggtaccggtcgggtaaccgtccgtgggtacttacggtttaagtttacggttaccgtttaacttttaccgtcgttagtaacgtccgtcgttacccggttcccgtccgacccggtcctaccccgggtcgttccgtacggggttccggggaccgggggtacgtacgggggtagaacgtggacggtaaccggtaacgtcggttaggcggacctacggacctaccgttntaccgttatttcctacgtcccttacccg

SEQ ID NO: 111683 - DNA, 625 bp, Homo sapiens
  misc_feature: GYAE6OF01DIHPR.45.36.D03.1.454.CMB.1.raw
  modified_base (434)..(434): a, c, t, g, unknown or other
  misc_feature (434)..(434): n is a, c, g, or t
  modified_base (550)..(550): a, c, t, g, unknown or other
  misc_feature (550)..(550): n is a, c, g, or t
  modified_base (600)..(600): a, c, t, g, unknown or other
  misc_feature (600)..(600): n is a, c, g, or t
  modified_base (608)..(608): a, c, t, g, unknown or other
  misc_feature (608)..(608): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacgttaggctaggtaaccaacaagtaaacctggaccaagggcctacccgaggcctccctacgaccttccaagttcgaagttcgacaacgtacccaacgtacgggtcccctaggtcccgtacccagacgtacggttccgtaggcgtaggtcgggtcgtgggacaggtacgtctacgtcctacaccgtnacgcagccgtggcgtaccgtgacttgtactttgacttagtttctctgtacacggtctacgtcccgttccgaccgaccgtccgtccttacgtaccgggttcggggaccggggtacgnggggtagacgtagtaggacgacggtaacgtggtcggcgtcgacctacgtnttcccgtnttacctctccttccccg

SEQ ID NO: 111684 - DNA, 882 bp, Homo sapiens
  misc_feature: GYAE6OF01BF027.45.36.D03.1.454.CMB.1.raw
  modified_base (217)..(217): a, c, t, g, unknown or other
  misc_feature (217)..(217): n is a, c, g, or t
tcagacgcgatcgacacgaccggtgctcgatttagctgcgtcacgatctcgtcgttgggggaggaactgctcagttaggaccagagggaaccatggaacgcccagctcagtcttcttcttcctcctgctactctggctccagactaccgaacggtaaaattgtgttcgacacacgtctccgaggccacccttgtcctctgtcctccgaggggacacncgccctaccctcctccgtcgacgacgggcctaggtacggtacgtcgtacgaaggttaacgttacgttacggtaccgttaacggtaaaccaaacgtaaacggaaaacccgtcggaccgacggtacctacccggtacggtaccttacccgtacctaaccttacccgtaagtacggtaaccttacggacctaaccgtacccgtaaaccgggttccgggttacccgtccgggtacccgtaacccggtaaagggtaccggttaccggggtttacccggtcgggtaccggttcggggttacggggttacggtaccggggtaacgttaacggttaccggttaccgtaccgtttcccggtaacccgtaccggttaccgtaacggacccgttaacggggtcccggtttaacggggaaccgtttccgttagggttaacgtttacggtttacgttttaccggacgttttacgttttaccgttgtacggtacgtaacggttccgtaccggttcccgtacccggacgttaccggtcctacggtttacccggtcgggttacggggggaccgggttatacgggggataacggtaccgtaacggaacgggtaccggttagtcgggtcgtacgtacccgacgtaacgttcgttcgtaccgtttccctgtacccggttccccg

SEQ ID NO: 111685 - DNA, 575 bp, Homo sapiens
  misc_feature: GYAE6OF01B4MFC.45.36.D03.1.454.CMB.1.raw
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
  modified_base (398)..(398): a, c, t, g, unknown or other
  misc_feature (398)..(398): n is a, c, g, or t
  modified_base (563)..(563): a, c, t, g, unknown or other
  misc_feature (563)..(563): n is a, c, g, or t
  modified_base (566)..(573): a, c, t, g, unknown or other
  misc_feature (566)..(573): n is a, c, g, or t
  modified_base (575)..(575): a, c, t, g, unknown or other
  misc_feature (575)..(575): n is a, c, g, or t
tcagacgcgatcgacacgaccggtgctcgatttagctgcgtcacgatctctcctgtgcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtccttctttttgcaaatgaatagcctgagtagttgaggacacgtctgtctatttctgtgccgaggggacatctatgagtcgtggttcgtagtgtaatcaactactactacctnatggacgtcgtgggacaaacgggacctcggtcnccgtctccgcacgtccttaccacgacggcccagtccgtccttcccccgnggcccgcccgtcgcctccgacgacgccgaccgtcggtcggggccacggcgccggtccgtcgggcgtcgcccgtggtaccgtaacgtaccttacttcccgtacgtacgtccgtccgtcgtacggacggtccgggcgtacgggaccgacgggccgacgtagtacggncgnnnnnnnngn

SEQ ID NO: 111686 - DNA, 876 bp, Homo sapiens
  misc_feature: GYAE6OF01B76FV.45.36.D03.1.454.CMB.1.raw
tcagacgcgatcgacacgaccggtgctcgatttagctgcgtcacgatctctcttgggggaggaactgctcagttaggacccagagggaaccatggaacgccccagctcagcttctcttcctcctgctactctcgcctcccagacgacctaccggaagtaaattgtcttagacctactacgtcctaccacgcctatttcgtcgtccttctctcctaccggagggaacaccacgaccctaccctctcagtacgcgaacggcctacgtacgaagtagttaagtaacgaactacgttcggttacggtaccttaggtaactaactaaacgtaaccgtaacggtcccggtaccgggtaccccgggtacccgggttcccccggtccttacccgtactaacgttcctaagtaccgtatacccggttcctaccgaacggtccgggaccgggtcctaaccgtcggaccctaaccgtcccgtaacggtcccggttaagggttccggtaacggggttcgggggttaccggggtttacgggtaccgtacgtaaccggtaacgtttccctaccgtaaccttctaaccgtaaccgtaactccgaaccgtacccgtaaccctaaccccgttaacccgtaaacgtttacgggttaaacgtttcgtttaacccgtaacgtttaccgtttaacctttacggttaacgtaaccgtaacgaaaccgtacgtaaccgttaacggtacgttaaccgttccgggtacccttacggttacccggtttaacgggccgggtaaccgggtaacgtaaccgggttaagggtaaccgtaacggtaaacgaaaccggtaaccggtacgttacgggacgttaaccgcccgtaacgtaaccgtttccgg

SEQ ID NO: 111687 - DNA, 976 bp, Homo sapiens
  misc_feature: GYAE6OF01DTCCP.45.36.D03.1.454.CMB.1.raw
tcagacgcgatcgacacgaccggtgctcgatttagctgcgtcacgatctctcgttgggggaggaactgctcagttaggacccagagggaaccagtggaacgccccagctcagtcttctcttcctcctgctactctcggcctcccagactaccgaaccggtaaaattcgtgttagaccacgtacgtcctaccgacggccacccttgtcctcgtcgtcgtaccggaggggacaccgacgaccctacccgtcctccgtacggaccgacgggaccgtaaggtacggtacgtcgtaacgtaacggttaaacgttacgttacggtaccgttaacggtaaacccaaacgtaacggaaccgtcggtaccgacggtacccgtacccgacggtcccttaccgtactaacgtaccctagtacgtacgtcgacctaaccgtacccggaacggtccggtccgtaccggtacccgtaccgtacggtaccggtaccggttacggtacggtacggtacggggtggtaccggtaagggacgtacggtaccgttacgtaccgttccgtaccgtaccgtacgaacgtacgtaccggtccgtacgggtactcccggtaggttaacgttcggttttacgttacgttaaccgtttttacggtttaacccgtttgtaacccgggttacgtaaccgggttacccgttacccgggtttacccggttacccccgacccgggttaccccggtacccgggtttaccccgtttacccgggggtttaaccccggggggttacccgggggggtaaccccggggggttaacgttaaaccgggggggtccgggaaacggttacgggttaaaccggggtaaccggtaccgggttttaaccgggtaccggggttaccggtacccggttacccgtacccggttaaccgtttacccgggttacccgttaccgttttaccccgggtttaacccttccccggttttaacccccgg

SEQ ID NO: 111688 - DNA, 588 bp, Homo sapiens
  misc_feature: GYAE6OF01CG7EF.45.36.D03.1.454.CMB.1.raw
  modified_base (355)..(355): a, c, t, g, unknown or other
  misc_feature (355)..(355): n is a, c, g, or t
  modified_base (394)..(394): a, c, t, g, unknown or other
  misc_feature (394)..(394): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaaacgagaaacctggaccaggcctcccgaggctcctcatccatcgatgacatccaaacacggggtccctggccgtccccagtaccagggtttccngggcacggtgggtctgggacagagttcactctcaccgtnagtcagcctggacgcctgtactgtatttgcttacgtttactttcgtgtcagctagtcgttcccgctaccgccgtctccgtacgtttccgggcggggggtacccgaggggtcggaacgtgacggaggtaacggtaacgttgggtacggtcgtcgaccgtaccgtaacgtcttacgttccgtttcctacttccccg

SEQ ID NO: 111689 - DNA, 896 bp, Homo sapiens
  misc_feature: GYAE6OF01A7Z6X.45.36.D03.1.454.CMB.1.raw
  modified_base (109)..(109): a, c, t, g, unknown or other
  misc_feature (109)..(109): n is a, c, g, or t
  modified_base (286)..(286): a, c, t, g, unknown or other
  misc_feature (286)..(286): n is a, c, g, or t
tcagacgcgatcgacacgaccggtgctcgatttagctgcgtcacgatctctcgttggggagctctgggagacgagcccagcactggaagtcgccggttgttccttggtnatcatcactgaacacagagactcaccagtggacttgggctgtacctgggtttcctgttgcttacgttttaagcggtcgtaccagtgtcgaggtgcgtagggtgggtgggtacgggtcgggggagtcgttgtccgaggtccggtggggacgtcctaggataccgtcgtcgtgtaccgntacgtcctcgtggtacttcctcccgtagtacgttaacgtttcggttacccgacggttccggggtccctaccggtacggttaccggaggggtaaccggtaacgggggtcgtacggggtaggttcgggggttccgccccgttacggttaacgtttacccggaaaggttaggtaacgggaaacggttgggaaaacgggtaacgggtaccccttaacgtaccgtaaccggtaaccgggtccggtaaaggggtaaaccggggtccccttacgtacccgtaaccgtacgttaccccgtaccggtaaggtaaccgaaacccgttaacgttaacccggtaaacgttaaaccgttccggtttaacccttttacgtttttaacgaaccgtaaaagttaacggtaaacgttccggtaccgttagggtaaggtacggtttaacgaaccgggttacctaccggttacctttacggttactttaacggttccgttaggttacccggacccggggttaaagggtccccgttaagttacggttaacggttacggttaccggttacgggttttacccgggttaagtttaccggggttaaactttaaccgttaaacggttaaaacccc

SEQ ID NO: 111690 - DNA, 854 bp, Homo sapiens
  misc_feature: GYAE6OF01AVB9Z.45.36.D03.1.454.CMB.1.raw
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggactttgggctgacctgggttttcctcgttgctctttaagaggtgtccagtgtcaggtgcgaggtggtggaggtcgggggagtcgttgtccgagccgtgggacgtcccgtgagtcctctccgtggtcgcgtacgccttcgtggtactttccgtcccctagtacgttaaccgttttcggtttaccccgacgttcgggtcccgtaccgtacggtttcccgaagggtaccggaacgggggtccttggggtacggttcggggtccggtaccccttacgtacgttttacccggaaagttggtaacggaaaggttaggaacggaaacgggtacccttaacgtaccgaacggtacccgttacccgggtagggaacccggggaccccgtccgtttaccaaccccgtacgttacccgtaccgtaacgtaccggtaaaccgtaaacgttacccgtaaacggtaacttaccggttacccgttttaccgtttttaacgtaacgtaaaacgtacgtaaacgttaacggtacccgtaaggtaacggtaacggttacggtaacgggtaaccgtaaccgttaccggttacgtttaccgtttacgtttaccgttcggtaccggtacccgggtaagggggtaaccttaacgttaacggttacgttagggttaccggttacggtttacgggtttacggttacggttaacgttaaacgttaaccgttaaaacccg

SEQ ID NO: 111691 - DNA, 769 bp, Homo sapiens
  misc_feature: GYAE6OF01A9855.45.36.D03.1.454.CMB.1.raw
  modified_base (205)..(205): a, c, t, g, unknown or other
  misc_feature (205)..(205): n is a, c, g, or t
tcagacgcgatcgacacgaccggtgctcgatttagctgcgtcacgatctctcttgggggaggaactgctcagttaggacccagagggaaccatggaagccccagctcagcttcctcttcctcctgctactctggcccccagataccaaccggaaaattgtgttgacacagtctccaggccaccctgtctctgtctccgagggganacagccaccctctcctgcagggcctaggtaggagtcgtcagtaacgttacgttaggctaggtaaccaacgacgaaacctggccaagggcctacccgaggcctcctcactccagtgactcgcactacccgaacgtcgggtccctaggacccgtacccgaaggaccgtacgggttcccgtgggaccgtagggttcgggtcgtacggggaacacgggtacgttccaccgttcgtacccgtaccgttcgaaggcccgtacggtcccgttaggaccgttccgtaggtacgttagttacgtttttacgaccgtttaacggtttttaaccttcgttacggttaccgtaacggtaccggttaaccggttcccggtttaaccccggaccccgttaccggtcccgtaccgtttacccggtaacccggggttttccggggggaacccggggggtacccgtagggggttacggacgtaacgggtcgggaaacggtaaccggtacgtgggttcggacgtcggacccgttacccgtagtttaccgttcgttaaccttccgtaccttcccggttacccg

SEQ ID NO: 111692 - DNA, 813 bp, Homo sapiens
  misc_feature: GYAE6OF01CSDT3.45.36.D03.1.454.CMB.1.raw
  modified_base (196)..(196): a, c, t, g, unknown or other
  misc_feature (196)..(196): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
tcagacgcgatcgacacgaccggtgctcgatttagctgcgtcacgatctctcgttggggaggaactgctcagttaggacccagagggaaccatggaagccccagctcagcttctcttcctcctgctactcgtggctcccagactaccgaacggaaaattgtgttgacacagtctccagccacctgtctcgtgtccnccgagggacgacacgtcccaccctctccgtggacgacggggacctaaggtaggacgtgtactaaaggttaacgtacgtttacgggcctaggtaaaccaacgaacgtaaccgtggaccgacgtccgtaccgaggtctcctanacttccgatacgntacgcctaacgtacccgaacggtccgggtccctagggaccgttaccccgaaggtacccggttacgggttccggtcggacgttacggggttacggggttacgaaccggggataaaggtccgtttacaacgttcccgttacgaaccccggttagaccgacggtacggtacccgtaggggaaccctccgtaggttagttaacgttttgttttaaccggacttttaacggtttacgttcgttacggacacgtaccgaaccggtcccgttacccgcccggtaaaccgtccccggttacttaaccggttcccggggttaggggggacccggggaacgttacgggggagttaacgggaaccgtttaggaaaccgggtaaccgtaggtaggggtacgtccgtaaccgggtacccttaacgtacccggggtttatttaccgggttacctttaacccgtccgtttacccccgg

SEQ ID NO: 111693 - DNA, 651 bp, Homo sapiens
  misc_feature: GYAE6OF01E0XNA.45.36.D03.1.454.CMB.1.raw
  modified_base (202)..(202): a, c, t, g, unknown or other
  misc_feature (202)..(202): n is a, c, g, or t
  modified_base (454)..(454): a, c, t, g, unknown or other
  misc_feature (454)..(454): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctccaggctcctcatccatgatgcatccaacacgggtccctggccgtccccagaccacggttccgtggcagtcgggtcgtgggacagacgttcgaactccgtcgaccgtcacgcacgcctggacgcctgtaactgtacgttttcgacttacgttttacttcgttcgttcacgtccnggtcccgtttcccggcctaaccggtcccggtccgtccgtacccgttttccgggggaccggggggtaccgtacgggggttacgggaacggtacgttacgggaaacggtaccggtaaaccgtttgggtaccgggtccgttaccgggacccaaccccgttaacgttccgttacggtttcctttccgtaacgtttcccccg

SEQ ID NO: 111694 - DNA, 658 bp, Homo sapiens
  misc_feature: GYAE6OF01A7C4W.45.36.D03.1.454.CMB.1.raw
  modified_base (284)..(284): a, c, t, g, unknown or other
  misc_feature (284)..(284): n is a, c, g, or t
  modified_base (363)..(363): a, c, t, g, unknown or other
  misc_feature (363)..(363): n is a, c, g, or t
  modified_base (498)..(498): a, c, t, g, unknown or other
  misc_feature (498)..(498): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtgggagtcggggggagcgttgtccagcctggggaggtccctggagactctcctgtgcagcctctggattcctccctntagttaactttcggtttccacgtggggtcccgcctaggttccagggccgaagggggctgggagtcggggtcggcccctnagtttccgaagagtggaagtgaggaacggcctacgtcagacctccggtaggaacgggcccgctttcaaccatcctaccgacgacgaactaacgttaccaagtaacttcgttaccctttctttttcgactaaagtntaatacgtaccgtgaagtaggttaggacggtacgtacggttcttacgttacctttacgtttccgttgggtacgtaccgggtacggggtacgtactcgttacggttacggtaggttcgtttcgggttagtttaacggttacgttaacgttccgtaaacccg

SEQ ID NO: 111695 - DNA, 824 bp, Homo sapiens
  misc_feature: GYAE6OF01A30OS.45.36.D03.1.454.CMB.1.raw
  modified_base (204)..(204): a, c, t, g, unknown or other
  misc_feature (204)..(204): n is a, c, g, or t
  modified_base (738)..(738): a, c, t, g, unknown or other
  misc_feature (738)..(738): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggccaccctgtctctgtctccgagggganacagccaccctctcctgccgacgggcctaggtacggagtcgtcgtaagtaaggttacgttagggacttacggtaaccctaacgaacgtaaaacccgtcggaccgaacgggtccctacccgaacggtaccctcccttacaacctcccaagttcggaacttcggacctacgtacccgtaaccgtacggggttcccctacggggtcccgttacccgacggtaaccggtcgggttttacccggagggtcccgtaggggttcgggttacggtacggggaacgtacggtaacggtttccaaccggttcctaccggtaacccggttcgaaacgccgtaacggtccccggttagggacccgtacccgggttaagttaacggttcggttaaccgtttttaccggggaaccttttacgggttttaaccctttcggtacggttaccgttacggtaaccgttcggttaccccggttacccggtacccgtacccgtccggttacccgtacgggtttaccccgggtacgggggccggggttaaaccgngggggtacggtaccgaggttccggaacggtacgtaacgggtgtggccctacgacgtactcgttacgttcctaactcggtcctcccg

SEQ ID NO: 111696 - DNA, 808 bp, Homo sapiens
  misc_feature: GYAE6OF01DVW6J.45.36.D03.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctcaggcaccctgtctctgtctccgaggganacgcgcccaccctctcctgcagggccaaggtaggagtcgtacgagttaagtacgttaggcctagggtaccaacgaacgaaaccgtggacccaggcctccgaggcctccncactccatgatcggacactaccaacggacggttccccgtaggccgtacccgacggtaacgtcggggtttcccgagggccgtaagggtcggggtcgtaggggacgtaaggtaccggttccaaccgttccgtcccgtaacccggttcgaacgggtacccgtaaccgggcccgttaccggggacgtccccgtaggtaacgttacgttacgttttacggacgtttacgttttacctttcgttccgtacgacggtaccgtcgtacccggttacccaacccggaccgtcccgtacccgttacccgttaccgggtttacccgggggacccgggggggtaaccgttcggggggtaccgggtaacggtaaccggtacggggtaaaccgggtaaccggttaaaccgggttagggtaccggggttaccgtaccggtaccccttaaacccgggttaaccgttaccccggtttccgggtttacctttccccggtaacgttttaccccccgg

SEQ ID NO: 111697 - DNA, 830 bp, Homo sapiens
  misc_feature: GYAE6OF01D8HGS.45.36.D03.1.454.CMB.1.raw
  modified_base (205)..(205): a, c, t, g, unknown or other
  misc_feature (205)..(205): n is a, c, g, or t
  modified_base (401)..(401): a, c, t, g, unknown or other
  misc_feature (401)..(401): n is a, c, g, or t
tcagacgcgatcgacacgaccggtgctcgatttagctgcgtcacgatctctcttggggaggaactgctcagttaggacccagagggaaccgtggaagccccagctcagcttctcttcctcctgctactctggcctcccagataccaaccggaaaaattgtgttagacacagtctccaggcaccctgtctctgtctccgagggganacagcccaaccctctcctgaccacgggacctagtaggagtgtcaagtaacgtacttaggctaggtaaccaacgagaaaccgtgggaccacggcctacccgaggtcctcctacaactcccaagtcgaacttcgaccaacctaccgaaaccggtacggtcccgtacggtccgtacccaagtacgtaacgggtttccgnggacgtaggtcggtacgtacgggactaaggtcttacgaccttcgtaccgaccgtagaccgcgaacgtcccgtaggaacgtccgtagtacgttagttaactttcgacgtttacgtttacctttgtaaccgttcgaacggtacgtaccgggtttaccccgtacccgtacccgtaccggtacccgtacccgtttaacccgggttacccgggggtttacccgggggggaccgggggggttaaacccgtacggggggtttaacggaaaccgggttaaggttaaccgggaaacccggggttaaacccggttaacggggttccggggttaacggtaccccggttaacgggaaaccccttaccggttaaacggtttcccgtttaaacgggtttaccccttttaccgggaaaccctttttcccccggtaacccccggg

SEQ ID NO: 111698 - DNA, 861 bp, Homo sapiens
  misc_feature: GYAE6OF01BPYW5.45.36.D03.1.454.CMB.1.raw
  modified_base (419)..(419): a, c, t, g, unknown or other
  misc_feature (419)..(419): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctccaggccaccctgtctctgtctccgagggacgacacgccccgacccttccgtccgtgccgacggaccaggtacggagtgtcaagtagttacgttaggactggtaaccaacgacgaaaccgtggaccaggtcctacccgaggccttccctacgtactaccgtgtaggactcgaccgtaactaccgaaccggttaccgggttccccgtgggtccccgttacccgaacggtaaccgtccgggtttacccggngggtaccgttacgggtgggttaccggtacgggacgtaacggtacgtttaccctacgttacccgtaccgtaaccggtcgaacgccgtaacgcgtacgggacccgtcgtacgttagttacgtttacggttttacgtaccgtttaacggttttaccctttacggtttaccggttacgttcccggtaaccggttccggtttaccccccgggttacccggtaccccgttacccgggtacccccgtttcccgggttaaacccccgggtttaccgggggttttccccgggggggaacccgggggttaccggggtaacggggtaacggggtaaccggtacggtaaggggtaacccgtaaccgggtacccgggtgggttcggtacggtacccgttaacccgacggttaccgtttaccgttaccgttcccgtttaccttacccgtccccccg

SEQ ID NO: 111699 - DNA, 666 bp, Homo sapiens
  misc_feature: GYAE6OF01D8AP7.45.36.D03.1.454.CMB.1.raw
  modified_base (426)..(426): a, c, t, g, unknown or other
  misc_feature (426)..(426): n is a, c, g, or t
tcagacgcgatcgacacgaccggtgctcgatttagctgcgtcacgatactctccttgggggaggaactgctcagttaggacccagagggaaccatggaagccccagctcagcttctcttcctcctgctactctggctccagactaccaaccggaaaattgtgttgacacagtctccaggccacctgtctctgtctccgagggagacacggccctaccctctcctgcgacgggcctaggtaggagtcgtacaacgtaagtacgtaggtctacgtaaccaacgaacgaaccgtcggaccgacggcctacccgaggtcctaccgtcacttaccagtgatcgacactaccaactacgtacgtcccgtacgccgtaccaagaccgtacggtccgtcgacgtaggtcggtcgagggacaggtactcgactcncgacgtacagaccgacgtcctagggaacctcgtagactttagtacgttttccgattttaacgtttcttcgttagactacgtccgtaaccggtcccgttacccggacctacccggtccgtacccgtttaccgttacccgggggtttcggggaccggggtaccgtaggggcgtaagtcgtaggaccggtaacgtggtacgtcgggctacgaccgtacgttagtccgttcttcctgtaccccg

SEQ ID NO: 111700 - DNA, 748 bp, Homo sapiens
  misc_feature: GYAE6OF01AZUFO.45.36.D03.1.454.CMB.1.raw
  modified_base (241)..(241): a, c, t, g, unknown or other
  misc_feature (241)..(241): n is a, c, g, or t
  modified_base (463)..(463): a, c, t, g, unknown or other
  misc_feature (463)..(463): n is a, c, g, or t
tcagacgcgatcgacacgaccggtgctcgatttagctgcgtcacgatctctcttgggaggaactgctcagttaggacccagaggaaccgatggaagccccagctcagcttctcttcctcctgctctctggcctcccagactaccaaccggaaaattgtagttgacacgagtctcaaggctaccctgtctctgtcctcgaggggactacagcccacctcctctgcgaacgggccagtacggngttcgtacgtaaggttaacgtaccgtttaggccgttacggtaaaccgaacgtaaacggaaaaccgttcggaccgtaagggtccctacccggaagtcccgttcctaccgtctacccaagtcggtactcgaccacttaacccgaacggtcggtcccgtacggtaccccgtaccacggtaaccgtccggttaccggcgtacggtaggtccggggtagtaccgganacgggtacttcgaccgtttccgaccggtaccgtaccgggtacccggtacgtccggtacggtaaccggttccgtagtaccggtttaagtaccgttttagtccgtttaaacggtttccgttccttcgtaccgtgtaaccgtcggtcgttacccgtcgacccgtccgtaccgtcgttaccggttcgggaccgggacggtcgggaccggtaagtccggtacggaacgtccggaacgtgggtacggtcgtcgacccgacgttacgccgtttagtccgtcgtccgttaccg

SEQ ID NO: 111701 - DNA, 661 bp, Homo sapiens
  misc_feature: GYAE6OF01CPL7H.45.36.D03.1.454.CMB.1.raw
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccaccctctcctgcgagggccagtaggagtgtcagtaagtactaggctggtaaccaacagaaaccgtggaccaggcctacccgaggcctcctcatccaatcgatcgcactccaaacgcggtccctggaccgtcccagacgtacggttccgtggcgtaggtcggggtctacgggacacgtcgttccaccttcgaccgaccgtcacgacgacgccgtaggacgtcctaggtactgttaattttcgactagtttttactcgtcgtacgagtaccgtaggtcccgttcccgaccgccgtacccggtccttcccggttaccgggtttccgggggaccggggggttaccgtacgggggtacggaaggtacgtagggaaccggaacgtacggtgggttccggacgttcggacccgtaacgtcgtttacccgtcgttttacctcgtcccgtttaccccg

SEQ ID NO: 111702 - DNA, 781 bp, Homo sapiens
  misc_feature: GYAE6OF01B6D1R.45.36.D03.1.454.CMB.1.raw
tcagacgcgatcgacacgaccggtgctcgatttagctgcgtcacgagtctctcttgggggaggaactgctcagttaggacccagagggaaccgatggaagccccagctcagcttctcttcctcctgctactctggctccagataccgaccggaaaattgtgttgacacagtctaccagcctattctgtctctctctaccgaggggagacacgtccaccctctcatcgtcgagggccagtcagagttatacgaactattacgtcggtccttaggttactacaaactacgaacgccgtcggaccgtacggggtacccccggtctacccgtacacgttcttaagtcgtacgtcgtcccttaccgacggtccgtacgggtcccgtacggcccgtcccgaggtaccgtcggttccgcgggtaccgtagggttcgggtcgtacgggtaccgtaggtaccgtttaccgacttaccggtccgtaacccggtcgtaaccgggactaccggggtaccgttaggggaacccgtccttaagggtaacgtttcggttaaccgtttcgggtaaccgtttacgtttttaacctgggttccgtttaaccgacgggtacccttaccgggtacccgtacccgacccggaccgggttccctaccggttaccggttacccgggttacggggggccgggggtaaccggtggggtacgaacgggtagtcgggaaagtaacccggtacgttccgggttacgaccgggttaccacccgttacggttacttcggttccgttacccg

SEQ ID NO: 111703 - DNA, 936 bp, Homo sapiens
  misc_feature: GYAE6OF01CSIJ5.45.36.D03.1.454.CMB.1.raw
  modified_base (165)..(165): a, c, t, g, unknown or other
  misc_feature (165)..(165): n is a, c, g, or t
  modified_base (185)..(185): a, c, t, g, unknown or other
  misc_feature (185)..(185): n is a, c, g, or t
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggacttgggctgaccttgggttttccngttgcttactttaagaggtntccagtgtcaggtgcgaggtggtggaggtcggggggagtcgttgtccgagtccgtggggaacgtccctaggacgtacctccgtcctggtcgtacacgcctcgtaggtacgttcctccctacgtagttaacctttcggttccacgtcgggtcccgccgtacgggttccacgggtacgaaggggtccgtagggcggttagggtccgggtcccttaccgtaggttttaacccggaaggtacgtaggggtaaacggttagggaacggtaaacggtcctaacgtccggtaacggttaaccgttcccgggtagggtaaccggggtacccgttaccgttaccgtaccgtaaccgttacgtacccggtaacggtaaccgtaaacccgtaaacgtttaacccggtaaacgtaaaccggttacgttttaccccgtttaacgggtttttttacgaaaccgttaaaacgtttaaccggttaaaacgtttaccgggtaaaccccgttagggggttaaaaccgtttaaggggttaacgggtaaaccgggtaaaccgttaaccggtttacccggtttaaacggtttccgttttaaacggttttcccggtttaaccgttcggggtaaaccccggggtaacgggggtaacccggttacggtttaacccggtaacgggtttaacgttaaaccgggtttccgttacgggggtttaacggtttaaccggtttaaacgggtttaaaaccgttacccggtttaaaaaccccgg

SEQ ID NO: 111704 - DNA, 710 bp, Homo sapiens
  misc_feature: GYAE6OF01CKB1C.45.36.D03.1.454.CMB.1.raw
  modified_base (217)..(217): a, c, t, g, unknown or other
  misc_feature (217)..(217): n is a, c, g, or t
  modified_base (415)..(415): a, c, t, g, unknown or other
  misc_feature (415)..(415): n is a, c, g, or t
  modified_base (503)..(503): a, c, t, g, unknown or other
  misc_feature (503)..(503): n is a, c, g, or t
  modified_base (557)..(557): a, c, t, g, unknown or other
  misc_feature (557)..(557): n is a, c, g, or t
  modified_base (620)..(620): a, c, t, g, unknown or other
  misc_feature (620)..(620): n is a, c, g, or t
tcagacgcgatcgacacgaccggtgctcgatttagctgcgtcacgatctctcttggggaggaactgctcagttaggacccagaggaaccatggaagccccagctcagcttctccttccctcctgctactctcggcctcccagactaacccgaaccggtaaaattgtgttgaccacagtctccgaggcctccctgtcctctgtccgtaccgagggganacgacgaccctacccgttctccgtcgcgacggccgtaggtagggagtcgtacgtaagttaagttacgttaggacgtacggtaacccaacgaacgtaaccgtcgaccgtacgtacccgtccgagtccctctacactccgatgactcacactaccaacggtcggtccgtcggtacctacccgagtacgtccggttacggnggcgtggtacggtcgaggacgacgtctcgacctcgtacccgacgcgaagtccgacggccgtggaccgtccgtaggtacttacggtttntttcggactttacgtttctcggttacgtgacgccgttaccggttcccgtacccnccggttacccgcccgttacttaccggggtcggggttaaccggggacggggacgtggggtacgnggtcggaaggtaccggaagtccggtgggtacccgtcgaccgtacctaccggttctacgggttcctaccgttaccgtcccgttaccccggg

SEQ ID NO: 111705 - DNA, 748 bp, Homo sapiens
  misc_feature: GYAE6OF01BRG38.45.36.D03.1.454.CMB.1.raw
  modified_base (367)..(367): a, c, t, g, unknown or other
  misc_feature (367)..(367): n is a, c, g, or t
  modified_base (385)..(385): a, c, t, g, unknown or other
  misc_feature (385)..(385): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaaccggaaaattgtgttgacacagtctccaggccaccctgtctctgtctcgagggagacacgccaccctctcctcgcgacgggccagtaggagtcgtcaggtaacgtacgttaggctacggtaaccaacgtaacgaacctcggacccaggtccctacccgaggacctcccgtcactccatgactcgacactaccacgtacgggtccctgggtccctaccgngaaccgtacgggttccgnggcgtaggtcgggtcgtacgggactaggtacgttccgacttaccgtacgtaccccgtacacggtacgaccggttacccggtacgggaccgtaccgttacgacgtttacggttaagttttacggaccgttttaaccgttttacctttaccgtcggttaacccgacggttacccgtacgggtccccgttttacccgggaaccgtaccccggtccggtaccgttacccgttaaccgggtttcccggggggaaccggggggaccgtacgggggtacggaacgtacgggtaggtaaccgtacgggtacgttaggggtacggccgtacgaccgtacctacgttacgttacgttcttacgtcccgttccc

SEQ ID NO: 111706 - DNA, 603 bp, Homo sapiens
  misc_feature: GYAE6OF01DXUO9.45.36.D03.1.454.CMB.1.raw
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
  modified_base (463)..(463): a, c, t, g, unknown or other
  misc_feature (463)..(463): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgcccaccctctcctgcgagggccagtacggagtgtcagtaagtacttaggctggtaccaagagaaacctggccaggctccgaggcctctcactccatgatgcanccaacgtcggtccctggcctacccgagacgtacggttccgnggcgtaggtgggtcgtaggggacagtacgttcaaccttctacgtccgcgaagcgacgccgtcggacgccgttagattgttattttcgacgttacgtttacttcgtgtcngtccgacgtccgttaccgccgacgtccgtcgtaccgtacgggttccgggcgggggaccggtgggtcgtaggtacgtcgaggtaccgaacgttggtccggtcgtcgacgtacctacgttcgtcgttctcgtacgttccccg

SEQ ID NO: 111707 - DNA, 292 bp, Homo sapiens
  misc_feature: GYAE6OF01CCIEE.45.36.D03.1.454.CMB.1.raw
  modified_base (226)..(226): a, c, t, g, unknown or other
  misc_feature (226)..(226): n is a, c, g, or t
  modified_base (271)..(292): a, c, t, g, unknown or other
  misc_feature (271)..(292): n is a, c, g, or t
tcagacgcgatcgacacgaccggtgctcgatttagctgcgtcacgatctctcttggggtttggggggaagaggaagactgacggtcctcccaggagttcaggtgctgggcaccttgggcacgggggagtgtgtcacaagatttgggctcgtgggcaccgtgggcagtggggggagtgtgtcacaagtatttcgggcctgggctgcctggtacaaggactacttccncgactcgcgtctggacggcgggctgggacgaacggcgcaagtagnnnnnnnnnnnnnnnnnnnnnn

SEQ ID NO: 111708 - DNA, 632 bp, Homo sapiens
  misc_feature: GYAE6OF01D5D9R.45.36.D03.1.454.CMB.1.raw
  modified_base (289)..(289): a, c, t, g, unknown or other
  misc_feature (289)..(289): n is a, c, g, or t
  modified_base (589)..(589): a, c, t, g, unknown or other
  misc_feature (589)..(589): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggttttcctcgttgcttctttttaagaggtgtccagtgtcaggtgcaggtggtggaggtcggggggagcgttgtccagcctggggaggtccctgagactctcctgtcgcagcctcgtggtattcctccctntagttactttggtttccacgttcgggtccgcgtacggttccgaggcgaaggggctgggacggtgggtcgccctcgtatttccggaagagtggaagtgaaggaacggcctacgtaccagacctccggtaggaacgggcccgtcttcaccgtactccgtaccagacgaactaaattaccgaagtaacgtcgttcctttacgttttacgtactaagtacgtaatacgtactagaagtagtaggagtaccgtacgttctagtacttactttcgtgtacggtccggtaggggtactagttacgtntggtagttcgttgggttacgttagttagtaacgtactaaaccg

SEQ ID NO: 111709 - DNA, 884 bp, Homo sapiens
  misc_feature: GYAE6OF01AXUMS.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctctgctactctggctccagataccgaacgaaaattgtgtgacacagtctccaggcacctgtctctcgtctccgagggagacacgccaccctcgtcctcgcgacgggccaggtaggagtagtactaagttaagtacgtaggacgtacggtaaccaaacgacggtaaaccgtcggaccgtacggacctacccgaacggcctaccgtacgtactaccgagtgtacgtcgaacctacctacccgtaacggtaccgggtcccgtacgggcccgttacccgacggtaaccgtcgggttcccggtacgggacgtacggggtcggggtacgtacgggaacgtaccggttacgttaccgtaccgttacccgtacgtaacccggtcgtaacggtaccggtaccggtacccggtagggtaaccgtccgttagggttaccgtttacggtttaacgttttacggtacccgtttttaagtttaccgtttccggtcgttaaccgggtacggttccgggtaaacccgtttcccccgggttaccccgacccggttaacccgggttccccgttaaccggtttacccgggttaccggggggttacccgggggaccggggggtaacccgttagggggtaacggttaaagggccctaaaccggggggtaacgttaaccccgggttagggttccggtacgggggtaccctacccgggtaccccttaaacggttccggtttactttacccgggtttacgttaacccgtttcccgtttaaccccccggg

SEQ ID NO: 111710 - DNA, 755 bp, Homo sapiens
  misc_feature: GYAE6OF01DHSDC.45.36.D03.1.454.CMB.1.raw
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
  modified_base (553)..(553): a, c, t, g, unknown or other
  misc_feature (553)..(553): n is a, c, g, or t
tcagacgcgatcgacacgaccggtgctcgatttagctgcgtcacgatctctcgttgggggggaggaactgctcagttaggacccagagggaaccatggaagccccagctcagcttctctttcctcctgctactctggctcccagataccaacggaaaattgtgttgacacagtctccaggccaccctgtctctgtctccgaggggagacacgcccaccctctcctgccgagggccaagtaggagtgtacgagtaaagtacgttaggctaggtaacccaacgaagtaaacccgtggacccgaaggcctacccgaggcccttccctacactccagtgactgacactaccgaacggtaccgggtccncggccgtaccacgaccgtcgggttccgnggtcgtaacggtcggggtactggggaacctaagggtaccgtttacctaccgtaccgttacccgaccggtaccacgggtacccacgggttcccgtagggacccgttccggttacgaagtttacgttagttttcgacgtttacgtttttactcgtacgtacgngtaccgtacgtccggttaccccgcacccggtcgtaccctttcggtaccgggtttccggggggaccggggtacgtagggggtaacggtacggaagtaccggggtaacgaaccggttaaacgggttgggtccgggtaccctagggtccccaaacccgttcgggtttaccttacccggtttacgtttcgtaccccggtttacccc

SEQ ID NO: 111711 - DNA, 940 bp, Homo sapiens
  misc_feature: GYAE6OF01E2TYF.45.36.D03.1.454.CMB.1.raw
  modified_base (798)..(798): a, c, t, g, unknown or other
  misc_feature (798)..(798): n is a, c, g, or t
tcagacgcgatcgacacgaccggtgctcgatttagctgcgtcacgagtctctcttgggggaggaactgctcagttacggacccagtagggaaccatggaagcccagctcagcttctcttcctcctgctactctggctcccagactaccaaccggtaaaattgtgttgacacgtagttctaccgaggcctaccctgtctcgtcgtccgtcggaggggacacgacgccctacccgtcgtccgtgccgacgggcctaaggtacggacgtgtaacgtaggtaacgttacgttacggcgtacggtaacctaaacgtaacggtaaccgttcgggacccgtaacgggtccctaccgtacggtccttacccgtacgtaacgtaccgtagtacggtacgtaccggacctacgtacccgaaacggtaccgggtcccgtacgggtcccgtaccgtaacggtaccggtacggtttacccgggtggaaccgttacggggttacggggtacggtaccggggtaacgtaacggttaccgtaccgttactacccgtaccgtaccggtacgtaacgggtaccgtaccggtcgtacggggacctaccgtaggtacgtttaacgggtttaccttaggttaaccgtttaacgttttaccgttaccgtacgggtttaacccgtaacggttcccgtaaccggggtttaccccctaacccgggtacccaaccgggggttaccccttacccgttccgggggttttaaaaccccggggggttccggggggaaccccggggggtaacggttacccggggggtanaaaccgggttaccggttaacgggtaaacccgggtaaaacggttcgggtacgggttaacgggccctttaacccgggaacctaacccggttttcgttccgggttaaaccccgtttgttaaacccggtcccctttaaccccgggg

SEQ ID NO: 111712 - DNA, 754 bp, Homo sapiens
  misc_feature: GYAE6OF01EXEP8.45.36.D03.1.454.CMB.1.raw
  modified_base (206)..(206): a, c, t, g, unknown or other
  misc_feature (206)..(206): n is a, c, g, or t
  modified_base (352)..(352): a, c, t, g, unknown or other
  misc_feature (352)..(352): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggtactttgggctgaccttgggttttcctcgttgcttacgttttaagaggtgtccagtgtcagggtncgtagggtggtgggtaggtcggggggagtcgttgccgaggccgtggggacgttcccgtggacgtcctcgttccgtgtcgcacgtcctcgtggacttcccgtccctacgtaacgttaacgttttcggttcctacgttcggggtcccnccgttaggttacccggacggcggaaggggtcgtgggtacggtggggttccgcccgttactacgtttccggaagtagtaggaagtgaacggacggtctaacgtcgagtacgtccgtaggacgggcctcttacacctctccgtacagtaacgaactaacgttacgaagtattccgttacctttcgttttacgaacgttaagtacgtaacttacggtacgtagggtaacgttaaggttagggtaaaccggtaacgttacccggtttcgttacggttttactttaacgtttccggttacgggttaccggacgggtaacggggtacctttaacggtacgttagtacggttaggttccggttaagggttttacggtaggtttacgttaaaccgtaccgttaaaacccg

SEQ ID NO: 111713 - DNA, 828 bp, Homo sapiens
  misc_feature: GYAE6OF01AONRF.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaccggagaaattgtcttgacacagtctccagccattctgtctctctctccaggganacacgccaccctctcactgacgacgggccagtcagtacgtagttaagaactagttaacgtggtccgttggttaactactaaataccgaacgtcccgttcggcccgtacggggtcccccggtcctccctcgtactcctatcgacgtcgaccctttacgacggaccggtacggggaccctaacggtccgggacctaccgttaccccgtacggtacccggtacgggttttacccgcggggtttacggggtcgggggttttaccgggggttttacgggacccgttaaacggtaaccggtaaccgtttcccgtaaccgtttacccgtactaacgtaaccgttccgaaggtccctaacgtaccccgttaccccaaacggtttaagtaacgttacgttttacgaccgtacgtttaccttaagtttaccttaggtaacctaaccgtacggtaccgttaaccggtaagtacggtttaccggtaccccgtacgtttacccgttaccggggttttacccgggaccggggttaaaccggggtaaaccggtacggggttacggtaacggtaaccgttaaacccgtaaaccgggtaacgttcgggttaacggaccgtttacgacccgttaacccgtaacg

SEQ ID NO: 111714 - DNA, 745 bp, Homo sapiens
  misc_feature: GYAE6OF01EJCDY.45.36.D03.1.454.CMB.1.raw
  modified_base (238)..(238): a, c, t, g, unknown or other
  misc_feature (238)..(238): n is a, c, g, or t
  modified_base (389)..(389): a, c, t, g, unknown or other
  misc_feature (389)..(389): n is a, c, g, or t
  modified_base (540)..(540): a, c, t, g, unknown or other
  misc_feature (540)..(540): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccaggccaccctgtctctgtcctccgagggacacacgcccaccctctcctgccgaggccagtaggngtgtacagtaagtacgtaggcttacggtaaccaacacgtaaaccgtcggaccacggcctccgacgtcctcctacactccctatacgtatcgactactacccgaacgaccgggtccctggacccgtaccacggtaccgtacgggttcccggnggtacgtagggttcgggtacgtacggggaactacggtacgtttaccgactttacccgaccgtaccgttcgacggcgtacggtccgtaggtaccgtccgtaggtacttaggtttactttcgtacgtttacgtttttacctcgttcggtaccncgtccgtacgttcccgttccgacccgtccgtcccgtccgtaccggttaccgggttacccgggggaccggggtaccggtaggggtacgggacggtacggttacggaacggttaccggtaacgggttcgggtaccggtcgtaccggtaaccgttaacccgttgttaacccgttggtttaccccttcccggttccgtttaccccccgg

SEQ ID NO: 111715 - DNA, 995 bp, Homo sapiens
  misc_feature: GYAE6OF01BZA09.45.36.D03.1.454.CMB.1.raw
  modified_base (208)..(208): a, c, t, g, unknown or other
  misc_feature (208)..(208): n is a, c, g, or t
tcagacgcgatcgacacgaccggtgctcgatttagctgcgtcacgatctctcgttggggggggaggaactgctcagttaggacccagagggaaccatggaagccccagctcagcttctcttcctcctgctactctggctcccagataccaaccggaaaattgtgttgacacagtctccaggcaccctgtctctgtctccgaggggganacacgccacctctcctgcgagggccaggtaggagtgtcaagtagtacgttaggctaggtaaccaaacgaagtaaccgtggaccaagggtcctacccgaggtacctcctcaatccaatcggaatcgactaactacccgaaacgtccgggtcccgtcggtacccggttaccccaaggaccgttaacggggtttcccggtaggggaccgtaagggtcgggggtcgtaaccggggggtaacaacgggttaacggtttccgtaaccttaccgttaccgaaaccccgggttaccgaaggtacccgtaaacggggtcccccggttaaggggtaaccgtaccccgttacgggtaagtttttacggttaacggtttttttaacggaaccccgttttaaagggttttttaaaccccttttccgggttttaacggtacccggggtttaaaccaaccccgggtttaaacggggtccccggtttttaacccccggggacccccgttaaaacccccgggtcccccgggtttacccgttttaaaccccccggggtaaccggggggtttttttaccccggggggggggaaacccgggggggggttaacccggggttaaacgggggggttcggggaaaaacgggttacggggttacgggggaaaaaccccggtaaccgggtttaaaaaccggttcggggggttaccggtacgggttaacccccgaacccggaaacccctttaaacgggttttccgtttaacccgggtttccgtttttaaacccgttaaccggtttaccccccgg

SEQ ID NO: 111716 - DNA, 873 bp, Homo sapiens
  misc_feature: GYAE6OF01A6WDE.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagcccaccctctcctgcacgggccagtaggagtgtacagtaagtacgttaggctaggtaccaacgaacgaaaccgtggaccaggcctacccgaggcctccgtcactcccatcggatcgactactacccgaaacggtaccggggtccccgtacgggcccgttaccccgaaacggtacccggttaacggggttttccccggtcggggacggttaacggggttcgggggttacggttacgggggaaccctaaggggttaccgtttaccgaaccgtttcccgtaccgtaaccccggttacgtaacggcccgtaaccgggtcccgttaggggaaccgtcccgttaagggtacgtttacggttaacgtttttacggaccgtttttaacggttttacccgttttcggtcggtttaccgacgggtacccgtacgggtttacccccgttaccccggcccggtaacccggtccccgttacccggttacccggtttacccggggttttccggggggaaccccgggggggtaccggttaggggggtacggtaacgggtacggtacggggtaaacggtaacccgggttaaccggttggggttaacccggcgttaccggtaaccctacccgttacggtttccgttacggtttacccgttccgttaacccgggtttcccccc

SEQ ID NO: 111717 - DNA, 744 bp, Homo sapiens
  misc_feature: GYAE6OF01A938U.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctcggccccagactaccaaccggaaaattgtgttgacacagtctccgagcaccctgtctctgtctcgagggacacacgccacctctccgtgcgacgggcctaggtaggtagtgtacaggtaacgtacgttaggcgtacggtaaccaaacgaaccgaacgtacggaccgacggcctaccgacgtcctacctactactcagtagactacgactacctaccgaacggtaccggtccgtacggtacccgtaccgaacggtaccggtacggttccggagtacggtacgggttcggttacggacgggactacggttcgtacctccgtccgtaccgtacgtcgaacgtccgtacgacggtggacctcgtagtagttgttacttcgatttacgtttccagtctacgacgttccgtaccgtcccgttcccggacccgtaccgtccgttacgttacccgggttaccggggtccggggggtaacgggtccgggtagggtaagacggttaccggtaacggacggggttaaacccctggggtcgttaccggggacctacccgtacctaaccgtttacgttcgggttaccccttacccgggttaaccctcccgttttccccggaacccg

SEQ ID NO: 111718 - DNA, 688 bp, Homo sapiens
  misc_feature: GYAE6OF01BUF57.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaattgtgttgacacagtctccaggcaccctgtctctgtctccgagggganacagcccaccctctcctgcagggccagtaggagtgtcagtaagtacttaggctggtaaccaacagaaacctggccaggcctcccaggctcatcatccatgatcgcactccaacgtacgggtccctgggcccgtacccgagacgtacgggttccgtggacgtagggttcgggtacgtggggacaggtacgttccacctcctaccgtaccgtcgacggccacggtcccgttggacctccgtagattgttattttcgacgtttacgtttttacgtcgttgtccaggtcctacgggttccgttcccgcccgtaccggtccccgtccgttaccgttacccgggtttccggggggacccggggggttaaccagggggtaggacggtaaggttacggaacgggttaacgtaaccgggttgggtaccggtcgttacggacccgttaaccgtacggttccgttacgtttaccctttccgtaccgtttccccccgg

SEQ ID NO: 111719 - DNA, 829 bp, Homo sapiens
  misc_feature: GYAE6OF01DMLGV.45.36.D03.1.454.CMB.1.raw
  modified_base (207)..(207): a, c, t, g, unknown or other
  misc_feature (207)..(207): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggcctcccagataccaaccggtaaaaattgtgttgacacagtcctccgagccacctgtctctgtctccgaggganacacgccaccctctcctgcggacgggccaaggtacggagtgtacgtaagttaagtacgttaggaccgtacggtaaccaaacgaacgtaaaacccgtgggacccgtaacgggaccctacccggacgggtcccttaccctaccaacttacccaagttggaagtcgacctaacgtacccgaaccgggtaccgggttacccctccgggtaccccgtacccgtacggaaaccggtacggggttccggtacggtaccggttaggggttacggggtacggtacggggtaaacacggttacgtcctaccgttccgtaccgaccgttcgaacggccgtacggtcccggtagggacctaccggttagtaacgtttcggtttaatttccggtaacgtttaacgttttaccttcggtaacggtacccgtaggtccgtaccggttacccggttccccgaccgacccggttcccggttaccggttccggttaccgggggttcccggggggaccgggggttaccgtaggggggtacgtagggtacgtacgggaagggtaacccggtaggttcgggtaccggcttaccgggacccttacgttactcccgttacgtttaccgttcctacccgttccccg

SEQ ID NO: 111720 - DNA, 881 bp, Homo sapiens
  misc_feature: GYAE6OF01DVP33.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttccctcctgctactcgtggcctcccagactaacccgaaaccggtaaaaattgttgttgaacacgtacgtcctccgaggccaccctgtcctctgtcctccgaggggacacgaccgcccaccctctcctgacgacggccgaggtaggagtcgtacgtaagtaacgtacgtaggcgtacggtaaccaaacgtaacggaaacccgtcggacccgaacggtccctacccgacggtccccttaccctacgtaccgtaccctaagtcggtacgttcggacctaaccgtacccgtaaaccgggtcccgggtcccgtcggtaccccgtaccgaacggtaccgttaccggggttccggtcggtcgtacggggttagggtccgtaaggggaccctaggttaccgtccctaccgttacccgaccgtaaccggtaccgaacggaccgtaaccgggtccgtaaggggtaccctccgttaaggttaacgtttcggttttacgtttccggaacgtttttaaccggtttttccgtaccggttcgtacccggaacgtcccggttacgttaccccggttcccgaacccggtcccggttaccgtacccgttccggggtttaacccgggggtccgggggtacccgggggtaattgggggaacggtaggtaacgtaccggggtaaaggtaaccggtttacgggtcggtcccgggaaccgttccggtaaccccgtacgtttcggttcccgttaccggtttcccctttacggaccccgttttccccccgg

SEQ ID NO: 111721 - DNA, 899 bp, Homo sapiens
  misc_feature: GYAE6OF01E31EM.45.36.D03.1.454.CMB.1.raw
tcagacgcgatcgacacgaccggtgctcgatttagctgcgtcacgatctctcttgggtttcggggggaagaggaagactgacggtcctcccaggagttcaggtgctgggcaccgttggggcgacgggggaggcgttgtccaggccgtggggacggtcccctggacggtaccttcctccgtgtcgcacgcctcgtggtacttcctccctcgaagtttaaccgttttcggtttccacgttcggggtccgccgtagggttccgaggcgaaggggccgtgggaggtgggtcgcccttctagttaccgaagtagtaggaggtggaagacggtcctacgcacgacgtccggtaggaacggccgtactaccgacctacgtacctaccgaaggaacgtaccgtaaacttaccgaaaacggtaacgtttccggtttaccctttagttttttaccgaaacgttaaagtacgttaaacgttacggtaccgttaaggtaacgggttaacgggtttacgggaaaccgggtaacgtttaccggttaccggttttacgtttaccgttttaagttttcccgtagggtaccgggtaaccggggacggggttaacctagttacggttaacgtacggttacggttcgttacgggttttacggttaacgttaacggtaaccttacgtaaaacccgtttacttaacccgttaaccgtacgtaagggttcggtaaccgttacggggtaacgggaaccggttaaaccgggtaccgttcccggttacctacccgggttcctaccggtccgtacgtacccgtccggaaacccgtaccgggacctttaccgggtccccgttcccgttccccggtcggccccgtccgtaccgtcccgtacggacgcccgtaccgccgggtaccggg

SEQ ID NO: 111722 - DNA, 788 bp, Homo sapiens
  misc_feature: GYAE6OF01CQ2O7.45.36.D03.1.454.CMB.1.raw
tcagacgcgatcgacacgaccggtgctcgatttagctgcgtcacgatctctcttgggggccctgggggaggaactgctcagttaggacccagagggaaccatggaagccccagctcagcttctcttcctcctgctactctcggcctcccagactaccaaccggtaaaattgtgttagacacagtctccgaggccaccctgtctcgtcgtcctaccgaggggacacgacgcccaccctctcctgccgacggccaggtaggtagtacgtacgaagtaacgtacgttaggtcgtacggtaaccaacgaacgtaaaccgtcggaccgacggtcctacccgacggtcctcctacactacctagtacgtacgttacgacctaacgtaccgaacggtaccgggttcccgtacgggtccccgtacccgtaacggacgttaccgggttccggtacgggtacgtacggggttcgggttacggtacgggaacgtaggtaccggtttaccacgttccgtaccgtacgacgtacgacgtaccggtcgtaggtacgtaccgttagtacgttagttacgtttcgacgtttaccgtttacgtcgtacggccgtacgtccgttacgggtcccgtttaaccgacccgtaccggtcccgtaccggttacccggttaccgggggttcccggggggacgggtaaccgggttagggtaccgggtaagtacgggtaacgggtaaacggaccgttacgggcggtacggtcctaaccggccttacgttaccgtcgtttcggtcccttaacccg

SEQ ID NO: 111723 - DNA, 858 bp, Homo sapiens
  misc_feature: GYAE6OF01C86YQ.45.36.D03.1.454.CMB.1.raw
  modified_base (204)..(204): a, c, t, g, unknown or other
  misc_feature (204)..(204): n is a, c, g, or t
  modified_base (612)..(612): a, c, t, g, unknown or other
  misc_feature (612)..(612): n is a, c, g, or t
tcagacgcgatcgacacgaccggtgctcgatttagctgcgtcacgatctctcttgggggaggactgctcagttaggacccagagggaacatggaagccccagctcagcttctcttcctcctgctactctggcctcccagactaccaacggtaaaattgtgttgacacagtctccaggccacctgtctctcgtctccgagggganactacgccctaccctctaccgtcgacgacgggaccaggtaggtagtgtacgaagttaacgtacgttcggacgtacggtaaaccaacgaacgtaaaccgtcggaccacgggtccctaccgtacggtcccttacctaccgtactaccgagtacggactacgtacctaacgtaccccggaacggttccgggtacccgtaccgggtaaccccggtaccgaacgggttaacccggttcggggttaccggacgggtcggttaggggtcgggttacgggtacggtaacgtaggtttaccctacgttaccgtaccgtacccggtaccgtacgtaaccgtcggtaccggtaccggttcgggaacctttcggtagttaaggttttactttacggtttaccgtacgtttaccttttacncgggtttaaccaggtacccggtcgtaccccggtacccccggtacgtcccggtacccgtacccgttccgggtttacccgggggtacggggttaccggggggaaccgggttaacgggaggggttaacctaacgggtacggtaaacggggaacccgttaacggggtggttgtacccggggactttaacccgaccggttttagtacccccggtttttacccggtaccctttccgtacccccggtttaccg

SEQ ID NO: 111724 - DNA, 790 bp, Homo sapiens
  misc_feature: GYAE6OF01CH3Y3.45.36.D03.1.454.CMB.1.raw
  modified_base (226)..(226): a, c, t, g, unknown or other
  misc_feature (226)..(226): n is a, c, g, or t
  modified_base (313)..(313): a, c, t, g, unknown or other
  misc_feature (313)..(313): n is a, c, g, or t
tcagacgcgatcgacacgaccggtgctcgatttagctgcgtcacgatctctcgttgggggaggaactgctcagttaggacccagagggaaccatggaacgccccagctcagcttctcttcctctgctactctggctcccagactaaccgaaccggaaaattgtgttagacacagtctccaggccacctgtctctgtctccgagggacacgcgacccaccctctccngccggacgggaccaggtaggagtgtctaaggttagtacgtggtactacggtaaccaaccgagaaccgtcggaccgacgtaccaccgngacctacgcctatacttcgtaacgtcgacctcgtaacgacggacgacggtccgacgtggaccaccgtccggtagaccgtacggttacgaggttcggaaggtcggtttcgggagtacgggaactacgtaccgtttaccacgttcctaccgacttagacgccgtacgtaacccgtacgggtttacccgtacggtaaggttaacggttttaccgttaccgttaccgttttaaaccggttttaccttaacggtttcggttaccaaccggggttccggtaaccgggttcccggtaaccggacccggggtaacccggtaccggggtccccgtttacggttaccgttcccgggttacggggaaaccgggtaaccgggtaacgtaaacggggccggtaaacggtaacgtaacccgggtaaacgttcggacgggttacgaacccggttaccaacggttaccctacggtttcccgtcctttacccgg

SEQ ID NO: 111725 - DNA, 756 bp, Homo sapiens
  misc_feature: GYAE6OF01BP95A.45.36.D03.1.454.CMB.1.raw
  modified_base (701)..(701): a, c, t, g, unknown or other
  misc_feature (701)..(701): n is a, c, g, or t
tcagacgcgatcgacacgaccggtgctcgatttagctgcgtcacgatctctcttgggggaggaactgctcagttaggacccagagggaaccatggaagcccagctcagcttctcttcctcctgctactctggctcccagactaccaaccggaaaaattgtgttgacacagtctccaggccacctgtctctgtctccgagggacacacgcccaccctctcctgcgacgggccagtaggagtgtacaagtaacgtacgtaggctaggtaaccaacgacgtaaaccgtcggaccgacggtcctaccgaacggccttacctacgtacctacccgtagtacggtaacttacggacctaacgtaacccgtaaaccggtaccgggtcccctgggtaccctacccgaacggtacggtaccgggtttccggacggtacgtagggttcggtacggtaacgggtacgtacggtacgttccaacttccgtaccgaccgtcgacgaccgtacggtccgtaggaacgtccgtagtacgttgtttacgttacgtacgtttaaccgtttccgttcgtacggttacacggtaccgttccggtcccgttacccgccgaacccgtccgttaccgtacgggttaccggttcccgggggaacgggggtactagggggacggtaagcggttcgggaaacgtacggtacggtggccggttaacnccggtaaactaccggtacgtttcgttaccggtctttaccggtcccgtttacccgg

SEQ ID NO: 111726 - DNA, 851 bp, Homo sapiens
  misc_feature: GYAE6OF01A5OFY.45.36.D03.1.454.CMB.1.raw
  modified_base (206)..(206): a, c, t, g, unknown or other
  misc_feature (206)..(206): n is a, c, g, or t
tcagacgcgatcgacacgaccggtgctcgatttagctgcgtcacgatctctcttggggaggaactgctcagttaggacccagagggaaccatggaacgccccagctcagcttctcttcctcctgctactctggcctcccagactaccaaccggaaaattgtgttgacacagtctccaggccaccctgtctctgtctccgagggganacacgcccaccctctcctgcgagggccagtaggagtgtacagtaagtacgttacggcgttacggtaaccaaacgaacggtaaaacccgtcgggacccgaacgggcccttacccgaaggtccccttaccctacaacgtacccagtacggactcgacctaaccgtacccgtaaacggtaccggggtttccccgacggggtccccgttaccccggaaacggtaaccggttaccggggtttcccggtagggtaccggtaagggggttcgggggttaccggtacgggggaacctaacgggtaccgttttaccaaccggtttccctacccggtacccggttacgacggcccgtacggtcccggtagggtaccgtccttaggtaagttcggttaacgttttcggacgttttaactttaccgttcgttcgtaccgtaggtccgtacggttccccgtaccgcccgaaccgtcccgttacgttacccggttaccggggttccggggggaccggggtaaccgtagggggtacggaacgttacgggtacggtaaacgggtaccggtaacggttcggggtaccggacgttaccggaacccgtaccgttaacgtttcccggtttcgttaacccgtttccgtaacccgtttccccccggg

SEQ ID NO: 111727 - DNA, 769 bp, Homo sapiens
  misc_feature: GYAE6OF01A0Z55.45.36.D03.1.454.CMB.1.raw
  modified_base (737)..(737): a, c, t, g, unknown or other
  misc_feature (737)..(737): n is a, c, g, or t
  modified_base (745)..(745): a, c, t, g, unknown or other
  misc_feature (745)..(745): n is a, c, g, or t
tcagacgcgatcgacacgaccggtgctcgatttagctgcgtcacgatctctcttgggggaggaactgctcagttaggacccagagggaaccatggaagccccagctcagcttctccttcctcctgctactctcggctcccagactaccgaaccggaaaattgtgttgacacagtcctcaggccacctgtctcttcgtccgtccgaggggactaccgacgaccccgaccctcctcccgtcggccgacgggacccgtaaggtacgggtaagtcggtaccgtaaggttaaacgttacggttaggtaccgttacggtaacccaaacgaaggtaaaacccgtcggaccgaacggtccctaccgaacggtcctacctacgacctaccgagtgacttcggctaccgtacccaacggtccgggtcccgtcgggtacccgtacccacggtaccggtacgggttacccggtcggtcgacggttgggtcgcgggtactaggtcgttcacctacgtcccgaacttccgacgtccgaccggtcgtacggtacgtcgtacgttacgtgtttacgtttcgtacttactttaccgttcgtacgttcgtacggtccgtacggttcccgttcccggaccctaccccggtccgttacccgttaccgggtttacgggttacccggggggtacggggtaccggtaggggtggtaaccggtggtacggaacggtacggtaacgtgggtacgtcggtacnccgtactnttacgtcttcgtcgttccgtaccg

SEQ ID NO: 111728 - DNA, 749 bp, Homo sapiens
  misc_feature: GYAE6OF01B2Y01.45.36.D03.1.454.CMB.1.raw
tcagacgcgatcgacacgaccggtgctcgatttagctgcgtcacgagtctctcttgggggccctggggaggaactgctcagttaggacccagagggtaaccatggaagccccagctcagcttctcttcctcctgctactcgtggctccagataccaccggtaaaatttgtgttgacactaagtctccaggtcacctgtctctgtctccgagggagacacgccgacctctccgtcgcgacgggtccgagtaggagtcgtcgacgtagtacttaggcttacggtaccaacgaacgtaaaccgtcggtaccgaggtcctaccgaggtcctcctcgactccagttcgacgtcgactacgtaccgaacgtaccgggttcccgtacgggtcccgtaccgtaaacggtaccgtaacgggtttccggtacggtacgtacggggttcgggtacgtcgggtaaacgtacggtacgttacgtacgttccgttacgaccggtacgacgtccgtacgtccggtaggccgtccgtaggtaacgtacgtttacgtttacgacgtttacgttttacctacgttgtaaccgtcgtcgtaacgttccgtacccgaaccgtcccggtccgtaccgttacggttacccgggtttccgggggaccgggggttacccgtagggggtacgtacggtaggttacggaacggttaacgacggtcgggtacgtccacggtaccgtacgttaccgtcgtttagtccgttaacccgg

SEQ ID NO: 111729 - DNA, 715 bp, Homo sapiens
  misc_feature: GYAE6OF01BU5DG.45.36.D03.1.454.CMB.1.raw
  modified_base (275)..(275): a, c, t, g, unknown or other
  misc_feature (275)..(275): n is a, c, g, or t
  modified_base (315)..(315): a, c, t, g, unknown or other
  misc_feature (315)..(315): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgcttcgttttaagaggtgtccagtgtcaggtgcagggtggtggaggtcgggggagtcgttgtccgagccgtagggacgtccctgacgactctcctgtgcagcctntggattcctcctcagttactttcggttccacgtgggtccncgtacggttccgaggcgaacggggctgggagtgggtcgcccttgacgtttccggaagtagttggaaagttggaacgtaacggtcctaacgtccgaacggtaccgtacccggtagggaaccgggtcccgtacgttcgaaccctacgtaccgtaccgaacggacgtaaaccttaaccgttaaccaacgtaacgtttcgttaccctttacgtttttacgaactaagtagtaaacttacggtaccgtaggaacggttaacggttaggaacgggtaaccgttacgttcgttacgttacgtttaacgtttcgttcggtacgtaccgggaacgggggtacctagttaccgttagttacgtaggttcggttacggtttaggttaagttagttaagtaccgttaaaccg

SEQ ID NO: 111730 - DNA, 735 bp, Homo sapiens
  misc_feature: GYAE6OF01EMQPN.45.36.D03.1.454.CMB.1.raw
tcagacgcgatcgacacgaccggtgctcgatttagctgcgtcacgatctctcttgggggaggaactgctcagttaggacccagagggaaccatggaacgccccagctcagcttctcttcctcctgctactctggctcccagacgacctcggaagaaattgtcttgacacagtctccaggccaccctgtctctgtcctccgaggggacacgacgcccaccctcgtaccgtgacgacgggccgtaaggtaggagtcgtacgtaaggttaagttacgttacggtacgtacggtaaccaaaccgaacgtaacccgtcggacctacggcccttacccgacggtccctccctacgtacctacctaagtcgtaacgtcgaccctaactaacccgaaacggtccggtttcccgccggtaccgtacccgaaggtaccggtacggttccgtggtacgtcgggttgggtccggtagggacctacggtacgttacctaccgtctaccgtaccggtacgacggctacggtccgttacgggacgtccgtagtacgttagttacgtttacgtaccgtttacgttttcttacgttgtactacggtaccgtaccggtccttacccggacccgtcgtaccccggtcttaaccgggttcggttaccgggggaccgggtacgttacggggagacgtggtacgaggtacgtaggtcggacgcgtacgactaccgtctagttcctactcgttacccg

SEQ ID NO: 111731 - DNA, 794 bp, Homo sapiens
  misc_feature: GYAE6OF01DDV2F.45.36.D03.1.454.CMB.1.raw
  modified_base (230)..(230): a, c, t, g, unknown or other
  misc_feature (230)..(230): n is a, c, g, or t
  modified_base (407)..(407): a, c, t, g, unknown or other
  misc_feature (407)..(407): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (478)..(478): a, c, t, g, unknown or other
  misc_feature (478)..(478): n is a, c, g, or t
  modified_base (566)..(566): a, c, t, g, unknown or other
  misc_feature (566)..(566): n is a, c, g, or t
tcagacgcgatcgacacgaccggtgctcgatttagctgcgtcacgatctctcgttgggggaggaactgctcagttaggacccaggagggaaccatggaacgccccagctcagcttcttcttcctctgctactcgtggctcccagataccaacggaaaattgtgtcacactagtctccgagccacctgtcctctgtccgccggagggacgacgtccgaccctaccctctcncgcgacggtaccgaggttaggagttagtacgtaaggttaacgttacgttaggccgttaacggtaaccaaacgaacggaaaccgtccggaccacggccctaccgacggtaccctccgtactaccgtcccgtagtaccgtatacggaccaaccgttaccgaacggtaccgggttcccgnggtacccgaccgagtacgtacggttcgagcgtagtcgggtagcggaanagtcncgtacncgtacgaccgtnaacgcgaccggtagtcgacgtactagtactagtttacgtttacggtacttttacggttacctttggtctaacggtcgtaacccgggtntttaccccggacccgtcggtaaccctcccggtaccgtttacccgttaaccggggttccgggggaaccgggtaacccgggtggggtaaccggtagggttaccgaaacggggtaaccgttaaccgggtaaaggtttcccgggaggggttcccttaacggggaccccttaaacgggttccgttaaaccggtttcccgttaaccgtttacccggtacgttttacccccccgg

SEQ ID NO: 111732 - DNA, 864 bp, Homo sapiens
  misc_feature: GYAE6OF01CWP6O.45.36.D03.1.454.CMB.1.raw
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
tcagacgcgatcgacacgaccggtgctcgatttagctgcgtcacgatctctcgttgggggaggaactgctcagttaggacccagagggaaccatggaacgcccagctcagcttctcttcctcctgctactcgtcggcctcccagactacccagtaggaagtaaagtaggtggtggaccgctagtcctcccacgtccctacccttgttcttttcggttaccggaagggggaaaacnccgccctaccccgttctccgtgccgaacgggtccctaggtaccgaaggggttacttaacngtacttacgttacgcctacggtaaaccaaaaccgtaaaaccgtcggaccgacggtcctacccgaggtaccttacaactactaacttactaacgttcggaaccgtctaaccggtaccggaaaccggtaccggggaccctaaccggttacgggacctaacccgtaccccgaacgggtaccccggtttaacgggtacttaccggggtaggaccggtaagggggtttccggggtacggttacggggaaacttacggtacctttacggtaccctttacgacccctaacctaacgtacgacgtaccgtaccgggtcccgtaccgtaaccgttgggaacgttttacgtttacgtaaccctttaacgttttaccgtaccggtttacgttaacgaccggtaacggtacgggtacccggttaccgggaaccgggtaacccgtcggtacccggtttcgtaccgttaccggggttacgggaccggggttaacggtaacggaagggtacgaggtaccgtaaaggtaacccgtaggtacggtacgtacgaccgtactacacgttctacgttactcgtaacccg

SEQ ID NO: 111733 - DNA, 908 bp, Homo sapiens
  misc_feature: GYAE6OF01B0DAB.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaaccggaaaattgtgttgacacagtctccaggcacctgtctctgtctccgaggganacacgccaccctctcctgcgacgggccaggtaggagtgtacaggtaagtacgttaggcgtacggtaaccaacgaacgtaaaccgtcgggaccaacgggtccctacccgaacgggtcccttacccgtacacgtttacccgaagttcggtaacttcggaacctaaccgtacccgtaaaaccgggtaccggggttcccctacgggtaccccggttaccccgaacgggtaaccggttaccggggtttcccggttacgggaccggtaacggggttcggggttaccggtacgggggtaacctacgggttaacgggtttacccaaccgggtttaccctacccggtaacccggttaccgaaaccgggtccgtaaccgggtcccgtcgggggtaaacctcccggttaggtaacgttttacgggttacgttttacggtaaccggttttaagtttttacccgtttcgtttccggtaaccgttaacggtcccggttaaccggtcccggttttaccccggaccccgttaacgggtcccccgtttaacggttccccggttaacccgggggtttccggggggaacccggggggttacctaggggggttaccggtaacggtaggtaccgggtaacggtacccggtaacggtttgggcccggtacggtacccgtacccgtaccgtacgttttccgtagtttcccttacgtcccgtttaccccg

SEQ ID NO: 111734 - DNA, 845 bp, Homo sapiens
  misc_feature: GYAE6OF01EBAA1.45.36.D03.1.454.CMB.1.raw
  modified_base (197)..(197): a, c, t, g, unknown or other
  misc_feature (197)..(197): n is a, c, g, or t
  modified_base (513)..(513): a, c, t, g, unknown or other
  misc_feature (513)..(513): n is a, c, g, or t
  modified_base (597)..(597): a, c, t, g, unknown or other
  misc_feature (597)..(597): n is a, c, g, or t
  modified_base (819)..(819): a, c, t, g, unknown or other
  misc_feature (819)..(819): n is a, c, g, or t
  modified_base (834)..(834): a, c, t, g, unknown or other
  misc_feature (834)..(834): n is a, c, g, or t
tcagacgcgatcgacacgaccggtgctcgatttagctgcgtcacgagtctctcttggggaggaactgctcagttagacccagaggaaccatgaagcccagctcagcttctcttcctcctgctactctggctcccagactaccaccggaaaattgtgttgacacagtctcaggcaccctgtctctgtctccgaggganaccgacgccctaccgtctcctcgacgacgggcctaaggtaggacgtcgtactaacggttaagttacgttaggtctacggtaaccaaacgtaaccggaaaaccttcgggaccgtacggtaccctacccgacggtccctaccctacaaccgttacctagtcgaacgttcggacctaaccgttaccccgaaacggttaccggggttccctagggtaccccttacccggaacggttaaccggttacgggtttccccggtaaggtcccggttaagggttcggggtacgttacggggaaccgttaaggtaccggtttaaccnccgtttacccgtacccgttaaccggtaccggtaaccggaccgtaccggttccgtacggggtaacctccgttaaggtaaccgttntttaacgtttacgtacgtttaccgtttacttcggttcgtacgtacggtaaccgtacgttccccggttccacccggtcccgttccccgtaaacgtttcccgggtaaccgggttttccgggggaacggggtaccggtacgggtcggtaacgtacgggtcgaaaccggtcgggtttaaactcggggttactacgtacccgtaacccgcttaaccggtcctttacncccggttttaacccncgttacccccg

SEQ ID NO: 111735 - DNA, 988 bp, Homo sapiens
  misc_feature: GYAE6OF01AWG80.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgtctcttttaagaggtgtccagtgtcaggtgctagggtggtgggaggtcgggggggagcggttgtcccgaggccgtggggacggttcccctggacgtactcgttccgtaggtcgcacgtcccgtcgttggactttcctaccccgttcgtaacgtttaaccgttttcggtttccccaacggttccgggggttccccgtaccggtaaccgggttttcccgaaggggtacccggtaaacgggggggtcgttacgggggaacgggtttccgggggttaccgggtcccccccgtttaacggttaacccggtttttaacccgggaaaacggtagggttaacgggggtaaacggtttacggggaaaacggggtaaaacccggggttaccccctaaacccgttaccggaaccggttaaccccgttacccgggggttaaggggtaaaaccggggggtttccccccgtaaccggttttacccccaacccccgttaacccgttaccccgttaaccccggtaaccggtaaaccggtaaaacccgttaaaccccgtttaaacccgtaaaacggttaaacgttaccgggttttaaccccttttaccgtttttaacggtaaccgtaaagttaacggtaaacgttaacgtaccgttaacggtaaggttacggttacggtaacggtaacccgttaacggttacgtttacgttactttaacggtttcgttacggtacgggtcccgggtaagggggtaacctagttaccgttaggtacggtacggttccgttacgggtttacggttaggttaacgttaacgttaccgttaaaacccg

SEQ ID NO: 111736 - DNA, 850 bp, Homo sapiens
  misc_feature: GYAE6OF01C95PU.45.36.D03.1.454.CMB.1.raw
tcagacgcgatcgacacgaccggtgctcgatttagctgcgtcacgatctctcttgggggaggaactgctcagttaggacccagagggaaccatggaacgccccagctcagcttctcttcctcctgctactctggcctcccagactacccgaaccggaaaaattgtgttgacacagtctccaggcaccctgtctctgtctccgaggggacacacgcccaccctctcctgccgacgggccaggtaggtagtcgtcgaagttaacgtacgttaggtcgtacggtaacctaacgaacgtaaacccgtcggacccgtacggtcctacccgacggtcccttacctacactccaagtgactacgacctacgtacccgaacggtacgggtcccgtcgggtcccgtaccctacggaccgttacgggttccggtaggccgtagggttcggggttacgtacggggtacctaagggttaccgttccgtaacccgttccgttaccgaaccggttccgacgtaccgttaccggccggttaggacccgttacgttaggtacgtttaggttacgttttaccggacttttaacggttttaccttactttcggtacgtccggtacccgtacccggttaccccggttccccggacccggttacccggtcccgttaaccccgtttacgggtcccgggggttttaccgggggacccggggggtaacggtggggggtacggtacgggtaacggtaccgggaacggttaacccgggtaggttgggtaaccggtcgttacccgggtaccctaacccggtacgttttaccccggtttaccgtttacccgttacccgttcccgttttaccccccgg

SEQ ID NO: 111737 - DNA, 928 bp, Homo sapiens
  misc_feature: GYAE6OF01BTVC3.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaacggaaaattgtgttgacacagtctccaggccaccctgtctctgtctccgaggggacacgacgccctaccctcgtccgtcgacgacgggacctagtactaaggttagtcgtttaacgacctaaaccgtaacgttacggtaccgttacgggtaaacccaaacgtaacggaacgtaacccgtacggacccgaacggacccttaaccccaaaaccttcccctacaccgttccgttcgttacggttaccgttaacgtacccgttaacccggacggggtacctaaccgggttcggttacccgtaacccgtaacggtaccggttaacgggttaccggaaacgggggtaccgtacgggggtttacggggttaccggtaacgggggtaaccgtacgggttaaccgtttaccgtaacccggtaccgttaaccccgtaaaccgtaacgttaccgggacgggacccggttaccggtccgtacgggtaaccggttcgttaaacgggtttaaggtttaacggtttttaccgggtttaaactttttaaccgtttaccgttaacggttacggtaaaccggttacgtttaaaccggtttacttaaacggttccgttaacggttcccggttaaccggttaaccggtttaccgggttttacggggaacccgggtaacgtaacgggtacggtacggaacgttaacgtaaccgtaaacggtacgttcgggtacgacggtccggacttacccggtacgttacgttcccgtttaaaccttccgttaccgttcccgttaccccg

SEQ ID NO: 111738 - DNA, 754 bp, Homo sapiens
  misc_feature: GYAE6OF01EK62J.45.36.D03.1.454.CMB.1.raw
  modified_base (205)..(205): a, c, t, g, unknown or other
  misc_feature (205)..(205): n is a, c, g, or t
  modified_base (737)..(737): a, c, t, g, unknown or other
  misc_feature (737)..(737): n is a, c, g, or t
tcagacgcgatcgacacgaccggtgctcgatttagctgcgtcacgatctctcgttgggggaggaactgctcagttaggacccagagggaaccatggaagccccagctcagcttctcttcctctgctactctggctcccagactaccaaccggtaaaattgtgttgacacagtctccaggcctaccctgtctctgtctcgaggganacacgccctaccctctcctgcgacggcctaggtaggagtcgtacgtaagttaacgtacgttaggcgttacggtaaccaacgaacgaaaccgtcggaccgacggtccctaccgacggtcccttccctactacctacccgtagtacggtacgtcgacctaaccgttacccgaaccgggtaccgggttccccgtcgggaccccgtaccgacggtaccggttacgggttcccggtcgggtaccggtagggtcggggttacggacggggtacgtaacggtaccgttccgtaaccgttccgtacccgtaccggtaccgacggtccgtaacggtccgtacgggtcccgtacgtaggttacgttcgtttaatttccggtacgttttaccgttttaccgtcgttacgtccgtacgtcgttaccggttcccgtaccgtcgacccgttccgtacgtcggttaccgggtccggggacgggccgtagggcgagtacggtacggacggtacgtcgttggcgtaccgccgaagtcctacgttccgtnttcctacgtccgtcccg

SEQ ID NO: 111739 - DNA, 801 bp, Homo sapiens
  misc_feature: GYAE6OF01AX2KV.45.36.D03.1.454.CMB.1.raw
  modified_base (407)..(407): a, c, t, g, unknown or other
  misc_feature (407)..(407): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgcccacccgtctcctgcgtacgggcctaggtacggtagtcggtcctaaggttaacgttacgttacgggcgttacggtaacccaaacgacgtaaaccgtcggacccacgggcctacccgaggcctccctacactccgatcgatcgacactacccaacgcgggtcccgtaggcccgtacccgaggtaccggtacggttccggnggtacgtagggtcgggtacgtcggggaacctaggtacgttactaccgtccgtaccgtaccggtacgacgtccgacgtccgtacgggaccgtccgttaggaatttcggttacttttacggaccgttttaacgttttaccgttccgttcgttaccgtacggtaccgtacgggttcccggttaccccgcccgttaacccggtccccggttaccgtttacccgggtttaacccggggttttacccgggggggaccgggggttaaccccgggtagggggttaccgggtaggtaacgggttaccgggaaacgggtacccgggtaacggttccgggttacgggtccgttaccggacctacgtaccgttcgttaccgtttcccgttacttacccgttccccg

SEQ ID NO: 111740 - DNA, 827 bp, Homo sapiens
  misc_feature: GYAE6OF01AFCYC.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagactaccaccggagaattgtcttgacacagtctccgaggccaccctgtctctgtctcgagggganacacgcccaccctctccgtagccgacgggaccaggtaggagttcgtacgtaaggttaacggtacgttacgggacgttacggtaacccaacgaacggaaacccgtggaccgacggtcctacccgaggtccttccctactacctcctaagtcgactaccgcctaacgtacccggaaacgtcccgggttacccgacggtaccccgtaccgaggtaaccgtcgggttccggtacggtcggtacgggttcgggtacgtcgggactacggttacgttccacgttccgtaccgaccgtcgaccgtaccgacgtccggcgtaaccgtctagggttaccttaggtttaacgtttcgtacgttttacgttttacccgttcgtacggttaccgaaccgttcggtacccggttccccgggtttacccgacccgttaccccggttacggtccccgtttaacccggggttaccggggggtttacccgggggaacggggttaacccgggtggggttaaccggaggtaacccggttgggaaaccggttaccgggttaccggtacggggttacggtacccccttaggtaaccccgtcggttaccgtttcccggttactttaccgggtttcccctaacccgg

SEQ ID NO: 111741 - DNA, 823 bp, Homo sapiens
  misc_feature: GYAE6OF01BQ7B9.45.36.D03.1.454.CMB.1.raw
  modified_base (201)..(201): a, c, t, g, unknown or other
  misc_feature (201)..(201): n is a, c, g, or t
  modified_base (808)..(808): a, c, t, g, unknown or other
  misc_feature (808)..(808): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctgctcccagataccacggaaaattgtgttgacacagtctccaggccaccctgtctctgtctccgagggganacagcccacccctctccgtgaccgtacgggacctaggtaggtagtcgtacaagtaagttacgttaggctacggtaaccaaacgacgtaaaccgtcggacccgtacggcctacccgaggtaccctccgtactacttccagtacgaactcgacctaacgtacccgaaacggtccgggttccccgtcgggacccgttacccgaaggtaccggttaacgggtttcccggtaggtaccggtacgggttacggggttccggtacggggtaacgacggttacgtttaccgaccgttccgtaccggtaccgtcgaacgtcgtaccgggtcgtacgggacgtaccggttagtacgttcgttaacgttttcggaaccgttttaccggtttactttcggttccgtaacgtacgggttacccgtaacggttcccccgtttaccggaaccccgggtccgtacccggtaccgtttcccgggttaccgggtttacgggggacccgggggtaccggtagggggtacggtcggtaacggtcgggaaaccgggtacgttaccgggttagggacggttcccgcggtaacccctacgttacgttcgtttaacccgtcgttttacccnccggtttaccccccg

SEQ ID NO: 111742 - DNA, 726 bp, Homo sapiens
  misc_feature: GYAE6OF01AOKMY.45.36.D03.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagtcaccctctcctgcagggccagtaggagtgtcagtagtactaggctggtaccaacagaacctggccaggcctcccaggctcctcatccatgatncanccaanacgggtcctggccgtcccgagacgcgggttccgtggacgtaggtcggggtctaggggtacacggtacgttaccaccgttcgtacccgtacccggttccacggtacccgtagggtcccttagggaccggtaccccgtaggtacgttacgttaacgtttttggaacctttacgggttttaaccctttcgttcgtaccgtaggccgtacggttcccgtacccggtacccgtaaccggtcccggtaccgttacccgttaccgggttttaccccgggggcgggggggtaaccgacgggggttagggacggtacgtagggtaaccggaaccgggtaacggtttgggtcgggtcgttaccggtcccgtaacccgtaacggttccgttaccggtttccctttaaccggtcccgtttacccccgg

SEQ ID NO: 111743 - DNA, 773 bp, Homo sapiens
  misc_feature: GYAE6OF01E32H6.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggccaccctgtctctgtctccgaggggagacacgccaccctctcctgcgacggcaggtaggagtgtcagtaagtacgttaggcgtacggtaaccaacaacgaaacctcggccgacggtccacccgacggtcctcctactactccagtagactcgacacgtacccgaacgaccgggtcccgtcggtccgtcccgaacgtacgtacgggttccggacgggtactaggggttcgggtcggacgggactaaggtacgttcgtactccgtacccgtaccgtacgacggaccgaccggtccggtacggaccggtcccgtagtacgtttagttacgtttttcgggacttttaacgttttaccgttctacggtacgtaacggtcgtaacccgggtcccgtttacccggacccgaccgttccccgggtccttacccgggttaaccgggttttccggggggaaccggggggtaccggtaagggggtacgaacgggtacgtacgggaaacgggtaccggttaacgggttggtacgggttcccgacggtaacccgttacccgttaacgttcccgtttacggttacccttcgttaccccggtttcccccg

SEQ ID NO: 111744 - DNA, 727 bp, Homo sapiens
  misc_feature: GYAE6OF01DJ47D.45.36.D03.1.454.CMB.1.raw
  modified_base (245)..(245): a, c, t, g, unknown or other
  misc_feature (245)..(245): n is a, c, g, or t
  modified_base (468)..(468): a, c, t, g, unknown or other
  misc_feature (468)..(468): n is a, c, g, or t
tcagacgcgatcgacacgaccggtgctcgatttagctgcgtcacgatctctcttgggggaggaactgctcagttaggacccagagggaaccatggaacgccccagctcagcttctccttcctcctgctactctcggcccccagataacccaaccggtaaaattgtgttgacacagtcctccgagcaccctgtctctgtctccgaggggacacacgcccacctcctcctgcgagggccaggtaggnttacgcaaggttaagtacgtaggcttacggtaaccaacgaagtaaacctggaccgaaggtccctccgaggtcctcctacactccagtaggactcgaccgtactaacccgaaaccggtcgggttacccggtacggtacccgtaccccaagggtacgtaccgggttccggtaggacgtacgggttcggggtacgtacgggaccgtaggtaacttccacgttaccnccgtaaccgtcaacgcctacggtccgtaggactccgtaagtgtcgttaagttttcgaacctttagtttccgttactacgtcgtacgtacgtaccgtcccggttacccgaccgtccggaccttccgttcggtacccggggttcgggggaccgggtacgtaggggtacgacgttacggacggtacggaacctacgggttcggaggtacccgtacggtacgtcccgagttccgttcgtaccttcgtacccttcccgtacccg

SEQ ID NO: 111745 - DNA, 754 bp, Homo sapiens
  misc_feature: GYAE6OF01A8P7M.45.36.D03.1.454.CMB.1.raw
  modified_base (598)..(598): a, c, t, g, unknown or other
  misc_feature (598)..(598): n is a, c, g, or t
tcagacgcgatcgacacgaccggtgctcgatttagctgcgtcacgatctctcttggggggaggaactgctcagttaggacccagagggaaccatggaagcccagctcagcttctcttcctcctgctactctggctcccagactaccaaccggaaaaattgtgttcgacacagtctccaggcacctgtctctgtctccgaggggacacacgcccaccctctcctagccgtagggacctaggttacgggacgttcgtcgaaggttaaacgttacgtttaacggcgttacggtaaccaaacgacggtaaacctgggaccaagggcccttaccgaggtcctaccgtcaactccctaagtggacctagcctaacgtccgaaaccgtcgggtccctaggccgtaccgacgtaccgtaggtttcccgaggaccgtaggtcgggtacgtacgggacgtagtaacgttccgaacttccgtaccggaaccggtcaacgggtaccgtacggtccgtacggtccgtaccgttcgagttactacggttttagaccgtttacggttttacgttaccgttacgtcgtaacgtcgtacgtcccggtttaacccncgtaaccggcccgttcgttaccgtcccgggttacggggacgggttacggtaggggtctaacggtcgtacggtaaacgttcgggaaaccttgggacggtcctacggtaccctaccgttacggtaccttttaggacccgtttacctcgtttacccccg

SEQ ID NO: 111746 - DNA, 673 bp, Homo sapiens
  misc_feature: GYAE6OF01B99MO.45.36.D03.1.454.CMB.1.raw
  modified_base (383)..(383): a, c, t, g, unknown or other
  misc_feature (383)..(383): n is a, c, g, or t
  modified_base (614)..(614): a, c, t, g, unknown or other
  misc_feature (614)..(614): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggagacacgcccaccctctcctgccgacggccaggtaggagtgtacaagtaagtacgtaggcgtacggtaaccaacgaacgaaaccgtcggaccgacggccctacccgaggtcctccctacactccagtgatcgacactaccgaacgtacgggtacccgtggcccgtaccagaccgtacggttccgnggtcgtagggttcgggtacgtagggacgtacggtacgttactaccgtctaccgaccgtacgacgtcacggtcgaggactccgtagtacgtttgttagtttcggacctttaagtttcctgtaacggcctagtcctacggtcccttcccgacaccggtcccgtacgtccggttaaccggggtccgggggacggggtacctaggggtacgaaccgtggtaccgaacggttacgnggttcggcggtcacggacccttacgtgttaccgtttccgtaccttcgtcccgttccccg

SEQ ID NO: 111747 - DNA, 866 bp, Homo sapiens
  misc_feature: GYAE6OF01CD3GB.45.36.D03.1.454.CMB.1.raw
  modified_base (588)..(588): a, c, t, g, unknown or other
  misc_feature (588)..(588): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagactaccaaccggtaaaattgtgttacacacagtctcgaggccacctgtctctgtctaccgagggacacgaccgcctacccctctccctaggccgacgggacctaggtacggagttctacgtaagtacgttacgtacggacgtacggtaaccaagaaccggtaaaccgtcggaccgaacggcccgtaccgcggttcctaccctacactaccgtagtccgaattcgactacgtacccaaacggtccgggttaccctcggtaccgtcctaacggtacgtacgggttcccgtaggcccgtaaggggttggtccgtacggggacttcggtaacgtttcccgaaccttacgttcccgaaccggttacaggttaccccgagtaccccgggttgggtaaccgtccgtaacggttaacgtttcgtttaggtttttaccgtactttttaaccgggtttntttcgggttaaacccgttcgtaaaccggtccttaaccgggttcccggttaaccccgccccgtaacggttcccccgttacccgttacgggggttacccgggtttaccccggggggtaccggggtaaacgggtccgggttaggtaccggtaaacggggacggttaaacccgggttacggtaaaccgggttcggggtttaaccgccgggtttacccggaaaccttcccgttacgttccgttaacgggtttccccttaccgtttacccggtttcccccccgg

SEQ ID NO: 111748 - DNA, 831 bp, Homo sapiens
  misc_feature: GYAE6OF01BWLIK.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagactaccgaacggaaaattgtgttgacacagtctcaggccaccctgtctctgtctccgagggagacacgccaccctctcctgacgagggccaggtacggagtggtacaagttaagtacgtaggtctacggtaaccaaacgaacgtaaaccgtcggaccgacggtaccctacccgaaggtccctacccgtactacgttacctaagtccgggaacctacgtaaccgtaacccggaaaaccggtaccggggtacccctaaccggtccgggaccctacgtacccccgagtacccggtaaggtttccgaggttaggaccgtaggggttcggtacgtacggggaaccacggttaccccgttagaccctttacccgtaccgaaccctacggttacctaccggacctaacccggtccggttacccggtaacccgttaggtaacgggtttacctttttaccggacccttttacttttaaacccgtagttacccgtatacccggacggtacgggtacccggtaccgggaccccggtaacgggtacgcccggtttaccgtccgggtttaacccggttacggggaacgggtaccgggtaaccggaagggtaggaaccgtaaagtaaaccggaaccggtaaaggttccggtacggtacgtaccggtaactacccgttaacgttcgtaacccggtttccttaaaccg

SEQ ID NO: 111749 - DNA, 867 bp, Homo sapiens
  misc_feature: GYAE6OF01D32TY.45.36.D03.1.454.CMB.1.raw
  modified_base (415)..(415): a, c, t, g, unknown or other
  misc_feature (415)..(415): n is a, c, g, or t
tcagacgcgatcgacacgaccggtgctcgatttagctgcgtcacgatctctcttgggggagaactgctcagttaggacccagagggaaccatggaacgcccagctcagcttctcttcctcctgctactctggctcccagataccacggtaaaattgtgttgacactagtcctcaggcaccctgtcctctgtctccgaggggacacctacgccctacccgtctcctcgcgacgggccaagttagggagttacggtactaaggttaacgtaaccgttaggaccgttacggtaaccaaacgtaaacgaaacccgttgggaccctaaggggtcccttacccgacgggtccttacccgttacaccgttacccaggttacgaccgttaggacctaactacccctaaacggaccgggttccncgggtaccgttacccgaacggttaaccgtacgggtttccggtagggcttacggggttcgggacgttcggggaactacggtacgttacctcgtacctccggacgtacgacgacctacggcgtcggaacgttccctaaggttacgtttaaggtacgtttttcgaccgtttttaaacggttttcctaccgttacgtcgtaacggtcctaacgggtttcccggtaccgttacccaaccggggttccttaccgttccgtttaaccggggggttcccggggaaccggggggttaaccgtacggggggtaacgtacgggtaactacccgggtaaaacgggtacccgggttaaccgtttgggggtaacccggtttccgggaaacccttaccccgggttaaaccgtaccgttttccggggtaccctttttaaccccgttccgcccgttttaacccccccgg

SEQ ID NO: 111750 - DNA, 889 bp, Homo sapiens
  misc_feature: GYAE6OF01C54DO.45.36.D03.1.454.CMB.1.raw
  modified_base (213)..(213): a, c, t, g, unknown or other
  misc_feature (213)..(213): n is a, c, g, or t
  modified_base (465)..(465): a, c, t, g, unknown or other
  misc_feature (465)..(465): n is a, c, g, or t
tcagacgcgatcgacacgaccggtgctcgatttagctgcgtcacgatctctcgttgggggaggaactgctcagttaggacccagagggaaccatggaagccccagctcagcttcctcttcctcctgctactcgtggctcccagactaccaaccggtaaaaattgtgttgacacagtctcgacgccacctgtctctgtctccgaggggacgacnccgccctaccctctccgtggaccgacgggaccaggtacggtagtggtacaaggttaacgtacgttacggacgttacggtaaaccaaacgtaacgtaaaaccgcggtacccgacggtacccgtacccgaggtcccttacctacgtaccgtaccctaggtactagtaccgaccgtaaccgtaacccgtaacgggtaccgggtcccgtccggtacccgtaccccgaacggtaccgtaccgggttccggtacgggngttacggggtcggggttccggtaggtaaccgtaggttaccgtacgtacccgttccgtaaccggtcccgtacgacggtaccacggtcccggtaggtaccctacggtaacgttgtttaacggtttcgttttacgttaaccgtttcggttttacccttggtacgtaccgtacgtcccgttaccgggtcccgttacccggaccccgtccgttcccccggttcggtttaaccccgggttggggtacccgggggggtacccggggggtaaccgtagggggggttaccgaacggggttaacggtcccgggtaaacggggtaaccggttcccgggttagggggttcccgtaacccggtttagaaccccgttccccggtagttttaccccggttcggttttaccctacccggggttccccgtttacccccggg

SEQ ID NO: 111751 - DNA, 915 bp, Homo sapiens
  misc_feature: GYAE6OF01CTKUS.45.36.D03.1.454.CMB.1.raw
  modified_base (98)..(98): a, c, t, g, unknown or other
  misc_feature (98)..(98): n is a, c, g, or t
  modified_base (189)..(189): a, c, t, g, unknown or other
  misc_feature (189)..(189): n is a, c, g, or t
tcagacgcgatcgacacgaccggtgctcgatttagctgcgtcacgatctctcttgggggaggaactgctcagttaggacccagagggaaccatggaanccccagctcagcttctcttcctctgctactctggctcccagactaccaaccggaaaattcgtgttcgacacacgtctccgaggccaccctntctctcgtctcgagggacgacacgacccacctcctccgtcgtaccggacgggtacccgtaaggttaacgggtacgtacggttaaccggtaaaggttaaacggtaaccgtttacggggaccgttaaccgggttaaacccaaaaccgtaaacggtaaaaccccggttcgggaacccggtaacgggtaccccgtacccggtaacggtaccccttaacccgttacctaacccgtcccgttaaaggttaccggtaaaccgttcggtaccgttaaacccgtaaccccgtaaaaccggggtaacccggggttccccggttaaccggggtccccgggttaaccccgtaacggggtaacccggttaacccgggtttaccggtccgggtacggttacggggtttaccggggttacgtaccgggtacggtaaggtaccgttaccgtaacgttcccgtaccgtaaccggtctaccggtaaccgtacggtaccggttcggaaccggtcgttaacggtcgttaggtttacgtttcggtacgtttacggttttacctgttacggtacacggtccgtaccgtacgttcccgaccgtaccgtccgtacgttccggttacgggttccggggtaaccggggtacggtaggggttacggacgtttaacggacggtaacggacggtacggttacgggtcggtacgtacgaaccctcgttacgaccttcgtaactccctacgttcccg

SEQ ID NO: 111752 - DNA, 863 bp, Homo sapiens
  misc_feature: GYAE6OF01DJTCN.45.36.D03.1.454.CMB.1.raw
  modified_base (168)..(168): a, c, t, g, unknown or other
  misc_feature (168)..(168): n is a, c, g, or t
tcagacgcgatcgacacgaccggtgctcgatttagctgcgtcacgatctctcttggggggaggaattgctcagttaggacccagagggaaccatggaagccccagctcagcttctcttcctcctgctactctgctcccagactaccaaccggaaaattgtgttgacanagtctcagcaccctgtctgtctaccgagggaagacgccaccctctcctgcgacggccaggtaccaagtaccttaattacgtcgggacaacgtacttaacgttacggaccgttacgggtaaccaacggaaccgtaaacggaaaaccccgttgggaacccgtaaccggggtaccccaagggtccccttaccctacgaactttaccgttaaaatttgacgtacgtacctaacccaacggaacggggtccctaaacggtcggacctaaccgtaccccgtaagtaccgtaacggtttcgaagggtcggtaccgtagggtccgggtacggttacgggaactaaccgtacgttacacccttacgttacccaacctactacgtacgtaccgaaacggtacgtacgggtacgtaccggtagttaaagtagtttttacgacgtttaggttacgttacgtttaacttacgtactaaaccgtagttaaccggtttcgttaacccgtttacccgttaccgttttaccggttacccgtttacccggggtaccccggttaaccgggtaaacccggttaaacggtaaaccggttaacgttaaacgttaaaacccggtaaaaccggttaaccggtttacggttaaccggggtaccctaaccggtaacccgttaaccgttaccgttaccgttccgtttcccgttttaaccccg

SEQ ID NO: 111753 - DNA, 765 bp, Homo sapiens
  misc_feature: GYAE6OF01BQ924.45.36.D03.1.454.CMB.1.raw
  modified_base (257)..(257): a, c, t, g, unknown or other
  misc_feature (257)..(257): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacggaaaattgtgttgacacagtctccagccctacccttgttcttttgtttccgaagggggaaacgcgcccaccctctccgtgcgacgggccagtcgagggttacttaacgngtacttacgttacgccgttacggtaaccaaaacgaaaaccgtcggacccacggtcctacccgaggtcctacatcacttactagtcgacgctagtaccgaacgacgggccctacgtacggacaccgttaccccgaacggtcccgtacggttacgacgggttcggacgtagggttcggggttacgtacggggaaccgtagttaccttaccaccgttactacccgaacctacgtaccgacggcgtaccgtcccgtacgggacccttagggtaacgtttctttcggaacccttttacttttaccgtacgttcgacgtacgaccggtacgggtccggtaccgggaccgtaccgggacgtccggtacgttaccggttaccgggttccggggaacgggtaacgggtaccggtaaggggtcgaaacggtaacctaaccggtaaacggacgttgggacgtacgtacgacccgttaaccgcgtttccgtcttaccgtttctcccgtttcccgtccccg

SEQ ID NO: 111754 - DNA, 855 bp, Homo sapiens
  misc_feature: GYAE6OF01DCO6K.45.36.D03.1.454.CMB.1.raw
  modified_base (120)..(120): a, c, t, g, unknown or other
  misc_feature (120)..(120): n is a, c, g, or t
tcagacgcgatcgacacgaccggtgctcgatttagctgcgtcacgagtctctcttgggaggaactgctcgagttaggaccagaggaaccatggaagcccagctcagcttctcttcctccngctactctggctccagactaccgaccggaaaattgtgttgacacagtctcaggacaccctgtctctgtctccgagggacacgacgcccaccctctcctagcgacgggacctagtaggagtacgtctaaggttaacgtacgttacggtccgtacggtaaaccaaacgaacgtaaaccgtggacccgtaggtccctaccgacggccttacctacgtactccctaagtacgtagtacgacacgtacccgaacggtacgggttacccgtcgggtaccgttacccgacgggtaaccgtaccggggttcccggttaggaccggtaacgggttcggggtacggttacggggaaccgtaacggttccggtaccgtaccgttaccgtaccgaaccggttcgacgtaccgtacgtacccgtacggacgtaccccggtagtaaacggttcgtttaacgtttacggtaaacgtttaccggtttttacccgttaacgttaccggttaccgacggttacccgtaacggtttccccggttaaacccgtccgaacccggtacccgttaccggtacccgggtttaaccgggtttccgggggaacccggggggtttaacgtccggggtaagggtaacgttacgggtacgggaaccgtaaacgggttaaccggttgggtaccggtaacccgtaccgtaaaccgaaccgttcggtttaccggtaccgtttaccttcccgtccgtttaacccccgg

SEQ ID NO: 111755 - DNA, 750 bp, Homo sapiens
  misc_feature: GYAE6OF01AGUEN.45.36.D03.1.454.CMB.1.raw
  modified_base (726)..(726): a, c, t, g, unknown or other
  misc_feature (726)..(726): n is a, c, g, or t
tcagacgcgatcgacacgaccggtgctcgatttagctgcgtcacgagtctctcttgggggaggaactgctcagttaggacccagagggaaccatggaagccccagctcagcttctcttcctcctgctactctggcctcccagactaccgaaccggaaaaattgtgttgacacagtctccaggcaccctgtctctgtctccgaggggacacagtccaccctctcctgcgtaggcctaggtaggacgtgtactagtaacgtacgttaggcgtacggtaaccaaacgaacggtaaaaccctcggggacctaagggtaccctacccgaaggtcccttaccccgtacgtaaacttcccggaatttcggaacgttcggacctaacgttaacccgaaacggtaccgggttccccgtcggggtacccttacccggaagtaccgttaccggggtttcccggacggtcgtacgggttcgggtcgtacggggactaaggtacgtttccaacgttcctcgacccggttcacggtaccgtacgggtaccgttcgggaaccgtccgttagacgtttagttagttttcgacgttttaagtttccttcgttactcgacgcgtacgtccgttcccgcgtaccgtcccgtacttccgtaccgggttcggggaccggggtaccgtaggggtacggagtacggtacggaaccgacggttaacgtgggtcgtcgtacgaccaacgtnttcccgttagtcctacgtctcccg

SEQ ID NO: 111756 - DNA, 1135 bp, Homo sapiens
  misc_feature: GYAE6OF01AV7YO.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttagacacagtctccaggccacctgtctctgtctcgagggacacacgcccacccgtctccgtgccgacgggcctagtacggagtacgtacgtaacgtaagtacgttaggacgttacggtaaccaaacgaacggaaaacccgtcggacccgtaacgggtccctaccccggtaacggtccccttacccgttaccgaaccttccccgtaagttaccggtaaagttccggtaccgtaaaaccgttaccccggtaaaaccggtacccggggtttacccccgttaccgggtaccccgtttaccccggaaacggtaacccgggttaccggggtttacccgggtacggggtaccggtaacggggttcggggttacccgggtaacggggtaaccgttaacgggttaccggtttacctaaccccgtttaccggtaacccgttaccccggttaaccggtacggtaacccggtacgggtttacccccgggtacgggttacccggtaccccgtttaagggtaccttttagggttttaaaacccggtttttccggacccgttttttaaaaagggtttttcccccgtaacggtttacccgggttaaacgtaccccggtaccccggggtttaaaccgggttttacccccgggccccccgggtttaacccgaacccccggggtttcccgttaaacccccgggttttaacccggggtttacccccgggggttacccccgggggggggggtaacggggttaaccccgggtaaaggggggggttcctaaaaaccgggggtcccggttaaaccggggggaaaaacccgggtttaccccggtaaacggggtttttcccgggggtaaaccggggttcccccttaaacccgggtaaaccccccggttttaaacccgttttacggggtttcccccccttaaaggggtttttccccccgttaaaccgggttttaccccccgtttaaacccccccccggggg

SEQ ID NO: 111757 - DNA, 820 bp, Homo sapiens
  misc_feature: GYAE6OF01CPIVV.45.36.D03.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (629)..(629): a, c, t, g, unknown or other
  misc_feature (629)..(629): n is a, c, g, or t
tcagacgcgatcgacacgaccggtgctcgatttagctgcgtcacgatctctcgttgggggaggaactgctcagttaggacccagagggaaccatggaagccccagctcagcttctcttcctcctgctactctcggctccagactaaccaaccggaaaaattgtgttgacacagtctccaggcacctgtctctgtcnccgagggganacacgcccaccctctcctgcgacgggccgaaggtagtagtgtacgtaagtaacgtacgtaggtcgtacgtaaccaacgaacgtaaaccgtcggaccgacggtacccgtacccgtacggtaccctcccttacgaaccttacgaacgtcggtactcgtacctaaccgtacccgaaccggtaccggttacccggtcggtaccccgtacccgacggtacggttaaccgggttccggtacggtcggtacgggttcgggtacggacggggtacgtagtacggttactacctcccgtacgtaccggtcgaacccggcgtaccgggacccgtgggaccgtccgttaggttaacttcggtttagttttaacgttcggttacttttacgtcgtacgtaccgtacgtcgtcccggtttaccgtcccgggtaccncccggttcctaccggttacccgttttaccgggggggtacccgggggttcgggggaaaccggttggggaaccgggttcggaaaggttacgggaaaccgggtaaaccggtcgggtttacgggtcggtccccgtaaggacccgttaaccgttgtttacccgttctttacccgtttcgttaccccgtttaccccg

SEQ ID NO: 111758 - DNA, 894 bp, Homo sapiens
  misc_feature: GYAE6OF01CZTZ1.45.36.D03.1.454.CMB.1.raw
  modified_base (423)..(423): a, c, t, g, unknown or other
  misc_feature (423)..(423): n is a, c, g, or t
tcagacgcgatcgacacgaccggtgctcgatttagctgcgtcacgatctctcgttggggggaggaactgctcagttaggacccagagggaaccatggaacgccccagctcagcttctcttcctcctgctactctggctcccagactaccaacggtaaaattgtgttagacacagtcctccaggccacctgtcctcgtcgttccaccggaggggacaccacgaccctaccctcctcctacggcgaccgggacctaaggtagggtacgtcggtacgtaacggttaacggtaacgttacggtaccgtacgggtaacccaaaacgaaccggtaaacccggtggaccgacgggtaccctacccggacggtcctccctagaactcccgtatacggtatccgactaccgtaccgacggtaccggttcccngggtaccctccgacggtaccgtaccggttccggaggaccgtaggggtcggggttacgacgggtacgtaacggtacgttccgaaccgttcctaccggaccgttacgacggtaccctaggtacccggtaggtaccgttccgtaggttaacgttggttttaccgtttaacgtaccgttttaagttccgtttacgggtacctaccggtacgtacccgggtacccggtttcccggtttacccccgggacccaccccgggtttccgggttaacccgttaccccggggttttacgggggttaccccgggggggaaccggggggtttaacccggaggggggtttaccgaaacgggggtaaccgtttacggggaaccggttaacccggggtaacggttcgggttaccggggaccttaccgggaccgttaacccggttccgtacgtttacggttccccaaaccgtttcccgttacccccgg

SEQ ID NO: 111759 - DNA, 743 bp, Homo sapiens
  misc_feature: GYAE6OF01CLTMP.45.36.D03.1.454.CMB.1.raw
  modified_base (180)..(180): a, c, t, g, unknown or other
  misc_feature (180)..(180): n is a, c, g, or t
tcagacgcgatcgacacgaccggtgctcgatttagctgcgtcacgatctctcttggggagctctgggagacgagcccagcactggaagtcgccggtgttccttcggtgatcatcactgaacacagaggactcaccatggactttgggctgacctgggttttcctcgttgctcttttaagnggtgtccagtgtcaggtgcagggtggtgggaggtcggggggaggcggttgtccaggccgtggggaggtccctggacgtactcgtcctggtcgcacgccttcgtggtacttccgtccctactaacgttaacgttttcggtttaccctacggtcggggttccccgaccgtacgggttcccgaaggggtaccggtaacgggggcgtgggagggttcggggtccggtaccccttcgtaacgtttccggaagtacggtaggaaggtaggaacggaacggtcccgttaactcggaacgtaccgtccggtacgggaacgggtccgtcgtaccgaccgtactcctaccgacgaacgtaactaaacttacgaagtaactcgttccttcgtttacgaactaagtacgtaatacgtacgtaggtaagtaggttacggaaggtacgtacgttcgtacgttactttactttcgtcggtacggaccgggtaacggggtactacgttcgtaacgttcggtaaggtttaccgttacgggtttacgttacggttaacgttaaagttacccgtaaaacccg

SEQ ID NO: 111760 - DNA, 784 bp, Homo sapiens
  misc_feature: GYAE6OF01BA5F5.45.36.D03.1.454.CMB.1.raw
  modified_base (167)..(167): a, c, t, g, unknown or other
  misc_feature (167)..(167): n is a, c, g, or t
  modified_base (171)..(171): a, c, t, g, unknown or other
  misc_feature (171)..(171): n is a, c, g, or t
  modified_base (278)..(278): a, c, t, g, unknown or other
  misc_feature (278)..(278): n is a, c, g, or t
tcagacgcgatcgacacgaccggtgctcgatttagctgcgtcacgatctctcgttgggagctctgggagacgagcccagcacgtggaagtcgccgtgtttccttcggtgatcatcactgaacacagaggactcaccagtggactttgggctgaccttgggttttccngttncttactttaaggcggtgtaccgagtgtacgagggtcacgaggtggtgggacggtcggggggagtcgttgccaggccgtgggacgttcctaggacgtacctcgtccgngtcgacgtacgtccgtcgtacgtcttccgtccctagtacgttaacgtttcggttccacggtcggtacccgtcgtacgttccgaggacggacgggtcgtgggacggtcgggtccgtcctacgtacgttaccggaagtgtacggtagtacgacggtacggtcctacgcgtaacgccggtcggtacggacggtccgtcgttaccacctcgtaccacgtaagaacgtaccttaaacgaaccgtaagtctttaccgtttccgtttacgtttaaggaacctaagttgaaacgtcgttaaccgtagggtaaacgtacggttacgacgttaaccgttacgttaccgttacgttacgttttacccgtagggttcgtaaaccccggggtaccggtaaacgggttcttaaccggttcggttaaaaccggtttccggtaaacgggttttcccggttttaaacggggttaacgtttaaccgttaacgttaaaccccggtttaaaccctaaaacccccgg

SEQ ID NO: 111761 - DNA, 683 bp, Homo sapiens
  misc_feature: GYAE6OF01DL3WR.45.36.D03.1.454.CMB.1.raw
  modified_base (209)..(209): a, c, t, g, unknown or other
  misc_feature (209)..(209): n is a, c, g, or t
  modified_base (526)..(526): a, c, t, g, unknown or other
  misc_feature (526)..(526): n is a, c, g, or t
  modified_base (536)..(536): a, c, t, g, unknown or other
  misc_feature (536)..(536): n is a, c, g, or t
  modified_base (627)..(627): a, c, t, g, unknown or other
  misc_feature (627)..(627): n is a, c, g, or t
tcagacgcgatcgacacgaccggtgctcgatttagctgcgtcacgatctctcttgggggaggaactgctcagttaggacccagagggaaccatggaacgccccagctcagcttctcttcctcctgctactctcggctcccagataccaaccggaaaaattgtagttgaccacagtcctcaggccaccctgtctctgtctccgagggganacacgcccacctctctgcgacggccaggtacgagtgtcaagttacgtacgttaggctacggtaaccaagacgtaaaccgtcggaccaggtcctaccgacggtcctcctcactcagtcgatcgcactacccgacgtacgggtccgtacgaccgtaccgagaaccggttcgggtccgcggtacgtcgggttcgggtacgtacggaacgtaggtaccggttcaccgttccgccgtaccgacgacgtaccgacgtccggtacggaccgtccgttagaacgttgttaaagttttcgtattccggttttactcgttacggtcnggttaacccncggttcccgccgtaccacccgttccgtacttaccgggtccgggttaccgggggcgggtacgtaggggtcgaagtcgtacggagttaccggngtgggtactcgacgtccctaacgcggtttctgggtttaactccgtccgtttacccg

SEQ ID NO: 111762 - DNA, 726 bp, Homo sapiens
  misc_feature: GYAE6OF01EF9BB.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctcggctcccagactaccgaaccggtaaaaattgtgttgacacagtctccgaggccacctgtctctgtctcgagggacacacgccaccctctccgtgcgacggccaggtaggagttcgtacgtaagtaacgttacgtacggtcgttacggtaaccaacgaacgtaaaccgtcggaccacggtccctaccgacggtcctcctacgactccatacggatcggactaacgtaccaacggtcgggttccctggtaccttaccgagtaccgtcggttccgaggtcgtaggtcgggtacgtcggaactaggtacgttccacgttccgtctacggtaccgagtcgtaacgtccggtacggtaccgccgttaggtacgttagtttacgtttcgtacgtttaacgttttactcgttacgtaccgtaacggtccgtaacgttcccgttcccgacccgtacccggtccgtccgtaccggtttaccgggttacccggggacggggtacgtaggggtcgaacggtacggtacggaacggtaccggtagttcggtcggtaccgtcgtacgtaaacctcgttacgttacgttccttacgtacccggttccccg

SEQ ID NO: 111763 - DNA, 764 bp, Homo sapiens
  misc_feature: GYAE6OF01DQQCT.45.36.D03.1.454.CMB.1.raw
  modified_base (190)..(190): a, c, t, g, unknown or other
  misc_feature (190)..(190): n is a, c, g, or t
  modified_base (308)..(308): a, c, t, g, unknown or other
  misc_feature (308)..(308): n is a, c, g, or t
tcagacgcgatcgacacgaccggtgctcgatttagctgcgtcacgatctctcttggggagctctgggagacgagcccagcactggaagtcgccggtgtttccttcggtgatcatcactgaacacagaggactcaccagtggactttgggctgtaccgttgggttttcctcgttgtcttacttttaaaggnggtgtccagtgtcgaggtgcgaggtggtggaggtcgggggagtcgttgtccgaggccgtgggacgtcccgtgagtacctcgtcctgtcgcgacgtcctcgtaggtacttcctaccctntaacgttaacgtttcggttaccctacgtcgggtcccgaccgtacggttccgaggacggtaacggggcgtagggtacggttcgggtccggtccccttagtacgtttaccggaagtagtcggtaaagtcgaacggaacggtcccttaacgtccgaacgtacccgtaccggtagggtaacccggggtccttacccgttacccgacccgtacgttacccgtaaccgtaacgaacgtaaccgtaaaccttaaccgaaaggttaaccttccgttaccgtttacttttacgaaccttaaagttaacgtaactacgtacgtacggtaagttacggtacggtaacggtaccgtacgttacgttcgttactttacgttccgtaggtacgtaccgggtagggtacctagtacgttacgtagtacgttcggttacggttacgttagttaacgtaacgtcgtaaacccg

SEQ ID NO: 111764 - DNA, 723 bp, Homo sapiens
  misc_feature: GYAE6OF01CWRYS.45.36.D03.1.454.CMB.1.raw
  modified_base (638)..(638): a, c, t, g, unknown or other
  misc_feature (638)..(638): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtcctccgaggggacgacacgcccacctcctcctgccgagggccagtacggacgtgtctaagtaagtacgtaggcgtaggtaaccaacaacgaaccgtggaccaaggccttacccgaggtcctaccctcaactccgaagttcgatacgcctaacgtacccgaaacgtcgggtaccccttcgggacccgttacccgacgtaaccgtacgggttccggacgggctaacgggttcggggttacgcgggactaacggtacgtttccgaccgttcctaccgtaaccggtcaacggtctaccgcggttacggacgtccgtagtaacgtttgtaacgttttacgtacccgttaaggtttttaccttgtacccgttagaccgttcgtaaccgtccggtttcccgaccgttaacgtcccgtaactcccggttacgggtccggggtaacggggtaccngggggtacaggtataccgggaatacgggtaactggggtcctacggtgtaccctacgtcttacgttctaccgttctcccgttcccg

SEQ ID NO: 111765 - DNA, 726 bp, Homo sapiens
  misc_feature: GYAE6OF01BHLS9.45.36.D03.1.454.CMB.1.raw
  modified_base (381)..(381): a, c, t, g, unknown or other
  misc_feature (381)..(381): n is a, c, g, or t
  modified_base (472)..(472): a, c, t, g, unknown or other
  misc_feature (472)..(472): n is a, c, g, or t
  modified_base (656)..(656): a, c, t, g, unknown or other
  misc_feature (656)..(656): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccacggaaaattgtgttgacacagtctccaggccaccctgtctctgtctccgagggacgacacgcccaccctcgtccgtgcgacggccgagtaggacgtagtcgagttaacgtacgttaggctaggtaaccctaaacgacggtaaaccgtggaccctagggaccctccgaacgggtccttccgtactacgttacccagtcggaactcgacctacttaccgaaccggtcgggttaccccngggtaccctacccggaacggtaccgtaacggtttccggtacgggacgttagggtacgggttccggtagggaacgtacggtacgttaacccncgttaccgtacccgtaacgtcgaaacgtccggaaccggtccggttcggaaccgtcgtaggtaacgttcgttacgttttcggtaaccgtttacgttttactcggttcgtacgtacgtaccgtcggttacccgttccgaccgtaccgtcccgtacgtcggttaccggtccggggacgggtaccggngggtacgcgttagcgaacggtagacggttgcggtctcgacgttacgctcgttctaccttgtcgtaccccg

SEQ ID NO: 111766 - DNA, 936 bp, Homo sapiens
  misc_feature: GYAE6OF01APMHD.45.36.D03.1.454.CMB.1.raw
  modified_base (167)..(167): a, c, t, g, unknown or other
  misc_feature (167)..(167): n is a, c, g, or t
  modified_base (203)..(203): a, c, t, g, unknown or other
  misc_feature (203)..(203): n is a, c, g, or t
tcagacgcgatcgacacgaccggtgctcgatttagctgcgtcacgatctctcttggggagctctgggagacgagcccagccactggaagtcgccggtgtttccttcggtgatcatcactgaacacagaggactcaccatggactttgggctgaccttgggttttccncgttgcttcgtttaagaggtgtccagtgtcgaggtncgaggtgggtgggacgggtcggggggagtcgttgtccgaggccgtggggacggtccctggacgtacctcgtccgtgtcgcgacgccgtcgtggtactttcccgtccctacgtaacgtttaaccgtttcggtttaccgacgttccgggtccgccgtacggttccgagggacgaaggggctgggtacgggtgggtaccggtccccgtacgtacgttttaccggaagtacggttagggtaaggtacggaaagggtaaccggtacccgttaaccggtaccggaaacggttaacccggtacccggggtttaagggaaaccccgggggtccccgttacccgtttaacccgaacccgtaaccgttacccgtaccccggtaaacggaaccgtaaaccgttaaacccgttaaaccgtaaaacgggtaaacgtttacccggtttacccgtttaaccttttttacggaaacccgttaaacggttaacgtaaaacggtttaccgtaacccgggttaaggttaaacgggttaaaccggggtttacgggaaacccggggttaaccgttaccggtttacgtttacggtttacccgtttacgttttaccggttacgggtttaccgggtacccggggttaaacggggtaccttaacgttacggttacgggttacgtttaaccggtttccggtttaaacccgggtttagttaagggtttacccttaaacggttaaccgtttaaaacccccg

SEQ ID NO: 111767 - DNA, 839 bp, Homo sapiens
  misc_feature: GYAE6OF01EUU8I.45.36.D03.1.454.CMB.1.raw
  modified_base (213)..(213): a, c, t, g, unknown or other
  misc_feature (213)..(213): n is a, c, g, or t
tcagacgcgatcgacacgaccggtgctcgatttagctgcgtcacgatctctcgttgggggaggaactgctcagttaggacccagagggaaccatggaacgccccagctcagcttctccttcctcctgcctactctggcctcccagactaccaaccggtaaaattgtgttagacacagtcctccaggccaccctgtctctgtctccgagggganacacgcccaccctctccgtgccgagggcctaggtaggcgttgtacagttaagtacgttacggcgttaaggtaccaaacgaagaaaccgtcggaccgtacggcctacccgaggccttccgtacactcccgtaatggtactcggacctaacgtacccgaaacggtaccgggttcccgtcgggtacccgttaccccgaaggtaacccgttacggggttaccccggtaggtacccgtaacgggggtttcggggtaccgtacgggggtaacctacgggttacgttacccgtaccgttacccgtacccgtaacccggtacgtacggtacccgtaacggtccccggttagggacccggtaccgtacggtacgtttaacggtttacgtttacgtaccgtttaaccggtttttcttcggttaccgtccgtaacgtccggaacgtttcccgttacccggcccgttaccggtccccgtacgttttacccggtaccgggggtttcccgggacggggggtaacccggttaggggtaacgggtacgtacggtaacggggtaaaccgtaccgggtaacgtcgggtacggtcgtaccggccctaaacgttcggtactttaccgttcttaccgtacttccccg

SEQ ID NO: 111768 - DNA, 799 bp, Homo sapiens
  misc_feature: GYAE6OF01BUD1M.45.36.D03.1.454.CMB.1.raw
  modified_base (206)..(206): a, c, t, g, unknown or other
  misc_feature (206)..(206): n is a, c, g, or t
  modified_base (510)..(510): a, c, t, g, unknown or other
  misc_feature (510)..(510): n is a, c, g, or t
  modified_base (715)..(715): a, c, t, g, unknown or other
  misc_feature (715)..(715): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctcggcccccagataccaaccggaaaaattgtgttgacacagtctccaggccaccctgtctctgtctccgagggganacacgccaccctctcctgcacgggcagtacggagtgtactagtaagtactagggctaggtaaccaacgaacgaaacccgtgggacccaagggtcctaccccgacggtcctacccgtcacttccacgttgatcgacactacccaacgtccgggtccctcgggtccgtaccccgaaggtaccggtaacgggttcccgtagggaccgtacgggttcggggtacgttacgggggaacgtacggtaccggtttcaaccgttccgttaccgaccggttacacgacgtacgtccgtaggtacgtccgtagngttacgttgtttacgacttaacgtttcttcgtacggttcaacggtctaaccggtccggttacccaccccggtacgtcccggttaccgtcccggtttaccggggtttaccgggggaccccggggggacggtttacgggggaccgggttaacggtaacggtacggggtacccgtaaaaggggttacccggtggggttaaccccgggngttttccccggaccgttaaccccgtttaacgttccggtttcccgtttaacgtttcccgttaaccggttttccccccggtacccg

SEQ ID NO: 111769 - DNA, 789 bp, Homo sapiens
  misc_feature: GYAE6OF01CKHOU.45.36.D03.1.454.CMB.1.raw
  modified_base (280)..(280): a, c, t, g, unknown or other
  misc_feature (280)..(280): n is a, c, g, or t
  modified_base (456)..(456): a, c, t, g, unknown or other
  misc_feature (456)..(456): n is a, c, g, or t
tcagacgcgatcgacacgaccggtgctcgatttagctgcgtcacgatctctcgttgggggagaactgctcgagttaggacccagacggaaccatggaacgccccagccttcacgctttcctctttccctcctcgctactcgtccggcccctagtactaaccgaacggtaaaatttcgtgttcgacaacgagtcctccgaggcctaccctgtctcttgtcctcgggaggggtacaacgacctacccgtacccttctcggtagccgaggctaaggtcgagtnaacgagtaacgttccgaggtctacgaacgtaacaacgtaaaccgtcggacgacgtacccgaccgtcggtacctccttacactaacgcgttagagcgacctacggtaacccgtaaccggttccgggtacccgtcgtacccgaacccgtaggacccgtccgggttcggtggtaaccgnggttccgggtaggttacgggacgttaacgggtaccttcgtaaccgttctacccggtacacggaaagccgtaacggtcgacgtccggtcttacggtagtttaccgttagtttaaccgtcggtttaaacctttcggttcgtacggtactacggtaccgttcgtaacccgtcccgtaaccgggtcctcccggtccgttacccggggttaacgggtccggggtaaccgggggtaccgttaaggggtcggacggacggttacggtaaacggtccggtaggtttaccgaggtttccgcgttacgtaccgttatcgttccattcccctaggtccctaccg

SEQ ID NO: 111770 - DNA, 751 bp, Homo sapiens
  misc_feature: GYAE6OF01CY9AL.45.36.D03.1.454.CMB.1.raw
  modified_base (186)..(186): a, c, t, g, unknown or other
  misc_feature (186)..(186): n is a, c, g, or t
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (521)..(521): a, c, t, g, unknown or other
  misc_feature (521)..(521): n is a, c, g, or t
tcagacgcgatcgacacgaccggtgctcgatttagctgcgtcacgatctctcgttgggggaggaactgctcagttaggacccagagggaaccatggaacgcccagctcagcttctcttcctctgctactctcggctcccagactaccaacggaaaattgtagtgacacagtctcagcacctgtctntcgtcncgagggacacncgccacctctctgcgaggccgagtagngtcgtatagtacgtatggcgtacgaacaacgaacgaacctggaccacggtcctaccgacgcctaccgtacactacctaggtcacgcgacctactaaccgaacgttaccgggtccgcgggttacccgtaccgcggtaaccggttacgggttccggtcggtcggtcgggtacggggtcggtaacgggtactacggttacctcgtaaccttccgtacggtaccgcacgtaccggcgtccggtaacggaccgacgttcgtagttaacgtttaggtttcacggttttacttttccnggtaccgttcgacggttccgttacccggtcccgttaacccgggacctacccgggtaccgtttcggttaaccccgggttccggggtttaacgggggggggaccgggttaaccgggggtaggtacgggtaaaccgggtgggtaaaccggtaccggttaaacggtcgggttaggcggtaccccttggaacccttagtacttcggtactttcccggtgtaccccgtttacccgg

SEQ ID NO: 111771 - DNA, 751 bp, Homo sapiens
  misc_feature: GYAE6OF01BE0KJ.45.36.D03.1.454.CMB.1.raw
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagaaaccattggagaaatactgatgacgctagtttccacgccaccctgtctgtcgtctccgaaggggaaacncgcccaccctctctgcgtggaccagtcagtgttgtagccaaccncgttacgccgtaggtaaccacggacaacggaaaccgtggacccacggccctaccccgaacgtacctcccgtactagttttacgttcggtttcccttaccgtaaccggaggggtccccgtcttacgggttacctccccgacggtaccggtaggtttacgacggtccggtaccgtaggggttcggggtcggtaggggactaaggtaccgtttccgaacccttaccgtacctaacccgacgttacccaggtaccgtccgttacccggttacgtccgtaagttccggttaaacggttaagttttcggtttttaacgttaacgtttacggttttttaacgttttcgtaccgtacgtacgtacgttaattacgtactaacgttaacggttgttacgtacgtttacgttaggtttacggaccgggtaacgggacctaaggtacgtaacggtaacaaacgtaacgtaagttggacgtctcgtaacctactgttctacgttctaccg

SEQ ID NO: 111772 - DNA, 884 bp, Homo sapiens
  misc_feature: GYAE6OF01CTHVW.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagtcttcctccttccctctcgctactctggcctcccagactaaccaaccggtaaaaattgtgttgacacagtctccgagccacctgtctctcgtcctaccgagggacgactcgcccacccttctccgtcgacgacgggaccgtaggtacggaagttcgtacgtaaggttaaacgttacgttacggacgttacggtaaacccaaacgtaaacggtaaacccggtcggaccgaccgggtaccctacccggacggtccgttacctaactaccgttaccgtaaggttcgaacgttcggaacctaaccgtaacccgaaacgggttaccggggtccccgttagggacccccgggttacgaacccggttacgggttaccccgggtttccggacgggttaccggtaaggggtttcggaccgggtacgggtaactcggttacgtacctacgtcccgtacgtaccgtgaccggtacgcgtccgtaggaccgttacgtaggtcgtttaacggtttacgttttggtaacgttttccggtttaacttcggtttaacgcccgtagtacccggttaccggttcccggtttacccgacccggttaaccgcccggtttaaccgttccggggttacccgggttacgggggaaccgggttaccgggtaggttaccgggacggtaacggtccgtaaacgggaccggttaccgggttagtaccgggtccctaaccgttacccggtacgtttaactttacccggtgttttaaccccttccgggttaccctttacccccg

SEQ ID NO: 111773 - DNA, 820 bp, Homo sapiens
  misc_feature: GYAE6OF01BBGRY.45.36.D03.1.454.CMB.1.raw
tcagacgcgatcgacacgaccggtgctcgatttagctgcgtcacgatctctcgttggggggaggactgctcagttaggacccagagggaaccatggaacgccccagctcagcttctccttcctcctgctactctggcctcccagactaaccaaccggaaaattggtgttgaacactagtcctaccgaggccaccctgtctctgtccgtacgaggggacacacgcccaccctctcctgcgacgggccaggtaggagtcgtacaaggttaagtacgttaggcgtaacggtaaccaaacgaacgtaaaccgtcggacccgtaacggcctacccgaggtaccctcccgtactactacccgtagtacgacttcgactaacgtacccgaaacggtccgggttcccgtcgggtacctaccccgaggtaccggttacgggttccgaggtaccggtagggttcgggtacggacgggaactacggtacgttaccgaccttcccggtaacctaccggtaacgaccggaccgtcggtacccggtaacgggtaccgttaccggtacgtaacgttacggtttaacgttttacggtaccgttttaacgttttacctttaccgggtacgttacgaccggtaccgttaccggttcccggttaccccgaccggtaccccggtcccgtacccgttacggttacccggggtttacccgggggaccggggggtaaccgggtagggtagggtaacgtaggtcggtaaacggtaccggtaggttgggacggtccgacgtaccgacttacggttccttacgttccgttacgtaccgtttccccg

SEQ ID NO: 111774 - DNA, 808 bp, Homo sapiens
  misc_feature: GYAE6OF01AWOR9.45.36.D03.1.454.CMB.1.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctcggcctcccagactaaccgaaccggtaaaaatttgtgttcgaacacagtctccaggccaccctgtctctcgtctcgaggganacncgaccaccctcgtcctagcgacgggaccagtaggagtctacgtagttaagtacgttaggcctacggtaaccaaacgaacgtaaaccgtggaccacggccctaccgacggtaccttcctaccgtaacttccgaagtggacttacggacctaaccgtacccgtaaacggtccgggggttccccacgggtaccccgttccgaaacggttaccgtacggggttaccggtcggacgtcggggttacggggtcggacgggtaacgtaacgtaccggtttaccacttccgtaccggtccgtacgaggtaccgaccggtcgtaacgggtacctaccggtaggttacggttacgttaccgtttaactaccggttttaacgtttaccgggttaacttcgggaaccttaccgcgggtttaaccgtacccgtttcccgaaccgttccggaaccccttcggttaaaccggtcccggggttaacggggcccggggttaagggtacggggtaagtcgggtaaactccgggtaaagaacccggtaggttccggcgttacgacccgtacgttcctaggtacgtttaccgccttaagttccccgtaccgg

SEQ ID NO: 111775 - DNA, 780 bp, Homo sapiens
  misc_feature: GYAE6OF01AI025.45.36.D03.1.454.CMB.1.raw
  modified_base (237)..(237): a, c, t, g, unknown or other
  misc_feature (237)..(237): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtcctcgaggggagacacgccaccctctccgtgcgacgggccagtaggngtgtcaggtaagtacgttaggctaggtaaccaacgagtaaaaccgtggaccgacggcctacccgacggaccttccctacacttacccgaattacggaactcgacgtactacccgaaaccgtaccgggtcccgtacgggtaccctacccgaacggtaccgtacgggttcccgtagggccgtaacgggtcggggtacgtacgggaacgtaggtacggttacctaccgttcgacctaccggtacacgaccgtacgccgttacgggactccgtagacgttacgttacgtttacgacgtttacgttttaccgtcgttccggtactaccgtacgtaccggttacccggttaccccgaacccgtaccggtaccccgtaccgttaccgttacccggggttttaccgggggaccggggggtaacccgtagggggtaaccgtacgggtacgttacgggaacggtaaccggtaacgttcggtaacgggtaccctaacgaaccgttaccgtaccgtttacgggtacctttacctacccgttaccgttacccccgg

SEQ ID NO: 111776 - DNA, 771 bp, Homo sapiens
  misc_feature: GYAE6OF01B8USZ.45.36.D03.1.454.CMB.1.raw
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
tcagacgcgatcgacacgaccggtgctcgatttagctgcgtcacgagtctctcttggggaggaactgctcagttaggacccagaggaaccatggaagccccagctcagcttctcttcctctgctactctcggtctcccagactaccacggaaaattgtgtgacacagtctcgagccacctgtctctgtctcgagggacacgacgcccacctcnctgcgacggcagtagngtgtacgaagtagtacgtagctaggtaccaacgacgaaccgtcggaccgacggtccctaccgaggtcctcctctacctccagtcgaacgtcgacctaacgtaccgaacggtcggtccctcggtacctaccgaagtaccgtaccggtccgcgtacgtacggtcgggtcgtacggtacgtaggtacgtaccgtacgtccgtaccgtacggtctacgtacgtacgtccggtaggtacctacgtagtagtacgtttagttcgaacgtttaaccgtttactcgtagtaccggtaacgtcgtaccggttacccggaccccgtcgtacccggtacccgttccggttaacccgggtttaccgggggtcccgggggtaacccgggggtaaccgttaacgggggtacgggtaaccgttaaccgggttaacggaaaccccgggtacccgtttaaagggtccggttaacccggtccgtaccgtaccccggttaaaccgttccgttaacccgggtttccctttacccgggttaacccgttcccggttaacccccg

SEQ ID NO: 111777 - DNA, 806 bp, Homo sapiens
  misc_feature: GYAE6OF01DAV1Y.45.36.D03.1.454.CMB.1.raw
tcagacgcgatcgacacgaccggtgctcgatttagctgcgtcacgatctctcgttgggggaggaactgctcagttaggacccagagggaccatggaagccccagctcagtcttctcttcctcctgctactctggctcccagactaccgaaccggtaaaattgtagttcgacacagtctccgacggctacctgtctctgtctccgagggacacacgccaccctctccgtcgacgacggaccgagtaggagtcgtacgtaagtaacggtacgtaggtactacggtaaccaacgtaaggaacccgtcggacccgtacggacctacccgaggtcctaccgtactacgtcccagtagacgtcgacctacgtaccaacggtcggtacccctgggtaccctaccgacggtacgtaccggggtttccgcggtaccggtaggttcggggtacgtagggtacgacggttacgttacgtacctaccgtaccggaccttccggacacgttaccggacgtcggggacttccgtacggtattacggttacttcggtacgttttacgttacgttccgttacggtacgtacggtaccgtttacccgggtcgttaccccgtaccggtaccggtacccgttcccgggttaacccgggtcgggttttacccccggggggaccggggggttaaccgttacgggggttaacgaaccgggttaccgtaagggtaacgggtaaacggtacggttcggggtacctccgggtacgacccgttacggacgttacccgttccgggtttactccggttttaccccggtaccccg

SEQ ID NO: 111778 - DNA, 865 bp, Homo sapiens
  misc_feature: GYAE6OF01AT8T5.45.36.D03.1.454.CMB.1.raw
tcagacgcgatcgacacgaccggtgctcgatttagctgcgtcacggatctctcgttgggggacggaactgctctacgttaggaccctagagggaaccatggaagccccagctcagcttctcttcctcctgctactctggcctcccagactaccgaaccggtaaaattgtgttgacactagtctccgaggcacctgtctctcgtctcgagggagacgcggcctaccttcgtccgtcggccggtacgggaccgtagtacggtaggtcgtacgaagtaacgttacgttacggctacggttaaccaacgtacggtaaccgtcgggaccgacggtcctacccgtacggtccttaccctacgaaccttacccgaggtacggacttcggaccgtaccgtacccgaaaccggtaaccggggttacccgccgggtacccgttaccggaacggtaccggtaccgggttaccggtacgggtaccgtagggttccgggtacgtacggggtaaccgtagggtaccgttcgtaaccgttccgaacccgtaccgttacgacgcgtacgggtacccgttagggcctccggttagacgtttacggttaacttttacggtaccgtttaacgttttactcgggttacacccgtagggtaccctaagggtccccgttaaccgaccgtaccgtacccggtccggttaaccgttacccggggtttaccggggggaacccggggtaagtacgggtaggtaaaccggtggttaaacgggaacccggttacgtaccgggttggggacggttaccctacccggggttacctaaacccgggtttcgttaccccggttacggtttaccctttccgtaacccgttttcccccgg

SEQ ID NO: 111779 - DNA, 695 bp, Homo sapiens
  misc_feature: GYAE6OF01E2960.45.36.D03.1.454.CMB.1.raw
  modified_base (311)..(311): a, c, t, g, unknown or other
  misc_feature (311)..(311): n is a, c, g, or t
  modified_base (401)..(401): a, c, t, g, unknown or other
  misc_feature (401)..(401): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccgaggggagacacgcctaccctctcctgcgagggccagtaggagtcgcagtaacgtacttaggctggtaaccaacacgaaacctggaccagcctacccgaggcctccctnactccatcgatcgacacgtaccaacgtacgggcccctggtcctacccaagggacctacgggttcccgaggcctaggggttcgggttacgnggggaacgtaggtacgtttaccgaccgttaccgccgtaacccgtcgaacgacctaccggtccgtcgggacgtccgtaagttacttcggttaacttttcgtacgtttacgtttttaaccttcgtacgttaccgtacgtaccgtaaccggtcccgttacccgtacccgaccggtcccgtacgttcccggtaccgggtttacccggggaccggggggtaaccgtagggggttacggacggtagtacggaacggtacgtacggttgacggtctacgcaactagtcttgtcccttaccg

SEQ ID NO: 111780 - DNA, 882 bp, Homo sapiens
  misc_feature: GYAE6OF01BCOO0.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccgttgggttttcctcgttgcttcttttaagaggtgtccagtgtcaggtgcgagggtggtgggaggtcggggggagtcgttcgtccgagccgtgggacggtcccgtgagtcctcgtccgtgtcgccagtccctgtacggtactttccctccctacgtaacgtttaacgttttccggttacccacgttccgggtcccgccgtacggttccgacgggcgaaggggtctaggggtaggtcgggtcgtccctagtacgtttacggaagtagtacggaagtggaagtaacggtcctacgtcgaacgtccgtaccggtagggaaccggtcccgtacttaccaaccgtactcccgtaccgaaggtaaccgtaaccgttaaaccttaaccgtaaacggtaacgtttaccggtttacccgttttaacgtttttacggaaaccttaaaaggttacgtaaaacgttacggtacccgttaacgggtaaagggtttaacggttaacgggtaaccgggtaaccgttaacccggtttacgtttaccgggtttacctttaacgtttttaccggtaccgggttacccgggtaaccggggttaaacccgggggtaactttaaccgggtttacccgtttaaggttaacccgggttaacggtttttaacccgggtttacggggtttttaaaccgggttaacgttttaaaccgggttaaaacccgtttaccccgtttaaaaaccccccgg

SEQ ID NO: 111781 - DNA, 997 bp, Homo sapiens
  misc_feature: GYAE6OF01D1DYE.45.36.D03.1.454.CMB.1.raw
tcagacgcgatcgacacgaccggtgctcgatttagctgcgtcacgatctctcgttgggggaggaactgctcagttacggacccagagggaaccatggaacgccccagctcgagcttctccttcctcgtggcactcgtggcctccagactaccgaccggaagtaaattggtgttacgacactacgtcctaccgacggcctaccgttcgttccttctcgttccgtaccggaaggggacaccgaccgcccctacccgtcctccggtcgccggacgggacccgtaaggtacgggtacggttcgtaacggtaaacggttttaacggttaaccggttacgggtacggttaaccgtaacccgtaaaaccggtaaacggtaaaaccccggttcgggacccccggttaacgggtaccccttacccggaaacggttccccttaccccggtaaccttaccgtaccgtaagtcgtacggtacgtaccctaacccgttacccgtaaacccgggtaccgggtttccccgaacgggggttacccctaaccccgggtaaacggtaccgggttcccggtttccggggtcggtaaaccgggttcggggtacggggttacgggaccggggtaacgggtacggtttaccggtaaccctttccggtacccgttaccggtaacccggttgaacccgtcgggtaaccgtaccgggttccggtaaccggtcggtttaatagggtttccgtttttaagtaaccggtttccgttttaaccgttttacgtttcccgtagtacccgcggttaacccttcgggtttaccccgacccggtaacccggtccccgttacccggttacccggttccggggtttaaaccccgggggtccggggtaaccggggggtacggtaacggggtaggtacccggtagggtaaaccggtcgggtaaccgtacgggccgttaaggcccgttaacgacccgtacgtttacctcggtttaacctcccgggttctaccccgg

SEQ ID NO: 111782 - DNA, 775 bp, Homo sapiens
  misc_feature: GYAE6OF01AG62G.45.36.D03.1.454.CMB.1.raw
  modified_base (330)..(330): a, c, t, g, unknown or other
  misc_feature (330)..(330): n is a, c, g, or t
tcagacgcgatcgacacgaccggtgctcgatttagctgcgtcacgatctctcttgggggaggaactgctcagttaggacccagagggaaccatggaagccccagctcagcttcctcttcctcctgctactctggctcccagatacccaaccggaaaaattgtgttgacacagtctccaggccaccctgtctctgtcctccgaggggagacacgccaccctctcctgcgagggccaggtaggagtgtcgtagtaagttacgttaggcgtacggtaacccaaacgtacggaaaacccgtgggacccgaggcccgtacccgaggtccctcccncaatccccgatggatcgacctacctacccgaaaccggtaccgggtccccgtgggcccccgtcccgaacggtaccggttcggggttccccggtaggaccggtacggggttcggggtacggttacggggaaccgtaggttaaccgttccgaaccttcccgtaccggtacccgtcaacgtcccgacggtccgggtacgtaccggtcccgtaagtcgttagtttaccgtttacgtacgttttacgtttaccgttcggtttagtaccgtacgtcccgtacggtcccgttacccgcccgtacccgtccgtcccgtacccggttcggggtacccgggggcccggggtaaggggtcgggaggtaggtacggaggtaaccggtagggtaccgtgggttacggccgttacggaccctacgtcctcgtttacccgacctttccgtcccggttcccc

SEQ ID NO: 111783 - DNA, 949 bp, Homo sapiens
  misc_feature: GYAE6OF01BITW3.45.36.D03.1.454.CMB.1.raw
  modified_base (172)..(172): a, c, t, g, unknown or other
  misc_feature (172)..(172): n is a, c, g, or t
  modified_base (726)..(726): a, c, t, g, unknown or other
  misc_feature (726)..(726): n is a, c, g, or t
tcagacgcgatcgacacgaccggtgctcgatttagctgcgtcacgatctctcgttgggggaggaactgctcagttaggacccagagggaaccatggaacgccccagctcagcttctcttcctcctgctactctcggcctcccagactaccgaacggaaaattgtgtgacacngtctccgaggccaccctgtctcgtcgtccgtccgagggacacgcgcccaccctcctccgtcgcgacggccgtaaggtacggtagtcggtacgtaaggtaacgttacgttacggacgttacggtaaacccaaacgtaaccgtaaaccgttccgggaacccgtacggtcccctaccggtacggtaccccttcccgtaccgtaactcccgtagtaaccgtacgttaccgaccgttaaacccgtaacccggtaacccggtacccgggggttaccccctcggggttaaccccgttacccggaccggtaaacccgggttccggggtttcccggtacgggacggttaacggggtttcggggttaacccgtacgggggtaaccgttaaacgggttccccggtttaaccgtaaccccgttaccccggttaaccggaaccccggttaccggtacggtacccggttaccgggtaaccccggttaccggggtaacttcccggttaaggttacggttttcgttaaacggttttccggtaacgttttacggtttaccctttacgggtntacccggtaggttacccggtacccgtttccccggtacccgacccggtacccggttccttaacccgggttccgggttacccggggttccggggggaacccggggtacgtagggggaacggtagaccgggttagaaacccgggttgaccgggtttagcgggccttaaccgggacctacccggtttacgttccgttacccgttaccgtttccgtccgttacccccg

SEQ ID NO: 111784 - DNA, 826 bp, Homo sapiens
  misc_feature: GYAE6OF01CZKC3.45.36.D03.1.454.CMB.1.raw
tcagacgcgatcgacacgaccggtgctcgatttagctgcgtcacgatctctcttgggttttggggggaagaggaagactgacggtcctcccaggagttcaggtgctgggcaccttgggcgacgggggagcgttgtccagcctgggagtccctgagactctcctgtgcacgtcctcgtggtacttcctccctactaagttaactttcggttcccacggtcgggtacccgccgtacggttccagggccggaaggggctagggacggtcggggtccggtccctacgtacgttccgaaagagtaggaagtggaaggaaccggtcctaaccgtacgaacgtaccgtaccggtaggaacgggtcccgtcttaccaccgtactacctaccgaacggaacgaaactaaaccgttaccgaaaagtaacgttccgtttaccttttacgttttacgaaacgttaaagtacgtaaacgtacgtaccgttaggaaggttaaggttacggaacggtaaccgtacgttcgtacgttactttactttcggtacgtcgggaaccggagggtactacgttacgttagtacggtgttacgttagggttactaacggtacgttaactaccgtaaactaccgtacctaacgtatacggtacggtacggtcggtaacgggaacggtaaccggtaccgtccgaaccgtaccgttaccgtcgtaactaccgtacccgttaaccgacggaaaccccggtcctaacggtccccgggttaccccttccccgggcgtacccccgccggttaccgtcccgaacggtaggtacccgcccgtccgggttacccgggg

SEQ ID NO: 111785 - DNA, 729 bp, Homo sapiens
  misc_feature: GYAE6OF01BSKUJ.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgtaccttgggtttttcctcgttgcttcgttttaagaggtgtccagtgtcaggtgcgaggtggtggaggtcgggggagtcgttgtccagccgtgggacgtcctgagctcgtcctgtcgcagcctcgtggtacttcctccctcgtaacgtttaaccgttttcggtttacccgacgttccggggtccccgccgtacgggttcccgacgggcggtaacggggtcgtgggtaggtcgggttcgccccgttacgtacgtttaccggaagtagtaggaagtggaaggaacggtcctacgtacgagtaccgtccggtaggaacgggccctacgttaccacctacgtccgtaccgaacgacgactaactacgaagtacgttcgttacctttacttttacgactaaagtagtaaactacgtaccgtaggtaagtagttacggacgtaccgttacgttacgttcgttacgtttacgtttaccgttcggttccggtaccgggaacggggttacctacgtttacgtagttacggtacggtttcggttacgggtttacgttaggttaacgttaacgtaacccgttaaacccg

SEQ ID NO: 111786 - DNA, 476 bp, Homo sapiens
  misc_feature: GYAE6OF01B81GF.45.36.D03.1.454.CMB.1.raw
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (407)..(408): a, c, t, g, unknown or other
  misc_feature (407)..(408): n is a, c, g, or t
  modified_base (425)..(442): a, c, t, g, unknown or other
  misc_feature (425)..(442): n is a, c, g, or t
  modified_base (444)..(476): a, c, t, g, unknown or other
  misc_feature (444)..(476): n is a, c, g, or t
tcagacgcgatcgacacgaccggtgctcgattttagctgcgtcacgattctcttggggggctctggggagacgagcccagccactgggaagtcggccggttgttttccttttcgggtgatcatccactgaaacacaggaggactcaccagtggtactttgggctgtaccgttgggttttccctgttgcctttagttttaagacgtccttacccaccgaacggggccctattccggttcccttcccccgtggccctccctcgccgtcgaggacgcctaccgtcgggtggggaccagcggccggngtcggtcggctcggccgtggaacaacgggttacttcccgtttccncgtacgtcggtcgtacgtggacgggcgggtcacggcgacgccggatactagnantacgnngagctagcagctatgannnnnnnnnnnnnnnnnncnnnnnnnnnnnnnnnnnnnnnnnnnnnnnnnnn

SEQ ID NO: 111787 - DNA, 791 bp, Homo sapiens
  misc_feature: GYAE6OF01DPPBP.45.36.D03.1.454.CMB.1.raw
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
tcagacgcgatcgacacgaccggtgctcgatttagctgcgtcacgatctctcgttgggggaggaactgctcagttaggacccagagggaaccatggaagccccagctcagcttctccttcctcctgctactcgtcggcccccagactacccaaccggaaaattgtgttgacacagtctccaggccaccctgtctctgtctcgaggganacagcccacctctcctgcgacggccagtacggngtacgtacgtagtaaggttacgtaggcttacggtaacccaaaacgtaacggaaaaccgttcgggacccacggtaccctaccccgaggtccttcccctactaaccttaccagtcgtacgtccggacctacctacccggaaaacggccggggttccctcggggtacccgtaccccaagggtaaccgttcggggtttcccggagggtaccgtacggggtttcggggttaaccgtaggggaaccttagggttaaccgttcccaaccgttctacccgtaccggtctaacgccgaacgtccggtacggcgtactaggtacttgtagttttcgtactttacgtttctacgtcgttccgacgtcgtaccggtcccgttacccggccgtaccggtcccgtaccgttacccggttaccgggggttccggggggtaccgggggtacccgggtaggggttaccgggaacgttacgggtaggaaccgggtaacggtacggtcgggtgtaccggtccgtaccgtacgttacgtcttacgttcgttcccgtactcccggtacccg

SEQ ID NO: 111788 - DNA, 946 bp, Homo sapiens
  misc_feature: GYAE6OF01DNOQX.45.36.D03.1.454.CMB.1.raw
  modified_base (105)..(105): a, c, t, g, unknown or other
  misc_feature (105)..(105): n is a, c, g, or t
tcagacgcgatcgacacgaccggtgctcgatttagctgcgtcacgatctctctggggagctctgggagacgagcccagcactggagtcgccggtgttccttcggngatcatcactgaacacagaggactcaccatggtactttgggctcgaccgttgggttttcctcgtttgcttacttttaaggcggttgtccaggttcgtccgaggttcgccgaaggttgggtacggacgggtcggggggtagtccggttacgtccgaggcccgttaggggacggttccctggaacggtaccttcgtacccgttggtcgtaccgtaccggtcccgttacggtacggttacttttacccgtcccccttaggttaacggtttaaaccttttcggggtttaccaccgtttcggggtacccctccgttaaacgggttcccgtaggggtacgaacgggggttcctagggtacggggttacgggttccggaccccttacgttaaccgggttttcggaaacgtacggggttaccggtaaagggtcgggtaaacggtaaccgggacctttaaccggtacgtaacggtttaccccgcccggggtttaaagggaaacccggggttccccgttaaccggtttaaccggacccttaaccgggtacccgtttaacccgggtaaacgggttaaccggtaaccgtaaaacccgtttaccggaaaacggttaacgttacccggttttaccgtttcccgttttttaaaccggaacgttaaacttaccgggttaaaacttaccggttaacccgttaggtaacccgttaagggttaccggaacggtaccggtaccgttacgttacggttaccttagttcgttacggtaccgtaccgggacgggtaacttagtacgttaggtcggttaagtccggttacggtttcggtaggttacgtaacgttccttaaaccgg

SEQ ID NO: 111789 - DNA, 951 bp, Homo sapiens
  misc_feature: GYAE6OF01DPLJV.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctccttcctcctgctactctggctcccagactaccaaccggaaaattgtgttagacacacgtctccaggccaccctgtctcctgtcgtaccgaggggacgacgccgacccctaccccttcctaccgtcggaccgacgggtaccgtaacggtagggtagttcggtactaaggttaaacggtaccgttaggccgttaacggtaaccctaaacgaaacgtaaacccggtcgggaccgtaacgggtaccctacccggaacggtcccttacctacctacttacccgtaagtagtacgttcggacctaaacgttaacccgaaccggtaccgggtccctacgggacccttacccggacggtaccgttacgggttccgacgggtactacggggttcgggtacggtaggggtaacctacggttacgggtcctaacccttccccgtacgtacccggtacgtacggtacccgtaggtaccccggggttagaaccgtttcccggtaagtaggttttacggtttctttaaccgggtaacttttccggttttaacctttgggttacccgtaaccgtacggttcccgttaccgggtccccgtaacccggtccccgtacccggccccggttaaccgtttccgggtaccccgggggttttcgggggggaaccccggggttaccgggacgggggtttggaaaccggtttaggtaacccgggggtaaacggttaaaccccgggtacggttaaggggtcccggttaaccggtacggttaaccccccgaccgggtttttaacggtaccgggttttacccgttttaaaccccctttggttaacccccccgggtttccccccg

SEQ ID NO: 111790 - DNA, 368 bp, Homo sapiens
  misc_feature: GYAE6OF01ASCWG.45.36.D03.1.454.CMB.1.raw
  modified_base (148)..(148): a, c, t, g, unknown or other
  misc_feature (148)..(148): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (311)..(313): a, c, t, g, unknown or other
  misc_feature (311)..(313): n is a, c, g, or t
  modified_base (317)..(317): a, c, t, g, unknown or other
  misc_feature (317)..(317): n is a, c, g, or t
  modified_base (320)..(368): a, c, t, g, unknown or other
  misc_feature (320)..(368): n is a, c, g, or t
tcagacgcgatcgacacgaccggtgctcgatttagctgcgtcacgatctcgtcttggggttttgggggggaagaggaagactgacggtccctcccaggagttcagggtgctggggcaccttggggcgacgggggagtgtgtcacaagntttgggctcgtgggcaccggtgggcagtggggggagtgtgtcanagtntttgggctgngggcacnggccggccctggggctgccgtggtcaaggaccttacgttcccagattccggcgttcgtggacggtcggggtcctaggggaccagggccgacaagtggnnncagntgnnnnnnnnnnnnnnnnnnnnnnnnnnnnnnnnnnnnnnnnnnnnnnnnn

SEQ ID NO: 111791 - DNA, 840 bp, Homo sapiens
  misc_feature: GYAE6OF01DIFNF.45.36.D03.1.454.CMB.1.raw
  modified_base (72)..(72): a, c, t, g, unknown or other
  misc_feature (72)..(72): n is a, c, g, or t
  modified_base (127)..(127): a, c, t, g, unknown or other
  misc_feature (127)..(127): n is a, c, g, or t
  modified_base (184)..(184): a, c, t, g, unknown or other
  misc_feature (184)..(184): n is a, c, g, or t
  modified_base (406)..(406): a, c, t, g, unknown or other
  misc_feature (406)..(406): n is a, c, g, or t
tcagacgcgatcgacacgaccggtgctcgatttagctgcgtcacgagtctctcgttgggggaggaactgctnagtacggaccaggaggaaccagtaggaacgccccagctcagtcttctcttcctcngcctactcgtcggcctccaagactaccgaacggtaaaattgtgtacgacacagtccncacggcctaccctgtctcgtcgccgtacggaggggacaccgacgaccccaccttcctccgacggacggaccgggacgtaagggtaggaggttacgtacgtaaaggttaacgtaacgttagggtaaccggttacggaaaacccaacggttaaccgaccggtacggaccgaccgggtccctaccgtaacggtaccttcccgccaaacgttcccagtacggtaanccgtaaccaacccttaaccgaaccgggtcccgtaccgtacgacccggtaccgaacggtacgggttaccggttccggaggaccggttacgggtacgggttacggaccggtaacggtacttaaccgggtacctcgtttccgacccgtaaacgtcggtacgaccgggccgtacggtcggtaccgtcgtcggtaagttcgtttaacgttcggttacttttaacggttcgtcgttcgacgttaccgccggttaagttccccggtacccgtccgacccgggttacctccgtccgggggttacccgttccgggggggaacccggggtaaggtcggggttacggaacgggtaggtaacgtaacgggttaccgggtacgtcggccgggtaactccccgattacccgtttagcccgtttacgactttccccgtacggtttcccg

SEQ ID NO: 111792 - DNA, 789 bp, Homo sapiens
  misc_feature: GYAE6OF01DNRDA.45.36.D03.1.454.CMB.1.raw
tcagacgcgatcgacacgaccggtgctcgatttagctgcgtcacgatctctcttggggagctctgggagacgagcccagcactggaagtcgccggttgtttccttcggtgatcatcactgaacacagtaggactcaccatggtactttgggctgaccttgggtttcctcgttgcttcttttaagaggtgtccagtgtcgaggtgcgagggtggtgggaggtcggggggagtgttagtccaggccgttggggacgttcccgtagacgacctctcctggtgcacgtcctcgtggtacttcctcccgtagtaacgttaaccgttttggttaccctacggtccggggttaccggccgtaacgggttccgaacggtaccggtaacggggtcgttaggggtaacgggttgggggtaccgtccccgttacggttaaccgttttacccgggaaaggtacggttaggtaaacggtgggtaaacggaacggtaccccttaacggttcggaaaccgtaacggtcccggggtaagtaaccggggtccctacttaccaactacgtacctaccgaagacgtaacctaactaccgaagtaacgttccgtttccgtttacttttacgaactaaacgttacgtaagtaccgtatacggtaagtaggtttacggaacgttaccgtattccgttaggttcctttaacgttccgttggtaccggtccggtaacggggttaactaggtttctaggttaggcgtttcggttacgggtttaggtaccgtttaagtaaccgttcgtaaacccg

SEQ ID NO: 111793 - DNA, 834 bp, Homo sapiens
  misc_feature: GYAE6OF01E0TIQ.45.36.D03.1.454.CMB.1.raw
tcagacgcgatcgacacgaccggtgctcgatttagctgcgtcacgatctctcgttgggggaggaactgctcagttaggacccaggagggaaccagtggaacgccccagcctcagctttcctcctttccctcctgctactctggcctccagactaaccgaaaccggtaaaattgtgttgacacagtcctcacggcctacctgtctctgtcctaccggagggacgaccacgcccacccttcctcctcggaccggaacgggaccagggtaaggacgtacgtacgtaagttaacgttacgttaggtcgtacgtaaaccaacgaaccgaaccgtcggaccgacggtaccctaccgacggtcctaccacgtacctaccagtcgaacgtcgtacaacgttacccgaaaccggtccggggttcccctagggtccccgttaaccgaacggtaccgggttacccgggttaccggtagggaccggtagggttccgggtacgggtacggtaacggtaacggtttacggtacccttaaccgttacccgtaacccgtacccggtaccgacgggtacccggtaaccggtcccggtaagggtacgttacccggtagttacgttacggtttacttttggacgttttaccgtttactttcgttacgtacgacggtacgttccggtaccctaccggccgtaccgtacccgttccggtacgggttaacccggggttccggggggtaaccgggaaccgggtagggtacgggtaagtcgtaacggaaccgtaggtaccgtggccggcgtaccgaccgttaccgtacgttccgtagtttactcccgttcgtaccccg

SEQ ID NO: 111794 - DNA, 776 bp, Homo sapiens
  misc_feature: GYAE6OF01AO0V2.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggacgtttgggctcgtaccgttgggttttccctcggttgtcttacgtttttaagacggttcgtccagtgtcgaggtcgcgagggtggtagggaggtcgggggggagtcgttcgtccacggtccgtgggacggtccctgacgactctccgtgtcgcacgccttcgtcggtacttcccgtaccctcgtaacggtttaaccgttttcggttacccctacggttccggggtccccgtaccgtacggtttcccgaaggtaccggagggtccgtgggtacggttcgggccgtaccgtcgtacgttaccgagtagtaggaagtcgaggtaccgcctactccggaagtcccgttacggtaggaacccggtccgtaccgttaccaaccgtacctacccgtacgaccggtaacgttaaccgtaaaccgttaccgaaacgttacgttaccgtttacctttacgtttacgtaaccgttaaacgtacgtaaacgtcgtaccgttaggtaacggttacgttacgaacgggttaccgtacggttcgttacgtttacgttcgtttaccgtgtacccgggcggttaacggggtactagttacgttacgtagtccgttacggttcggttacgtagtaacgtccgttaagtaaccg

SEQ ID NO: 111795 - DNA, 824 bp, Homo sapiens
  misc_feature: GYAE6OF01BUFF3.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgtaccttgggttttcctcgttgtcttcgttttaagaggttcgtcctagtgtcaggtgcgagggtggtgggagggtcggggggagtcgttgtcccgaggtccgtggggacggtcccgtggacgtaccgttcctccgttaggtcgcctacggtcccgttcgttacggtaccttttcccgttaccccgttacgttaacggttttaaaccgtttttccgggtttaccccgtaaccggttccggggttaccccggtacccggttacggggtttacccgaacggggtaccggtaacggggggtcgttacggggtacgggttcggggtaccggtccccttacgttaaccgtttccggaaagtacgtagggaagtagaaacgggtacggtacctacgtacgaaccgtaccgtaccggtacggaaccgggccgtaccttaccaaccgtactccgtaccgtaagaacgtactaacgttaaccgaagtaactttcgttcctttcgttttaacgacttaaacgtagtaacgttacgacgtagtaagtacgttaggacgtaccgtacgttcgtagtttacgttacgtttcgtacggtaccggaaccgggtacgggtacttacgtacgttacgttacggtacgttcggtttcggttacgttaagtacgttaacctaacgttaaaccg

SEQ ID NO: 111796 - DNA, 773 bp, Homo sapiens
  misc_feature: GYAE6OF01COZBS.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcgagggccagtacggagtcgtacaaggttaagtacgtaggcctaggtaacccaaacaacgaaaccttcggacctaacggcccgtacccaagggtcctcctacgactcccattacgactcggcctaacgtacccaacgtacgggttcccctggtcccgtaacccaggtaaccgtacgggtttccgcggtcgagggttcgggtcgtacggactaggtacgtccctaacgtcttaaccgaccgtttcacgggtacctcggtacccgtttacgggacgtacccgttagttaagttacggtttactttttacgggaacttttaacggtttttcccgtacttcgggttaaccaggtacccggttacgggttaccccggttccccggtaccccgtaaaccgggtccccctttaccggtaacccgggtttccgggtttcccgggggggaaccggggggttaacccgtaggggggttaacggaccgtaggtacgaccggggttaccgtaaagtcgggtacgtcgtaccgactcctagtcctggttcccttgacgttccccg

SEQ ID NO: 111797 - DNA, 918 bp, Homo sapiens
  misc_feature: GYAE6OF01ERZ2M.45.36.D03.1.454.CMB.1.raw
tcagacgcgatcgacacgaccggtgctcgatttagctgcgtcacgatctctcgttgggggagaactgctcagttacggacccagaggaccatggaacgccccagcctcagtcttctcttcctcctgctactcgtcgcctcccagactacccgaaacggtaaaattgtacgttacgaaccacgtacgtcctacccgacggtccctacccgttgtcctcgttcgtcccgtaccggaggggaccacaccggacccctccctcgttccgcggtaccggacggtaccgtaaggtaggtacgttcgtaacgacgtaacggttacgtacggtacgtaaccgtaaccaaccgaagaaccggtccgaccgacgtcccacgacgtcctacctacgacctcgaacttgacctcgaccgtaacctacccggtaaccggtccgggttccctacggaaccccgttcggacgttaaccggtcccggtggtacggaccggttacgggtcgggttacggacggtacctaagttcccgtacctaacccgtcgtacccgtaacggtctaccgggtacgtaccgggtacggtaccggtacgtccgttaacgtttacgggttactttacggtttccgtttaagttacccggtttacttttcccggaagttacccgtacggttacccgttacccgggttacccgtcccccgggtaacgttccccccgaccgggtttaacccggttcccggggtttaacccggggggttcccgggggaccgggtttaaacccgggagggggtacgtaaccggttaaaggggaccccggttaaacgggtaccgggttccggttaccgggtcggttacccggaccccggttagttacccccgtgggttacccgttcccgttttaacctccccgggtttcccttaaccccgggg

SEQ ID NO: 111798 - DNA, 746 bp, Homo sapiens
  misc_feature: GYAE6OF01EU75B.45.36.D03.1.454.CMB.1.raw
  modified_base (437)..(437): a, c, t, g, unknown or other
  misc_feature (437)..(437): n is a, c, g, or t
  modified_base (545)..(545): a, c, t, g, unknown or other
  misc_feature (545)..(545): n is a, c, g, or t
tcagacgcgatcgacacgaccggtgctcgatttagctgcgtcacgatctctcttggggaggaactgctcagttaggacccagagggaaccatggaagcccagctcagcttctcttcctcctgctactctcggcccccagactaccgaacggtaaaattgtgttgacacagtcctacaggccacctgtcctcgtgtccgtaccgaggggacacacgcccacccgtctcctcggcgagggccaaggtacggagtcgtacgaagttaagtcgttacggctacggtaaccaacgaagaaccgtggaccaggccctaccgagtcctacctacactcctaatcgatcgactacaccgtaacggaccggtcctcggtcccgtaccgtaggtaccggtacgggttccggtacggacgtagggtccggggttacgcgggtaaacgnggttacgttacccgacttacgtaccccgtacgttaccgaggaacctcggtaccggttacggacctacgtgtactttacgggttatttacggtactttaacgttttccncgttacgtcgtaacgtcggtaccgtcccggttcccaccggtacgtcctacggtaccggtacgggggttccgggggaccggggttagcggggttacggaacggtcgtagggtaacccggtaaccgttagggttcggacggttccggaccgaacctacccgttgttcccggttggttaaccctccttaccgttccccgtaccg

SEQ ID NO: 111799 - DNA, 673 bp, Homo sapiens
  misc_feature: GYAE6OF01C4A2A.45.36.D03.1.454.CMB.1.raw
  modified_base (295)..(295): a, c, t, g, unknown or other
  misc_feature (295)..(295): n is a, c, g, or t
tcagacgcgatcgacacgaccggtgctcgatttagctgcgtcacgatctctcttgggggaggaactgctcagttaggacccagaggaaccatggaagccccagctcagcttctcttcctcctgctactctggctcccagataccaaccggaaaaattgtgttgacacagtctccaggccacctgtctctgtctccgaggggagacacgcccaccctctcctgcgagggccaaggtaggagtggtcaagtagtactaggcttaggtaaccaacgaagaaacctggaccagggtccncccgaggctacctcattaccatgatcgacaactcccaacggaccgggtccctggccgtacccaggacgtacggttccggtggaccgtagggtcgggtccgtagggaactaggtacgtttcacgttactccgaaccggtacaacggtccaaggtccccgttagggactcccgtgtaaattaggttagttttacgacgtttaacgtttaccgtttcgagttccgagaccgtacgccgtttcccggactaccggccgacttaccgtacgttaccggggacgacggggtaacccgaggggacgtaggaccgttagggaaccggtaaccgtaaggtcggttggcgttaccgactacccgttatccgtcgttctccgttaaccg

SEQ ID NO: 111800 - DNA, 728 bp, Homo sapiens
  misc_feature: GYAE6OF01AY337.45.36.D03.1.454.CMB.1.raw
  modified_base (523)..(523): a, c, t, g, unknown or other
  misc_feature (523)..(523): n is a, c, g, or t
tcagacgcgatcgacacgaccggtgctcgatttagctgcgtcacgatctctcttggggggaggaactgctcagttaggacccagagggaaccatggaagcccccagctcagcttctcttcctcctgctactctggctcccagataccaccggaaaaattgtgttgacacacgtctccaggcaccctgtctctgtctccgaggggagacacgcccaccctctcctgcagggccaggtaggcgtgtcagtagtacttaggctggtaccaatagaacctggccaggccttccgaggtcctcctcactccatcgatgccactccaacgacgggttcccctcggcccgtaccgacgaccgtacgggtttccggcggactacgggtgggtccggtgggacctaggtcgtttacgacctctaccgacccgttcgacgtcaccggtcccgtaggacgtccgtagtagtggtttaagtttgacgttacgtttttaccgtcgttgtaccgcgtccggtactcccggttacccnccgttaacccgcccgttaccgtaccgttccgggtttaccgggggaccccgggggtaaccgtacggggtacgggtacggacggtaggtaaaccggggtacccgtaaggttcggggtacggtcccgtttaccggacccgttaacccggttaacgtttcccggtttaccgggttttacccctttcggttaaccctttacccccccggg

SEQ ID NO: 111801 - DNA, 760 bp, Homo sapiens
  misc_feature: GYAE6OF01A1AV5.45.36.D03.1.454.CMB.1.raw
  modified_base (579)..(579): a, c, t, g, unknown or other
  misc_feature (579)..(579): n is a, c, g, or t
tcagacgcgatcgacacgaccggtgctcgatttagctgcgtcacgatctctcttggggccctgggaggaactgctcagttaggacccagagggaaccatggaagccccagctcagcttctcttcctcctgctactctggctcccagataccaccggaaaattgtagttgacacagtctccaggcaccctgtctctgtctaccgagggacacacgccacctctcctgcaggccagtaggagtgtacagtacgtacgtaggcgttacggtaaccaacgtaacgaaccgtcggacccgaacggtaccctaccgaaccggtccttaccctaccgacgttacccgattacgtacttcggactaccgtacccgtaaaaccggtccgggttaccccggtcgggtaccccgttacccgaacggttacccgtaacggggttttccggacgggtcctacggggttcgggtcgtacggggtaacgtacggtacgttaccgtaccgttccgtacccgtacccggtacgtacgaccgtacgtcccgggtcgaaccggtctacgtacgtcgtagtttcgacttacgtttaccngttcgctaacgcgtaccgtcttccgaccgtccgtcgtacctccggttacggttccgggccggggtaacgtcggggttacgggacgtcggttaacggaccggtaagggttacgttcgggttaccgcgggtttaaccgcccgttaaacggtaccggtttccttcgggttcctttaaccccggg

SEQ ID NO: 111802 - DNA, 821 bp, Homo sapiens
  misc_feature: GYAE6OF01CR5DT.45.36.D03.1.454.CMB.1.raw
tcagacgcgatcgacacgaccggtgctcgatttagctgcgtcacgatctctcgttgggggaggaactgctcagttaggacccagagggaaccatggaacgccccagctcagtcttctcttcctcctgactactcgtggcctccacgactaaccgaacggtaaaattgtgttcgacgacagtctccgacggccaccctgtctcgtgtccgtcggagggacacgacgaccctaccctctccgtcgcgtacgggaccgtaggtagggtagtcggtaacgtaacggtaacgttacgtacggtacgtacggtaacccgaaacgtaacggtaaacccggtcggtacccgacgtacccgtacccggtaacggtcccctttacccacctacctaccgtacgttacggacgtacgaacctaaccgtaacccgaaccggttaccgggtcccggtacggtacccgtaccccgagttacccggtacgggttcccggtggtccgtagggtcgggtacggtacgggaacgttacgtacgttccgtaacccgtcgtacccggtaaccgtacgacggtacccgtacggtaccggtacgggtaccgtaccgttacgtacgttgtttacgtttacgttaccgtttaagttttccgtcgtacgtaccgtcgttaccggtacgtcccggtaacccgccgtaccgtaccggtccgttaaccgggtccgggttacggggtacccggggtacggtgggtacggaggttacggacggtaacgacggttacgtgggtaccggtcgcgtacccgtagtacgttctacggttcctcgtccttaccccg

SEQ ID NO: 111803 - DNA, 234 bp, Homo sapiens; identical to SEQ ID NO: 111417
  misc_feature: GYAE6OF02IZHQY.45.36.D03.1.454.CMB.1.raw
  modified_base (231)..(234): a, c, t, g, unknown or other
  misc_feature (231)..(234): n is a, c, g, or t

SEQ ID NO: 111804 - DNA, 237 bp, Homo sapiens
  misc_feature: GYAE6OF02HMQVJ.45.36.D03.1.454.CMB.1.raw
  modified_base (211)..(237): a, c, t, g, unknown or other
  misc_feature (211)..(237): n is a, c, g, or t
tcagacgcgatcgacacgaccggtgctcgatttagctgcgtcacgagtcgtctcttgggtttgggggaagaggaagactgacggtcctccaggagttcaggtgctgggcaccttgggcacggggaggtgtgtcacaagatttgggccctgggctgcctggtcaaggactacttcctcgatcgcgtctgagcgggctggcaaggcgcatagnnnnnnnnnnnnnnnnnnnnnnnnnnn

SEQ ID NO: 111805 - DNA, 222 bp, Homo sapiens
  misc_feature: GYAE6OF02GOU1N.45.36.D03.1.454.CMB.1.raw
  modified_base (219)..(222): a, c, t, g, unknown or other
  misc_feature (219)..(222): n is a, c, g, or t
tcagacgcgatcgacacgaccggtgctcgatttagctgcgtcacgatctctcttgggggaagaggaagactgacggtcctcccaggagttcaggtgctgggcaccttgggcacggggaggtgtgtcacaagatttgggctctgggcacagcgtccctgggctgcctggtcaaggactacttcctcgatcgcgtctgagcgggctggcaaggcgcatagnnnn

SEQ ID NO: 111806 - DNA, 550 bp, Homo sapiens
  misc_feature: GYAE6OF02HR4P8.45.36.D03.1.454.CMB.1.raw
  modified_base (310)..(310): a, c, t, g, unknown or other
  misc_feature (310)..(310): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctcctcatccatgatgcatccaacncgggtcccctgggccgtccccagaccagggttcccgtggcaggtgggtctggggacaggagttcactctcaccgtcagcagcctggacgcctgatgtattttgctagtttacttctgtcagctagcgttccgccacgcccgctcctaccgtttcgggccgggggtaccgaggggtcggagagtgagacgtaacgtggttcggcgtgaccacgtactcgtcgttcttctacttccttcccg

SEQ ID NO: 111807 - DNA, 231 bp, Homo sapiens
  misc_feature: GYAE6OF02HSY36.45.36.D03.1.454.CMB.1.raw
  modified_base (222)..(231): a, c, t, g, unknown or other
  misc_feature (222)..(231): n is a, c, g, or t
tcagacgcgatcgacacgaccggtgctcgatttagctgcgtcacgagtcctactcttcgggggaggaactgctcagttaggacccagacggaaccatggaagccccagcgcagcttctcctcctcctgctactctggctcccaggaactgtggctgcaccatctgtcttcatcttcccgccatctgatcgatcgcgtctgagcggctggcaaggcgcatagnnnnnnnnnn

SEQ ID NO: 111808 - DNA, 530 bp, Homo sapiens
  misc_feature: GYAE6OF02HYN98.45.36.D03.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
tcagacgcgatcgacacgaccggtgctcgatttagctgcgtcacgatctctcttgggggaggaactgctcagttaggacccagagggaaccatggaagccccacctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaangggtccctggctcccagacaggttccgnggcaggtgggtctgggacnggagttcactctcaccgtcagcagcctggacgcctgatgtattttgctagtttacttctgtcagtcagtcgttccgccacgccgctccgacgtttcgggccgggggaccgtacggggtcggagagtgaggacgacgtggtggcgtgcaccgatcgtgtcttctctccttcccg

SEQ ID NO: 111809 - DNA, 540 bp, Homo sapiens
  misc_feature: GYAE6OF02F8R6G.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggcccccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacgcgggtccctggccgtcccagaccaggttccgtggcaggtgggtctgggacagtagttcactctcaccgtcagcagccgtggacgctgatgtatttgctagtttactctgtcagcacgtcgttccgccacgccgctcgtacgtttccgggccgggggtaccgaggggtcggagtagtggaggacggaacgtggtggctggcaccgatcgtcgttcttcgtacttcctcccg

SEQ ID NO: 111810 - DNA, 271 bp, Homo sapiens
  misc_feature: GYAE6OF02GDW7A.45.36.D03.1.454.CMB.1.raw
  modified_base (269)..(271): a, c, t, g, unknown or other
  misc_feature (269)..(271): n is a, c, g, or t
tcagacgcgatcgacacgaccggtgctcgatttagctgcgtcacgatctctcttgggtttgggggaagaggaagactgacggtcctcccaggagttcaggtgctgggcaccttgggcacggggaggtgtgtcacaagatttgggctctgggcaccgtgggcatgggggagtgtgtcacaagatttgggctctgggcacagcggccctgggctgcctggtcaaggactacttcctcgatcgcgtctgagcgggctggcaaggcgcatagnnn

SEQ ID NO: 111811 - DNA, 548 bp, Homo sapiens
  misc_feature: GYAE6OF02IOIUM.45.36.D03.1.454.CMB.1.raw
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
  modified_base (516)..(516): a, c, t, g, unknown or other
  misc_feature (516)..(516): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaacctggccaggctcccaggctcctcatccatgatgcatccaacncgggtccctggccgtcccagacaggttccgnggcaggtgggtctggggacaggagttcactctcaccgtcagcagcctggacgcctgatgtatttgctagttttacttcttgtcagtcagtccgttccgccaccgcccgtcttccgtacgtttcggggccgggggtaccgaggggtcggagagtggacggacggaacgtggtcggngtcgccactacgtccgtgtccttctacttccg

SEQ ID NO: 111812 - DNA, 511 bp, Homo sapiens
  misc_feature: GYAE6OF02HBX1C.45.36.D03.1.454.CMB.1.raw
  modified_base (338)..(338): a, c, t, g, unknown or other
  misc_feature (338)..(338): n is a, c, g, or t
  modified_base (374)..(374): a, c, t, g, unknown or other
  misc_feature (374)..(374): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcaggggccagtaggagtgtcagtaagtacttaggctggtaccaacagaaacctggccaggctcccaggctcctcatccatgatgcatccaacagggtccctggctcccagacaggttccnggcagtgggtctgggacagagttcactctcaccgtnagcagctgacgcctgatgtatttgctagtttacttcttgtcagctagtcgttccgccacgccgctcacgttcgggcggggaccgagggtggagagtgagacgaacgtcgtggctgcacatccgtgtcttcacttccg

SEQ ID NO: 111813 - DNA, 511 bp, Homo sapiens
  misc_feature: GYAE6OF02GB8HT.45.36.D03.1.454.CMB.1.raw
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (339)..(339): a, c, t, g, unknown or other
  misc_feature (339)..(339): n is a, c, g, or t
  modified_base (376)..(376): a, c, t, g, unknown or other
  misc_feature (376)..(376): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatgatgcatccaacngggtccctggctcccagacaggttccgnggcaggtgggtctgggacagagttcactctcaccgtnagcagcctggagccgtgatgatttgctagtttacttcttgtcagcagcgttccgccacgccgctctacgtttcgggcgggggtaccgagggtggagagtgagacgaacgtgtggctgcacatctgtcttcatccg

SEQ ID NO: 111814 - DNA, 543 bp, Homo sapiens
  misc_feature: GYAE6OF02JJ619.45.36.D03.1.454.CMB.1.raw
  modified_base (202)..(202): a, c, t, g, unknown or other
  misc_feature (202)..(202): n is a, c, g, or t
  modified_base (344)..(344): a, c, t, g, unknown or other
  misc_feature (344)..(344): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccagggganacagccaccctctccgtgcagggccagtaggagtgtcagtaagtacttaggctggtaccaacagaaacctggccaggctcccaggctcatcatccatgatgcatccaacgagggtccctggccgtcccagaccaggttccgnggcaggtgggtctgggacagtacgttcactctcaccgtcagcagcctggacgcctgatgtatttcgctagtttacttctgtcagcgacgtcgtccgtccacgccgctcgtacgttcgggccgggggtactacgggtgagtacgtgacggacgaacgtgtcggcgtgaccgacgtacgtccgtgtccgttacagttcccg

SEQ ID NO: 111815 - DNA, 244 bp, Homo sapiens
  misc_feature: GYAE6OF02I4T6B.45.36.D03.1.454.CMB.1.raw
  modified_base (216)..(244): a, c, t, g, unknown or other
  misc_feature (216)..(244): n is a, c, g, or t
tcagacgcgatcgacacgaccggtgctcgatttagctgcgtcacgatctctcttcgggttttgggggaagaggaagactgacggtcctcccaggagttcaggtgctgggcaccttgggcacgggggaggtgtgtcacaagatttgggccctgggctgccttggtcaaggactacttcctcgatcgcgtctgagcgggctggcaaggcgcaggtagnnnnnnnnnnnnnnnnnnnnnnnnnnnnn

SEQ ID NO: 111816 - DNA, 501 bp, Homo sapiens
  misc_feature: GYAE6OF02FHLKV.45.36.D03.1.454.CMB.1.raw
  modified_base (498)..(498): a, c, t, g, unknown or other
  misc_feature (498)..(498): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctggctcccagacaggttccgtggcagtgggctggggacagagttcactctcaccgtcagcagcctggagcctgatgattttgctagttacttctgtcagcagcgttccgccacgccgctcactttcgggcgggggaccagggtggagatgagacgaactgtggctgcaccatctgtcttcntcc

SEQ ID NO: 111817 - DNA, 526 bp, Homo sapiens
  misc_feature: GYAE6OF02IXSI4.45.36.D03.1.454.CMB.1.raw
  modified_base (508)..(508): a, c, t, g, unknown or other
  misc_feature (508)..(508): n is a, c, g, or t
tcagacgcgatcgacacgaccggtgctcgatttagctgcgtcacgatctctcttggggagaactgctcagttaggacccagagggaaccatggaagccccagctcagcttctcttcctcctgctactctggctcccagatacaaccggaaaaattgtgttgacacagtctccaggccaccctgtctctgtctccaggggagacagcccaccctctcctgcagggccagtaggagtgtcagtaagtacttaggctggtaccaacagaaacctggccaggctcccaggctcctcatccatgatgcatccaacagggtccctggcgtcccagaccaggttccgtggccaggtcggggtcctggggaacaggagttcactctcaccgtcagcagcctggagcctgatgtattttgctagtttacttctgtcagcagtcgtccgcacgcccgctcacgtttcgggcggggaccgagggtggagtagtgagacgtaactgtacggctcgctacnctcgtgtcttcgattccg

SEQ ID NO: 111818 - DNA, 623 bp, Homo sapiens
  misc_feature: GYAE6OF02JQNYA.45.36.D03.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
tcagacgcgatcgacacgaccggtgctcgatttagctgcgtcacgagtctctcttggggaggaactgctcagttaggaccagagggaaccatggaagcccagctcagcttctcttcctcctgctactctggctcccagataccaccggaaaattgtgttgacacagtcctccaggcaccctgtctcgtgtctccagggganacagccacctctcctgcagggccagtaggagtgtcagtaagtacttaggctggtaccaacagaaacctggccaggcctcccaggctccncatccatgatcgcatccaacgcgggtccctgggccgtcccagactaggttcccgtaggccaggtcgggtctaggggactaggcgttaccacgtcctacaccggtcaggcacgccgtggacgtccgtagactgtatttgactagtttactcgttcgtacgcgtacgagtccgttccgccgtacgtccgtccgttacgtaccgtttccggggccgggggtaaccgtaggggttcggaacggtacgttacggacggtaaccggtaacggttcggtacgggtcgttacggaccgtaaccgtacgttccgttacgtttaccgttcgtaccgtttcccg

SEQ ID NO: 111819 - DNA, 228 bp, Homo sapiens
  misc_feature: GYAE6OF02FHK6T.45.36.D03.1.454.CMB.1.raw
  modified_base (226)..(228): a, c, t, g, unknown or other
  misc_feature (226)..(228): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnnn

SEQ ID NO: 111820 - DNA, 525 bp, Homo sapiens
  misc_feature: GYAE6OF02HRHBD.45.36.D03.1.454.CMB.1.raw
  modified_base (316)..(316): a, c, t, g, unknown or other
  misc_feature (316)..(316): n is a, c, g, or t
  modified_base (345)..(345): a, c, t, g, unknown or other
  misc_feature (345)..(345): n is a, c, g, or t
  modified_base (382)..(382): a, c, t, g, unknown or other
  misc_feature (382)..(382): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccaggggagacagccaccctctcctgcagggccagtaggagtgtcagtaagtacttaggctggtaccaacagaaacctggccaggcctcccgaggcctcctcatccatgatgcatccaacgngggtccctggcctcccagacaggttccgnggcaggtgggtctgggacagagttcactctcaccgtnagcagctggacgccgtgatgtatttgctagtttacttctgtcagcagtcgttccgccacgcccgtctcgtacgttcgggccgggggtaccgagggtcggagagtggagacgaacgtgtggctgcactagtctgtcttctatcc

SEQ ID NO: 111821 - DNA, 609 bp, Homo sapiens
  misc_feature: GYAE6OF02JI7HZ.45.36.D03.1.454.CMB.1.raw
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (416)..(416): a, c, t, g, unknown or other
  misc_feature (416)..(416): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccaggtaggagtgtcagtaagtacttaggctggtaccaacagaaacctggccaggctcccaggctcctcatccatgatgcatccaacngggtccctggcgtcccagacaggttccgnggcaggtgggtctgggacagagtttcactctcgaccgtcagcagtcctggacgcctgatgtatttgctagtttctntcgtcagcacgtccgttccgcctaccgcccgtccgttaccgtaccggtttccggggaccggggggtaccgacgggggttacggaacgggtacgtacggaacgggtacccggtaaacggttggttacggggtccgtacggccgtaacccgtacggttccgttacggttacccgtttaccgtaccgtttccccgg

SEQ ID NO: 111822 - DNA, 545 bp, Homo sapiens
  misc_feature: GYAE6OF02ISMZF.45.36.D03.1.454.CMB.1.raw
  modified_base (262)..(262): a, c, t, g, unknown or other
  misc_feature (262)..(262): n is a, c, g, or t
  modified_base (340)..(340): a, c, t, g, unknown or other
  misc_feature (340)..(340): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatgatgcatccaacacgggtccctggcctcccagacaggttccgnggcaggtgggtctggggacaggagttcactctcacgtcagcagcctggagcctgatgtatttgctagtttacttctgtcagcagtccgttccgccaccgccgtctctacggtttcgggaccgggggtaccgtaggggtcggagtagtaggaggtaccggtaacgtggtcggcgtgaccgacacgttccgtgtacttcgattcccg

SEQ ID NO: 111823 - DNA, 551 bp, Homo sapiens
  misc_feature: GYAE6OF02HMH8K.45.36.D03.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (385)..(385): a, c, t, g, unknown or other
  misc_feature (385)..(385): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctccncatccatgatgcatccaacagggtcccctgggccgtcccagaccagggttcccgtggccaggtgggtctggggacagagttcactctcaccgtnagcagcctggagctgatgtatttgctagtttacttcttgtcagctacgtcgttccgccacgccgctccgtacgtttccgggccgggggacctaggggtcggagagtgagacggtaacgtggtggcgtcgccgaccgacgtcgtgttccttctacgttccttccccg

SEQ ID NO: 111824 - DNA, 212 bp, Homo sapiens
  misc_feature: GYAE6OF02HOLZN.45.36.D03.1.454.CMB.1.raw
  modified_base (211)..(212): a, c, t, g, unknown or other
  misc_feature (211)..(212): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacggggaggtgtgtcacaagatttgggccctgggctgcctggtcaaggactacttcctcgatcgcgtctgagcgggctggcaaggcgcatagnn

SEQ ID NO: 111825 - DNA, 234 bp, Homo sapiens; identical to SEQ ID NO: 111417
  misc_feature: GYAE6OF02HTJ6H.45.36.D03.1.454.CMB.1.raw
  modified_base (231)..(234): a, c, t, g, unknown or other
  misc_feature (231)..(234): n is a, c, g, or t

SEQ ID NO: 111826 - DNA, 553 bp, Homo sapiens
  misc_feature: GYAE6OF02IVTOM.45.36.D03.1.454.CMB.1.raw
  modified_base (442)..(442): a, c, t, g, unknown or other
  misc_feature (442)..(442): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctnatggacgtcgtggggcaaagggacctcggtcaccgtctccgcagtctccgaccagggcccagtccggtccttccccgtggccgccctcgcctccgaggacgccacctcggg

SEQ ID NO: 111827 - DNA, 525 bp, Homo sapiens
  misc_feature: GYAE6OF02IZDP8.45.36.D03.1.454.CMB.1.raw
  modified_base (311)..(311): a, c, t, g, unknown or other
  misc_feature (311)..(311): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (521)..(521): a, c, t, g, unknown or other
  misc_feature (521)..(521): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacngggtccctggctcccagacaggttccgnggcaggtgggtctggggacaggngttcactctcaccggtnagcagcctggacgcctgatgtattttgctagtttacttctgtcagctagtcgttccgccaccgccgctcgtacgtttcgggccgggggtaccgagggtcggagagtgacgacgaacgtgtcggctgcgacactctgtcttcntccg

SEQ ID NO: 111828 - DNA, 548 bp, Homo sapiens
  misc_feature: GYAE6OF02GNCUL.45.36.D03.1.454.CMB.1.raw
tcagacgcgatcgacacgaccggtgctcgatttagctgcgtcacgatctctcttgggttttgggggaagaggaagactgacggtcctcccaggagttcaggtgctgggcaccttgggcacggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggactctggggcaaagggacctcggtcaccgtctccgcagcttccaccaggcccagtccggtccttcccccgtggccgccctcgccttcccaggcgcacctccggg

SEQ ID NO: 111829 - DNA, 565 bp, Homo sapiens
  misc_feature: GYAE6OF02H87UK.45.36.D03.1.454.CMB.1.raw
  modified_base (312)..(312): a, c, t, g, unknown or other
  misc_feature (312)..(312): n is a, c, g, or t
tcagacgcgatcgacacgaccggtgctcgatttagctgcgtcacgatctctcttgggggaggaactgctcagttaggaccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctggtaccaacagaaacctggaccaggctcccaggctcctcatccatgatgcatccaacngggtccctggccgtcccagactagggttccgtggcaggtggggtctggggacaggacgttcactctccaccgtcaggcagcctggacgcctgatgtatttgctagttttacttcttgtcagcagtcgtccgccaccgccgctccgtacgtttccgggccgggggtaccgagggtcggagtagtaggaacggtacggaacgtggtacggccgttcgaccgaccgtacgtccgttcggtctttaccagttccccg

SEQ ID NO: 111830 - DNA, 890 bp, Homo sapiens
  misc_feature: GYAE6OF02JFOH8.45.36.D03.1.454.CMB.1.raw
  modified_base (220)..(220): a, c, t, g, unknown or other
  misc_feature (220)..(220): n is a, c, g, or t
tcagacgcgatcgacacgaccggtgctcgatttagctgcgtcacgatctctcttgggggaggaactgctcagttaggaccagagggaaccatggaagcccagctcagcttctcttcctcctgctactctggctccagataccaaccggaaaattagtgttgacacagtctccacggcacctcgtctctgtctccgagggagacacgccacctctcctcgnccgacgggaccgacggtaggtaggtcgtacgaggtaacgtacttaggggtacgttagggttaaccgaaaaccgtaacggtaaaacccgttacagggggaacccctaacggggtacccgttaacccccgtaacggggtacccttacccggttacccgtaaccgttaccccgaacttacggaacgttacggtaccgtaaacgtacccgtaaaaccgtaacggggttaccccgttacggggtacccggtaccccgtaacggtaacccgtaacggggttacccggtacgggtaccggtaacgggtacggggtaccgttacgggggtaaccgtaacgggtaacggttaccgtaaccgttaccgtaccgtaacccggttaccgtaacggtaccgtaacggtacccggtacgggtaacggtaccgtacggtaacgttacggtaacgttttacggttacgttaacgttttaaccgtttacgttacgttaccgtaacggtacgtaacggtaccggttacccggtacccgtaaccggtacccggtaccgtaccgtaccgttaccgggtaccgggggtacccgggtacggggtacgggtacgggtaacggtacggtaacggtaaccggtaaccggtacggtacgggtacggtacggtaccggtaaccgtacgtacgtacgg

SEQ ID NO: 111831 - DNA, 547 bp, Homo sapiens
  misc_feature: GYAE6OF02HZOMH.45.36.D03.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcacctgtctctgtctccagggganacagccaccctctcctgcagggccagtaggagtgtcagtaagtacttaggctggtaccaacagaaacctggccaggctccaggctcctcatccatgatgcatccaacncgggtccctggccgtcccagactacgggttccgtggcaggttgggtctggggacaggtacgttcactctcaccgtnagcagccgtggacgcctgatgtattttgctacgttttacttctgtcagcagtccgtccgccaccgccgctccgtaccgtttccgggccgggggtaccgtagggtcggagagtggaggacgaacgttggtggcgtcgcgacgtactctgttcttcgacttccg

SEQ ID NO: 111832 - DNA, 550 bp, Homo sapiens
  misc_feature: GYAE6OF02JBH0J.45.36.D03.1.454.CMB.1.raw
  modified_base (263)..(263): a, c, t, g, unknown or other
  misc_feature (263)..(263): n is a, c, g, or t
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggcctcctcatccatgatgcatccaacacgggtcccnggccgtcccagaccaggttccgnggcaggtgggtctgggacngagttcactctcaccgtnagcagcctggacgccgtgatgtatttgctagtttacttcttgtcagcacgtccgttccgccgtaccgcccgtctccgtaccgtttccgggccgggggaccgagggtggagagtggacggacggaacgtggtcggcgtcgcgaccgtacgtccgtgtccttctattcccg

SEQ ID NO: 111833 - DNA, 519 bp, Homo sapiens
  misc_feature: GYAE6OF02F2LFL.45.36.D03.1.454.CMB.1.raw
  modified_base (339)..(339): a, c, t, g, unknown or other
  misc_feature (339)..(339): n is a, c, g, or t
  modified_base (376)..(376): a, c, t, g, unknown or other
  misc_feature (376)..(376): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctcctcatccatgatgcatccaacagggtccctggcctcccagacaggttccgnggcagtgggtctgggacaggagttcactctcaccgtnagcagcctggagcctgatgtatttgctagtttacttctgtcagcagcgttccgccacgccgctcgtaccgtttcgggccgggggtaccagggtcggagagtggagacgacgtgtggcgtgcaccatctgtctctactctcccg

SEQ ID NO: 111834 - DNA, 532 bp, Homo sapiens
  misc_feature: GYAE6OF02IXN1S.45.36.D03.1.454.CMB.1.raw
  modified_base (344)..(344): a, c, t, g, unknown or other
  misc_feature (344)..(344): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacacgggtccctgggccgtcccagacacggttccgnggcaggtgggtctggggacagagttcactctcgaccgtcagcagcctggacgcctgatgtattttgctagtttacttcgttgtcacgctagtccgtccgccacgccgctcgacgtttcgggccgggggtaccgagggtggagtagtgagtacggaacgtgtggctgcacgatcgtgtcttcattcccg

SEQ ID NO: 111835 - DNA, 534 bp, Homo sapiens
  misc_feature: GYAE6OF02I3AY2.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgttccaggggaaanagccaccctctcctgcagggccagtcagggtgttaacagctacttagcctggtaccaacaaaacctgcaggctccaggctcatcatctatgacgcatacgaacagggccactggcatcccagccaggttcagtcggcagtgggtctgggacagacttcactctacaccatcagcacgcctggaccctggacgtatttcgactatttactactgtcagcagcgtggcgacgagcgctctacgttcggcggtacgggacctaagggtcgaagtacaacgaaacggtaacgtggtcggtacctgcaaccgatccgtggtaccttcgacttcccg

SEQ ID NO: 111836 - DNA, 573 bp, Homo sapiens
  misc_feature: GYAE6OF02HMG02.45.36.D03.1.454.CMB.1.raw
  modified_base (299)..(299): a, c, t, g, unknown or other
  misc_feature (299)..(299): n is a, c, g, or t
  modified_base (436)..(436): a, c, t, g, unknown or other
  misc_feature (436)..(436): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccaggggagacagccaccctctcctgcaggaccacccagagtgttaggagcaatcacttagcctggtaccagcaagaaacctggaccaggctaccaaagcctcctnatctacggtgcatccaggtacggccgctggcactcccaagacaggttcagtggcaggtgggtctgggacagacttcacttctccaccatccaacctaaggttggacgtcctagaagttatttgcttgtcttaatttnttcgtacaacttctattcggttactttcttcgttttgttcgtcgttttccgcccgtggaccctactaggtacgaaacttaccgaaaacggtacttggtcggacctgacccaaccgtattccgtgttccttcgtaacc

SEQ ID NO: 111837 - DNA, 521 bp, Homo sapiens
  misc_feature: GYAE6OF02GDBKS.45.36.D03.1.454.CMB.1.raw
  modified_base (310)..(310): a, c, t, g, unknown or other
  misc_feature (310)..(310): n is a, c, g, or t
  modified_base (376)..(376): a, c, t, g, unknown or other
  misc_feature (376)..(376): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggatgtcagtaagtacttaggctggtaccaacagaaacctggccaggctcccaggctcctcatccatgatgcatccaacngggtccctggcctcccagacaggttccgtggcaggtgggtctgggacagagttcactctcaccgtnagcagctggacgcctgatgtatttgctagtttacttcttgtcagcagtcgttccgccgaccgccgctcgaccgtttcgggccgggggtaccgagggtggagagtgagacgaacgtgtggctgcactacgtcgtgtcttctatccg

SEQ ID NO: 111838 - DNA, 564 bp, Homo sapiens
  misc_feature: GYAE6OF02J1256.45.36.D03.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacntacttggcctggtatcaatacaagcctggccagggtccccgctcctcatctatgatgcttccagcagggccacgtggcatcccagccaggttcagtggcggtggttgcacgagtacttcactctcgacaatcagcacgcctaccaacctgaacgtattttcgactagtactagttactgtacaactagaccgtaacgagtacgttcgggaccgtctaccgtacgttttccgggacggtacgggtaaccgtaagggttacggaacggtacgttaccgaaacggtaacgttcggtacggtacgtacggaccgtaccgtaacg

SEQ ID NO: 111839 - DNA, 210 bp, Homo sapiens
  misc_feature: GYAE6OF02F1HDD.45.36.D03.1.454.CMB.1.raw
  modified_base (210)..(210): a, c, t, g, unknown or other
  misc_feature (210)..(210): n is a, c, g, or t
tcagacgcgatcgacacgaccggtgctcgatttagctgcgtcacgatccctcttgggtttgggggaagaggaagactgacggtcctcccaggagttcaggtgctgggcaccttgggcacggggaggtgtgtcacaagatttgggccctgggctgcctggtcaaggactacttcctcgatcgcgtctgagcgggctggcaaggcgcatagn

SEQ ID NO: 111840 - DNA, 214 bp, Homo sapiens
  misc_feature: GYAE6OF02I8JDT.45.36.D03.1.454.CMB.1.raw
  modified_base (210)..(214): a, c, t, g, unknown or other
  misc_feature (210)..(214): n is a, c, g, or t
tcagacgcgatcgacacgaccggtgctcgatttagctgcgtcacgatccctcttgggttttgggggaagaggaagactgacggtcctcccaggagttcaggtgctgggcaccttgggcacggggagtgtgtcacaagatttgggccctgggctgcctggtcaaggactacttcctcgatcgcgtctgagcgggctggcaaggcgcatagnnnnn

SEQ ID NO: 111841 - DNA, 814 bp, Homo sapiens
  misc_feature: GYAE6OF02HHXDI.45.36.D03.1.454.CMB.1.raw
tcagacgcgatcgacacgaccggtgctcgatttagctgcgtcacgatctctcttgggggaggaactgcctctaggttacggacccaggacgggaaccagtaggaaccgccccagcctcagtcttcttccttcctcctgctactcgtggcctcccagactaccgaaaccggtaaaattgtgttagacacagtctcgaggccacctgtctctgtcctccggaggggacacacgccctaccctcctcctcgcgacgggcctaaggtaggagttcgtacgtaaggttaacgttacgttacggacgttacggtaaccaaacgtaacgaaaccgtcggaccgacggcctacccgaggtccttcctacacttccaagtcgacttcgacctaacgtacccgaaacggtccggggtccccgtgggcccgttacccaaggtaccgttacggggtttccgcggacgtaggggttcgggtacgtacggggaactaggttacggttaccaacttccgtacctacccggttcgacggccgtacggccggttagggaccgtccgtagtacgtttcgttacgttttcggacgttttacgttttaccttcgttacgtaccgtaggtaccgtacggttcccgttacccgaccgtaccggaccttacccgtcgtttaacccggggtttccgggggacccgggggttaaccggtaggggttacgggaacgtacggacggtaaccggtaaccggtaacggttcgggtacgggtccgtacggaccgtaaccgttcgttccgtttcggtttaccctttccgtaccgtttacccccgg

SEQ ID NO: 111842 - DNA, 537 bp, Homo sapiens
  misc_feature: GYAE6OF02GZRYA.45.36.D03.1.454.CMB.1.raw
  modified_base (202)..(202): a, c, t, g, unknown or other
  misc_feature (202)..(202): n is a, c, g, or t
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (445)..(445): a, c, t, g, unknown or other
  misc_feature (445)..(445): n is a, c, g, or t
  modified_base (480)..(480): a, c, t, g, unknown or other
  misc_feature (480)..(480): n is a, c, g, or t
  modified_base (505)..(505): a, c, t, g, unknown or other
  misc_feature (505)..(505): n is a, c, g, or t
  modified_base (516)..(516): a, c, t, g, unknown or other
  misc_feature (516)..(516): n is a, c, g, or t
  modified_base (528)..(528): a, c, t, g, unknown or other
  misc_feature (528)..(528): n is a, c, g, or t
  modified_base (536)..(536): a, c, t, g, unknown or other
  misc_feature (536)..(536): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacgacgggtcccctggccgtcccagtaccaggttccgnggcaggtcgggtctggggacaggacgttcactctcgaccgtnaacngccgtggactcctgatgtatttgcttagtttactctgtcagcagtccgttccnccacgcctctccgtacgtttcggggcggggtaccnggggtgagtagtgagacgacgtggnggctgccactntcctagtcttcnttcctccnc

SEQ ID NO: 111843 - DNA, 545 bp, Homo sapiens
  misc_feature: GYAE6OF02HGYU1.45.36.D03.1.454.CMB.1.raw
  modified_base (537)..(537): a, c, t, g, unknown or other
  misc_feature (537)..(537): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtcgtgggcaaagggacctcggtcaccgtctccgcacgcttccaccacggccagtccggtcttccccgtggccgccctgcctccaggacncacctcgg

SEQ ID NO: 111844 - DNA, 524 bp, Homo sapiens
  misc_feature: GYAE6OF02GSZ3V.45.36.D03.1.454.CMB.1.raw
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
tcagacgcgatcgacacgaccggtgctcgatttagctgcgtcacgatctctcttggggagctctgggagacgagcccagcactggaagtcgccggtgttccttcggtgatcatcactgaacacagaggactcaccatggactttgggctgacctgggttttcctcgttgctctttaagaggtgtccagtgtcaggtgcaggtggtggagtcggggggagcgttgtccagcctggggagtccctgagactctcctgtgcagcctctggattctccctcagtaactttggtttccactgggtccgccaggttccaggcaaggggctggagtggtgcctnattccgagntggagtgagaaggctancagactccgtgaagggccncttcaccatctccagagacaattccaagaatcgtccttcttttgtctaaatgaatagcctgagagttagaggacacgtctgtctatttctgtgccgtagggggactatctatgtagtcgtggttcggtagtagtatctaacg

SEQ ID NO: 111845 - DNA, 234 bp, Homo sapiens
  misc_feature: GYAE6OF02HI3KM.45.36.D03.1.454.CMB.1.raw
  modified_base (230)..(234): a, c, t, g, unknown or other
  misc_feature (230)..(234): n is a, c, g, or t
tcagacgcgatcgacacgaccggtgctcgatttagctgcgtcacgatctctcttggggagagctctggggaggaactgctcagttaggacccagacggaaccatggaagccccagcgcagcttctcctcctcctgctactctggctcccaggaactgtggctgcaccatctgtcttcatcttcccgccatctgatcgatcgcgtctgagcgggctggcaaggcgcatagnnnnn

SEQ ID NO: 111846 - DNA, 558 bp, Homo sapiens
  misc_feature: GYAE6OF02FREJ3.45.36.D03.1.454.CMB.1.raw
  modified_base (263)..(263): a, c, t, g, unknown or other
  misc_feature (263)..(263): n is a, c, g, or t
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (381)..(381): a, c, t, g, unknown or other
  misc_feature (381)..(381): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggcctcccaggctcctcatccatgatgcatccaacgngggtccctggcctcccagacnggttccgnggcaggtgggtctgggacaggacgttcactctcaccgtnagcagcctggacgcctgatgtatttgctagtttacttcttgtcagcagtccgttccgccaccgcccgtctccgtaccggttccggggccgggggtaccgaggggtcggagtagtggacggaacggtaacgtcggtcggcgtcgacgtaccgacgtccgttcgtcttccgtattcccg

SEQ ID NO: 111847 - DNA, 668 bp, Homo sapiens
  misc_feature: GYAE6OF02J048Q.45.36.D03.1.454.CMB.1.raw
  modified_base (200)..(200): a, c, t, g, unknown or other
  misc_feature (200)..(200): n is a, c, g, or t
  modified_base (260)..(260): a, c, t, g, unknown or other
  misc_feature (260)..(260): n is a, c, g, or t
  modified_base (514)..(514): a, c, t, g, unknown or other
  misc_feature (514)..(514): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggnacagccacctctcctgcagggccagtaggacgtgtcagtaagtacttaggctggtaccanagaaactggcaggctccaggctcctcatccatgatgcatccaaacgcgggtccctggcctcccagaccgtacggttccgtaggctaggtcgggtacgtggggactaggtacggtttccaccgttctcccgtaaccgtcgaacgtccacgggtccctgggacgtaccgtggaacttggtaacttttcgaccgttacgttttactcgttaggttccaacggtccgtaaggtccgtttcccggacctaccggtcccncgtttaccgaccgggttttccggggaccgggggggtaccctaacgggggttcgaacggttaggtacggtaacggtaaccggtaacggttgggtacggtcgttacggaccgtaccgttacgtccgtttaggttaccgttaccgtacgtttccccg

SEQ ID NO: 111848 - DNA, 567 bp, Homo sapiens
  misc_feature: GYAE6OF02FNWD5.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacgcgggtccctggccgtcccagactacggttccgtggcaggtgggtctggggacagtagttcactctcacgtcagcagctgacgctgatgtatttgctagtttacttcgttgtctagtcgacgtccgttccgccaccgccgtctccgtacggtttccgggccggggggtaccgagggtcgggagtagtacggaaggacggtaacgtggtacgggtcgtcggacgtaccgacgttcgtcggttacgttacgtagttcccg

SEQ ID NO: 111849 - DNA, 544 bp, Homo sapiens
  misc_feature: GYAE6OF02FXMVI.45.36.D03.1.454.CMB.1.raw
  modified_base (202)..(202): a, c, t, g, unknown or other
  misc_feature (202)..(202): n is a, c, g, or t
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
  modified_base (523)..(523): a, c, t, g, unknown or other
  misc_feature (523)..(523): n is a, c, g, or t
  modified_base (537)..(537): a, c, t, g, unknown or other
  misc_feature (537)..(537): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctccaggctcctcatccatgatgcatccaacagggtccctggcctcccagacaggttccgnggcaggtgggtctgggacaggtgttcactctcaccgtnagcagcctggacgcctgatgtattttgctagtttacttcttgtctagcagtccgttccgcctaccgcccgtctccgtaccgtttccggggccgggggtaccaggggtcggagagtggagacgtaacgtggtggccgtgccaccgtnttccgtgtccttcncttcccg

SEQ ID NO: 111850 - DNA, 914 bp, Homo sapiens
  misc_feature: GYAE6OF02IAGNO.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcagggtggtggagtcggggggagcgttgtccagcctgggaggtccctgagactctcctgtgcagcctctggattcctccctcagttaaccttttggtttcccacgttgggtcccgccgtaggtttccagggcgaagggggcctggggaggttgggggtcggccccttcgtaacgttttcccggaaaggtacgttaggggaaacggttgggaaacggtaaacggggtacccctttaacgttaccgaaacgggtacccgttaccccgggttagggaaaccggggggtccccgtaccgtttttaccccgaacccgtaacgtttacccgttaccccggaaacgggtaaaccggtaaacccgttaaaaccgttttaccccgaaaaagggtaaaccgtttacgggttttaccccttttaccgttttttttacggaacccgttaaaaagttaacggttaaaacgttaacggtacccgtttagggtaaacgggttaagggtttacgggtaaacggggttaaccgtaaccgggtttaccgtttacggtttacctttaaacgttttttccgtttacgggttaccgggtaccccgggtaacgggggggtaacccttaacggtttaccgttaaggtttacgggtaacgggtttccggttttacggggttttaccgggtttaaacgggttttaacggttttaaaccgttacccgtttaaaaaccccg

SEQ ID NO: 111851 - DNA, 230 bp, Homo sapiens
  misc_feature: GYAE6OF02F6K3S.45.36.D03.1.454.CMB.1.raw
  modified_base (227)..(230): a, c, t, g, unknown or other
  misc_feature (227)..(230): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnnnn

SEQ ID NO: 111852 - DNA, 605 bp, Homo sapiens
  misc_feature: GYAE6OF02GVCJQ.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccgaggcctcctcatccatgatgcataccaacgcgggtccctgggccgtcccagaccgtacgggttccgtggctaggttcggggtctaggggaactaggtacgttccacgtcctacaacccggtcaggcacgccgtggacgccgtgatgtatttgctagtttacttctgtcagtcacgtccgttccgccgtaccgtccgtcctccgtacggtttccggggccggggggtaccgtaggggtacggacggtacgtaggaacggacggtaacggtggtcggaccgtcggaccgaccgtacgttccgttcgttcgttcgtacttcccg

SEQ ID NO: 111853 - DNA, 533 bp, Homo sapiens
  misc_feature: GYAE6OF02IO1P8.45.36.D03.1.454.CMB.1.raw
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
  modified_base (528)..(528): a, c, t, g, unknown or other
  misc_feature (528)..(528): n is a, c, g, or t
tcagacgcgatcgacacgaccggtgctcgatttagctgcgtcacgatctctcttggggagctctgggagacgagcccagcactggaagtcgccggtgttccttcggtgatcatcactgaacacagaggactcaccatggactttgggctgacctgggttttcctcgttgctcttttaagaggtgtccagtgtcaggtgcaggtggtggagtcgggggagcgttgtccagcctgggagtccctgagactctcctgtgcagcctctggattcctccctcagtaactttggtttccactgggtccgccaggttccaggcaaggggctggagtgggtggccctcgatttccgaagatggaagtgagaaggcctacncagactccgtagaagggccgcttcaccatcctccagagacaattccaagtatcgtccttnttttgcaaatgaatgcctgagagttagagacacgtctgtctagtttctgtcgccgaggggactagtctagtgagtcgttggttcgtaggtgtactntaacc

SEQ ID NO: 111854 - DNA, 565 bp, Homo sapiens
  misc_feature: GYAE6OF02IY2C0.45.36.D03.1.454.CMB.1.raw
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggaccaanagaaacctggccaggcctcccgaggctcctcatccatgatgcatccaacgacgggtccctggccgtcccagaccaggttccgnggctaggtgggtctgggacagcgttcactctcaccgtcacgcacgtccgtggacgcctgtagtgtatttgcttagtttacttctgtcagtcacgtccgttccgccgacgcccgtctccgtacgtttccggggccgggggtaccgagggtaggagacgtggacggtacggaacgtcggtggcgtcgacgaccgtacttccgtcgtcttcgtcgttcccg

SEQ ID NO: 111855 - DNA, 509 bp, Homo sapiens
  misc_feature: GYAE6OF02I4OJL.45.36.D03.1.454.CMB.1.raw
  modified_base (498)..(509): a, c, t, g, unknown or other
  misc_feature (498)..(509): n is a, c, g, or t
tcagacgcgatcgacacgaccggtgctcgatttagctgcgtcacgatctctcctgtgcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctggggcaaagggacctcggtcaccgtctccgcagcttccaccaagggcccatcggtcttcccctggcgccctgctccaggacgcacctctggggcacgagccggccctgggctgcctggtcgaaggacctacttcctcgatccgcgtcgtgaggcgggctgggcaggcgcatacgnnnnnnnnnnnn

SEQ ID NO: 111856 - DNA, 593 bp, Homo sapiens
  misc_feature: GYAE6OF02JGCWO.45.36.D03.1.454.CMB.1.raw
  modified_base (352)..(352): a, c, t, g, unknown or other
  misc_feature (352)..(352): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcagggccagtaggagtgtcagtaagtacttaggctggtaaccaacgagaaaccgtggccaggcctcccgaggctcctcatccatgatgcatccaacgacgggtccctggccgtcccagaccgtaggttccgnggctaggtcgggtctggggacaggacgttcactctacgaccgtcagcacgccgtaggacgcctgagtgtagtttgctagtttacttcgttgtctacgtcgtacgtccgttccgaccgtaccgcccgtctcgtaccgtttcggggaccgggggtaccgtagggtggagtagtacgacggtaccgtaacgtggtcggtcgtacgaccgacgtacgttaccgtcgttaccttacgtacttcccg

SEQ ID NO: 111857 - DNA, 539 bp, Homo sapiens
  misc_feature: GYAE6OF02H3D1R.45.36.D03.1.454.CMB.1.raw
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
  modified_base (532)..(532): a, c, t, g, unknown or other
  misc_feature (532)..(532): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccaggcctcctcactccatgatgcatccaacgngggtccctggccgtaccagactaggttccgnggctaggtgggtctggggacaggngttcactctcaccgtcagcagcctggagccgtgatgtatttgctagtttacttctgtcagctagtccgttccgccacgccgctcgtacgtttccggggcgggggtaccgagggtggagtagtgacgacggtacgtggtggctcgacactagtcgtcgtcttcncttcccg

SEQ ID NO: 111858 - DNA, 546 bp, Homo sapiens
  misc_feature: GYAE6OF02HIZLM.45.36.D03.1.454.CMB.1.raw
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatgacgtctggggcaaagggacctcggtcaccgtctccgcagcttccaccaggcccactcggtccttcccctcggccgccctcgcctccacggacgcacctccgg

SEQ ID NO: 111859 - DNA, 600 bp, Homo sapiens
  misc_feature: GYAE6OF02HNVML.45.36.D03.1.454.CMB.1.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggcctcctcatccatgatgcatccaacnggtccctggcgtcccagaccaggttccgtggcaggtcgggtctggggacaggacgttccacgttcctaccgaccggttcaacgcctagcccgttggacgtccgtgattgtattttgcttagtttacttcttgtcagtcacgtcgtcccgccgaccgtccgtcgtcctacgtttccggggaccgggggtaccgtagggtcgggacgtagtacggaacggaccggtaacgtcgggtcggtccgtcggaccgaccgtacgttccgttcggttccttaccgtacttccccg

SEQ ID NO: 111860 - DNA, 656 bp, Homo sapiens
  misc_feature: GYAE6OF02I45O5.45.36.D03.1.454.CMB.1.raw
  modified_base (262)..(262): a, c, t, g, unknown or other
  misc_feature (262)..(262): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctccccaggcctccgtcatccatgatgcatccaacacgggtccctggccgtcccagactacggttccgtggcaggtggtcngggacnggattcactctccgaccgtcacgcacgccgtaggacgcctacgagtcgtagttttcgacgttagtttaccgttcgttagtccgtacgtacgtacggtccggttcccgtacccgtaccggtacccgtccgtcccgttaccggttttaccggggccgggggggttaacccgtacggggttacgggtaacgtacggtacgggtaacggtaaccggtaacggttacggtcgggtacccgtacggtaccgaaccgttacgttccggttacgtaccgtttaccgtaccgttaccccgg

SEQ ID NO: 111861 - DNA, 727 bp, Homo sapiens
  misc_feature: GYAE6OF02HJWTG.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagactaccaccggaaaaattgtagttgacacagtctccaggcaccctgtctctgtctccagggganacagccacctctcctgcagggccagtagagtgtcagtaagtacttaggctggtaccaacgagaaacctggcaggctcccaggctcctcatccatcgatgcatccaactacggtccctggccgtaccccgagaccgtaacgggtttccggtcggaccgtaaggttcgggggtccttacggggggaacctagggtaacgttttcccgaaccgttccgtaccgtaacccggtaccgaaggtcccaaacggtcccggtacggtaacgggtccccgttaggtaacgttggttaacgtttttcggtacgttacggtttttaaccgttcgtttacggttaccgttaacgtccgttaacggtccggtttccgaccccgtacgccccggtaccttcccgtaccgtttaccggggacccggggggttaccacggggggttacgacgggtaacgtcggacggacggtaacgtcggttacggtcgtcgtaccggaccttcggtacgttccgtcgtttaccacgttcccttcccgg

SEQ ID NO: 111862 - DNA, 657 bp, Homo sapiens
  misc_feature: GYAE6OF02ICGS7.45.36.D03.1.454.CMB.1.raw
  modified_base (265)..(265): a, c, t, g, unknown or other
  misc_feature (265)..(265): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaanacgaaacctggccaggcctcccgaggcctcctcatccatgatgcactccaacgacgggtcccctgggcccgtacccaggaccgtacgggtttcccgtgggcctagggtggggtccgtggggacaggtacgttcactcctcgacccgtcagccgacgccgtgggacgtccgtagattagtacttttgacttagttttacttcgtgttcagtcctcgtccgtcccgccgtaccgcccggtccttccgtaccggttttccgggggccggggggtaccgtaggggtacgggtaacgtacgttagggaacggtaaccgggtaacgttcgggtacgggtccgttacggccgtaaccgtacgttacccgttcggtttccctttccgtaccgtttccccg

SEQ ID NO: 111863 - DNA, 801 bp, Homo sapiens
  misc_feature: GYAE6OF02INRPN.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggcctcccgaggcctcctcactccagtgatcgctaactcccgaaccgtacgggtccccttgggaccttaccccgaaggaccgtacgggttcccggtaggaccgtaagggttcggggtccgtacgggggaactaacgggtacgtttccaaccgttccgttacccgaacccggttcgaacggccgaaccggtccgttcgggaacgtccccgttaggtacgttacggttaacgttttcggtaccgtttaacgttttaaccgtttccgtacggttaccgtacggtaccgtaacggttcccggtttaccccggtacccgtaacccggttccccggtccgttacccggttaacccgggtttttcccggggggaccgggggggtaaaccccgtaggggggtaccgggtaacgttacggtaccgggtaaacgggtacccggtaaacgggttcgggttacgggtaccgtaccggtacccgtaacccgtacggtttacccggttcgtttacccgttaccgtacgtttacccccgg

SEQ ID NO: 111864 - DNA, 532 bp, Homo sapiens
  misc_feature: GYAE6OF02I102H.45.36.D03.1.454.CMB.1.raw
  modified_base (509)..(509): a, c, t, g, unknown or other
  misc_feature (509)..(509): n is a, c, g, or t
  modified_base (526)..(526): a, c, t, g, unknown or other
  misc_feature (526)..(526): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacgagggtccctggccgtcccagacaggttccgtggcagtgggtctggggacaggtagttcactctcaccgtcagcagccgtggacgccgtgatgtattttgctagtttacttcttgtcagtcagtccgttccgcctaccgcccgctccgtacgtttccgggccggggtaccgacgggtggagagtgaggacgaacgtggnggctgcacatctgtctnactccg

SEQ ID NO: 111865 - DNA, 576 bp, Homo sapiens
  misc_feature: GYAE6OF02I43VA.45.36.D03.1.454.CMB.1.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatcccaacgacggggtcccctgggccgtccccaaggaccgtacgggttcccgngggccagggtcggggtacctgggggaccaggtaacctttcactcctacaactaaatccaagccacgccctacccaacctagaacgtattttcgactagtactattacttgtacaactagcgtacagtattcggccgctctacgtttcggcgggtacgggaccgaaggtggagagtacgaacgtaacgtagtcggctgactaccattcctcgtcttcatcc

SEQ ID NO: 111866 - DNA, 649 bp, Homo sapiens
  misc_feature: GYAE6OF02J2SLX.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtagtacttaggctggtaccaacagaaacctggccaggcctcccgaggcctcctcactccatgatcgcatccaacgacgggtcccctgggccgtcccaggaccgtacgggttcccgtaggcctagggtcggggtcgtaggggacaggtacgttcacgtccgtcgacccgtcacgcacgccgtggacgccgtagagtgtactttgacttacgtttacttcgttcgtcacgtcgacgtccgttccgcgtaccgtcccgtccgttcccgtaccgggtttccggggacccggggggtaacccgtacgggggtacggtagggtacggttacgggaacggtaaccggtaacggttacggtcgggtccgttccggaccgtaccgtacgttccgttcggtacctttccacgtttccccg

SEQ ID NO: 111867 - DNA, 751 bp, Homo sapiens
  misc_feature: GYAE6OF02JSDYF.45.36.D03.1.454.CMB.1.raw
  modified_base (202)..(202): a, c, t, g, unknown or other
  misc_feature (202)..(202): n is a, c, g, or t
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
tcagacgcgatcgacacgaccggtgctcgatttagctgcgtcacgatctctcttgggggaggaactgctcagttaggacccagagggaaccatggaagcccagctcagcttctcttcctcctgctactctggctcccagataccaccggaaaaattgtgttgacacagtctccaggcaccctgtctctgtctccgagggganacagccacctctcctgcagggccagtaggagtgtcagtaacgtacttaggctggtaccaacagaaacctggccaggcctcccgaggcctcctcatcccaagtcgaactcgacatccaaacgtcggggtcccngggccgtcccagtacacgggttccngggacctagggtcggggtactcggggaactaggtacgtttaccacgttccgtacgacccggttacgaggaccctaacggtcccgttagggtaccggtacccgttacgggtacgttacggttaacgtttttacggaccgtttaacggttttaacctttccgttacggttaccgtacggtaccgtaacggtccggtttaccccgtaccggtaacccgtccccggtacgttacccgttaccgggtttaccggggtaccggggggtaacccggtagggggtaccggtacggtacggtacgggtaacggtaaccggtaaccggttaggtaccgggtacgttccggtacccgtaccgtacggttccgttacggttccgttaccgtaccgtttccccgg

SEQ ID NO: 111868 - DNA, 743 bp, Homo sapiens
  misc_feature: GYAE6OF02JPTRF.45.36.D03.1.454.CMB.1.raw
  modified_base (216)..(216): a, c, t, g, unknown or other
  misc_feature (216)..(216): n is a, c, g, or t
tcagacgcgatcgacacgaccggtgctcgatttagctgcgtcacgatctctcttgggggaggaactgctcagttaggacccagagggaaccagtggaagcccagctcagcttctcttcctcctgctactctggctcccagactaccacggaaaattcgtagttgacacagtctccaggccacctgtctctgtctccgagggacgacagcccacctntcctgcagggtccagtaggacgttcgacagttaagtaccttaggcttcggtaaccaacaaggaaacctggccctaaggcctaccgaggtcctacgtcaatcccaagtgactcggacctagtaccgaacgacggggttcccctagggccccttaccgacgggtaaacctcgggggttttacccgcggtaccgaacggggtttccgggtcgttccgggggaaacctttaagggaacggttttccctaacggtcctaacccggtacccggttacgacgggtaacacggtaccgtacggtacggtacgtacggtacgtacgtacgttacgttacgtacgttacgttacgttcgttacgtacgtacgtacgtacgtaccgtaccgtaccgtaccgtaccgtaccgtaccgttaccggttccgggtaccgggtacgggtacgggtacggtacggtacgtacggtacggtaacggtacgtacgggggggtactacggtacgtacgtacgtaccgtacgtcgttacgtacgtccg

SEQ ID NO: 111869 - DNA, 578 bp, Homo sapiens
  misc_feature: GYAE6OF02FF3BL.45.36.D03.1.454.CMB.1.raw
tcagacgcgatcgacacgaccggtgctcgatttagctgcgtcacgagtcgtctccttggggaggaactgctcgagttaggacccagagggaaccatggaagccccagctcgagcttctcttcctcctgctactctggactcccagataccaccggaaaaattgtgttgacacagtctccaggcaccctgtctctgtctccagggacacagccacctctcctgcagggccagtaggatgtcagtaagtacttaggctggtaccaacagaaacctggccaggtctcccaggctcctcatcccatgagtcgacactcccgaacgtacgggtcccctggccgtaccccagacctacggttcccgtcggctacggtcgggtcctggggaccaggtacgttccacgtcgtccacccgtcacggcacgccgtaggacgccgtgtacgttgtacgttttcgacgtacgtttacgttcttcgtcacgtcgtagtccgttccgccgacgccgtctcgtacgttcgggccggggactagggtgagtagtgagacgtaacgtgtcggctgcacactcgtgtcttcatccg

SEQ ID NO: 111870 - DNA, 526 bp, Homo sapiens
  misc_feature: GYAE6OF02IU9CB.45.36.D03.1.454.CMB.1.raw
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (382)..(382): a, c, t, g, unknown or other
  misc_feature (382)..(382): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacgagaaacctggccaggctccccgaggctcctnatccatgatgcatccaancgggtccctggccgtcccagaccnggttccgnggcaggtgggtctggggacagagttcactctcaccgtnagcagccgtggacgcctgatgtatttgctagtttacttcttgtcagtcagtcgttccgcacgccgctctacgttcgggcggggtaccgagggtgagagtgagacgaacgtgtaggcctgccacgtatcgtcgtcttcattcccg

SEQ ID NO: 111871 - DNA, 646 bp, Homo sapiens
  misc_feature: GYAE6OF02IVOD6.45.36.D03.1.454.CMB.1.raw
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
  modified_base (383)..(383): a, c, t, g, unknown or other
  misc_feature (383)..(383): n is a, c, g, or t
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggactttgggctgacctgggttttcctcgttgctcttttaagaggtgtccagtgtcaggtgcaggtggtggaggtcggggggaggcgttgtccaggcctggggaggtccctgagactctcctgtgcngcctctggattctcctnagtacttggttccacttgggtccncgtaggttccaggcaaggggctggggagttggggtacggcccttnagtttccgaagctaggatggagacggcctacncaggactccggtagaacggggccctcttccgaacctacgtcctaccaggtaacgaacgtaacttaccgaaacgaacttacgtaccttcgttttacgtactaaagtacgtaactaacgccgttaggagtaacgttaggtaacggtacgtaacgttcgtacgtcttaagtttcgtggtacgtaccggtacggggactacgttacgttaagttacggtacggttcgttacggttaggttacggtttaacgtaagttacctaaaccg

SEQ ID NO: 111872 - DNA, 745 bp, Homo sapiens
  misc_feature: GYAE6OF02IALK5.45.36.D03.1.454.CMB.1.raw
  modified_base (225)..(225): a, c, t, g, unknown or other
  misc_feature (225)..(225): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagactaccaccggaaaaattcgtgttgacacagtctccaggccaccctgtcctctgtctccgaggggagaccagcccaccctctccngcagggccaggttaggagtgtcgagtaagtacttaggcttaggtaaccaacgagaaacctggacaggtcnccccgaggctcccgnactcccagtagactcgcctaagacccaaacgtcggggtccctacgggtccgtaccccaaggacccgtaagggtttccccggagggaccacggtttcggggttcctaccgggggaatacggtacggtttcccaacggtttccccgcgtaacccgggtcaacggccctaaggtccccgtcggaccggtcccgtaggtacgttcggtacgttttcggaccgtttaagtttaaccggttacgttcggttacgacgtcgtaaccggtcgttcccggaccgttaccgcccggtaccgtccgtaccggttttccggggacccggggtaaccggttacggggcggtaacggacggttacggacggtacccggtaaggtcggtacggcggttcggaccgtaccgtacgtaccgtacgttaccgttctaccgttcccgttacccg

SEQ ID NO: 111873 - DNA, 705 bp, Homo sapiens
  misc_feature: GYAE6OF02IPXIB.45.36.D03.1.454.CMB.1.raw
  modified_base (265)..(265): a, c, t, g, unknown or other
  misc_feature (265)..(265): n is a, c, g, or t
  modified_base (355)..(355): a, c, t, g, unknown or other
  misc_feature (355)..(355): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccaccctctcctgcagggccagtaggagtgtcagtaagtacttaggctggtaaccaanagaaacctggaccaggcctcccaggctcctcactccatgatgcactccaacgtcgggtccctggccgtcccaagaccgtacggtttccgnggcaggtcgggtctacggggactaggtacgtttccacttcctaccgaacccgtcgaacggtccaggtcccgtagggacgcccgttggtacgttacgttactttttcggacttacggttttacctttcgttcgtacgtacgtaccgtacgttcccggtttcccgacccgtaaccggtcccgttaccgttacccgtaccggtttccgggggacccggggggtaacccgtacgggggtacggaacggtacggtacggaacgggtaacccggtaacgttcgggtacgggtccgtacggtacccgtaacccgtacgttccggttacggttaccctttacctaccgtttcccccgg

SEQ ID NO: 111874 - DNA, 562 bp, Homo sapiens
  misc_feature: GYAE6OF02HSL7W.45.36.D03.1.454.CMB.1.raw
  modified_base (347)..(347): a, c, t, g, unknown or other
  misc_feature (347)..(347): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggcctcccgaggcctcctcatccatgatgcatccaacgcgggtccctggccgtcccagaccaggttccgnggctaggtgggtctgggacagacgttcactctcacgtcagcacgctggacgctgatgtatttgcttagtttacttctgtcagtctagtccgtccgccaccgccgtcctccgtaccgttccgggccgggggtaccgtagggtggacgagtaggacggacggtaacgtggtcggccgtcgaccgtaccgtacgtccgtcgttcttccgtacttcccg

SEQ ID NO: 111875 - DNA, 649 bp, Homo sapiens
  misc_feature: GYAE6OF02GEECU.45.36.D03.1.454.CMB.1.raw
  modified_base (354)..(354): a, c, t, g, unknown or other
  misc_feature (354)..(354): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctggtaccaacagaaacctggccaggcctcccaggctcctcatccatgatgcactccaacgtacgggtccctgggccctacccgagtaccgacggtttccgnggactagggtcgggtcgtagggacaggtacgttcactctccgaccgtcacgcgacgccgtaggacgtccgtagtagtgtatttcgacttagtttacttcgttagtcagtccgtagtcccgttccgaccgtaccgtacccgtccgttaccgtacccggttttccgggggaccggggggtaccgtaggggtacggaggtacggtaggaacggtaaccggaacggttggtacgggtaccgttcggaccgtaacccgttaggttccgttacggtttacctttaccgtactttcccccgg

SEQ ID NO: 111876 - DNA, 523 bp, Homo sapiens
  misc_feature: GYAE6OF02GOILY.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcacgggccacgtggcatccctagccaggttcaggtggcggtgggtttggcacagacttcactctcacatcagcagcctaccaaccgtgaagtatttgactagtcttaattactgtacaacagtcgtacagtagttgccgtctacgacgtttcggcggtacgggtaccgaaggtaggagagtacgaacggtaacgtggtaggctcggccacgtacg

SEQ ID NO: 111877 - DNA, 568 bp, Homo sapiens
  misc_feature: GYAE6OF02I99HV.45.36.D03.1.454.CMB.1.raw
  modified_base (202)..(202): a, c, t, g, unknown or other
  misc_feature (202)..(202): n is a, c, g, or t
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
  modified_base (403)..(403): a, c, t, g, unknown or other
  misc_feature (403)..(403): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggcctcctcatccatgatgcatccaagcgggtccctggcctcccagaccgaggttccgnggcaggtgggtctggggacaggagttcactctcaccgtnagcagcctggacgctgatgtntttgctagtttacttcttgtcagcagtcgtccgccgaccgccgctccgtaccgtttccggggccgggggtaccgacggggtaggacgtacgtacgaaacggtaacgtggtacggtcgtacgaccgtaccgtacgttcgtcgttcctttactacttccgttccccg

SEQ ID NO: 111878 - DNA, 183 bp, Homo sapiens
  misc_feature: GYAE6OF02GC1I5.45.36.D03.1.454.CMB.1.raw
  modified_base (182)..(183): a, c, t, g, unknown or other
  misc_feature (182)..(183): n is a, c, g, or t
tcagacgcgatcgacacgaccggtgctcgatttagctgcgtcacgatctctcttgggttttgggggaagaggaagactgacggtcctcccaggagttcaggtgctgggcacagcggccctgggctgcctggtcaaggactacttcctcgatcgcgtctgagcgggctggcaaggcgcatagnn

SEQ ID NO: 111879 - DNA, 552 bp, Homo sapiens
  misc_feature: GYAE6OF02IHRS3.45.36.D03.1.454.CMB.1.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccagggganacagccaccctctcctgcagggccagtaggagtgtcagtaagtacttaggctggtaaccaacagaaacctggccaggctcccaggctcatcatccatgatgcatccaacncgggtccctggccgtccagacaggttccgnggcaggtgggtctggacagagttcactctcaccgtcacgcgacgccgtggacgccgtgtagtgtatttgtctagttttcttcgttgtcagcagtccgtccgccacgccgtcctcgtcgttccgggccgggggtaccgaggggtcggagtagtggacgacggtaacgtggtcggcgtcgccgacctagtccgtcgtccttcgtacttcccg

SEQ ID NO: 111880 - DNA, 519 bp, Homo sapiens
  misc_feature: GYAE6OF02HMOLI.45.36.D03.1.454.CMB.1.raw
  modified_base (202)..(202): a, c, t, g, unknown or other
  misc_feature (202)..(202): n is a, c, g, or t
  modified_base (348)..(348): a, c, t, g, unknown or other
  misc_feature (348)..(348): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (504)..(504): a, c, t, g, unknown or other
  misc_feature (504)..(504): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggctcctcatccatgatgcatccaacgacgggtccctggccgtacccaggaccagggttccgnggccaggtcgggtctggggacaggtacgttcactctcgaccgtcagcagctggagctgatgtatttgctagtttacttctgtcagcagcgttccgcacgccnctcncgttcggcggggaccgagggtgagagtgagacgaacgtgtggcgtgcacntctgtcttctatccg

SEQ ID NO: 111881 - DNA, 896 bp, Homo sapiens
  misc_feature: GYAE6OF02JONPH.45.36.D03.1.454.CMB.1.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
tcagacgcgatcgacacgaccggtgctcgatttagctgcgtcacgatctctcttggggaggaactgctcagttaggacccagagggaaccatggaagcccagctcagcttctcttcctcctgctactctggctcccagataccaccggaaaaattgtgttgacacagtctcaggcaccctgtctctgtctccaggganacagcccacccgtctccgtgccacgggccagtaggngtcgtacgagtaagtccttaaggcctggtaaccaacgtagaaaccgtggaccagggtacctaccgaggtcctccgcctaatacccagtcggaatcgactactcccgaaacgacgggttccctagggtcccgtacccaggtaaccgtaccgggttccggtacgggtaccgaacgggttcggggttcttacgggggaacgtacgggtaaccggttttaccgaacgttcccgttaccgtaaacccggggttccaacgggtacccgtacgggtccccgtaacggggtacgtccccggtaggttaacccgttagtaacgtttttaccgggtaccgttaagggttttttacccctttacggttacggtttaaccccgtaagggtacccgtaacggtttcccggtttaaccccgggtaacccgtaaccccggggttccccgtaaccgtttaccccggttaaacgtttttcccgggggggggaaccccgggggtttaaacccgggaaccgggggtttaccgggggaacgttaaccggttacgggtaaccgggtaaaccccgggttaaacggttcgggttcgggtaaaccccggtttccgggaaccttacccgggttaacggtccccggttttaagggtttccccggttaccgttacggttttacccccgg

SEQ ID NO: 111882 - DNA, 619 bp, Homo sapiens
  misc_feature: GYAE6OF02JJJMT.45.36.D03.1.454.CMB.1.raw
  modified_base (203)..(203): a, c, t, g, unknown or other
  misc_feature (203)..(203): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtacggagtgtcagtaagtactaggctggtaaccaacagaaacctggaccaggctcccgaggcctcctcactccatgatgctactccaacacgggtccctgggcctcccgaagtactagggttccgtgcaggtcgggtcngggaacngtagttccactctaccgaccgtgacgtcacggtccgtcgggcctgacgtgtagtttcgtacgttacgtttacgttgttcgtctacgtactacgtcgttccgccgaccgtccgtctccgtaccgttcggggaccgggggtaccgtacgggtcggtaggagtcgtacggtacggtaacggtcggtacggcgtcgaccgtaccgtaacgttccgttcggttactccgttacgttcccgttaccccg

SEQ ID NO: 111883 - DNA, 595 bp, Homo sapiens
  misc_feature: GYAE6OF02I10D0.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggttttcctcgttgcttcttttaagaggtgtccagtgtcaggtgcagggtggtggaggtcggggggaggcgttgtccagccgtggggacggtccctgagactctcctgtgcagccctctggattcctccctcagttaacttttggtttcccacgttcgggtcccgccgaggttcccagggcgaaggggctgggagtggggtcggccctgacgtttccgaagagtaggaagtgaaggaacggcctactcgagacgtaccgtgaacgggccgtcttcaccatcctccagagacaattaccaaagtatcgtccttcgttttagactaatgtaatacgacctagagtaggttgaggtactacgtcttgtcttatttctagtcgaccggtacgggaactactacgtagtagtagtcgttggttcgtagtagttatactaacc

SEQ ID NO: 111884 - DNA, 618 bp, Homo sapiens
  misc_feature: GYAE6OF02G3BO5.45.36.D03.1.454.CMB.1.raw
  modified_base (588)..(588): a, c, t, g, unknown or other
  misc_feature (588)..(588): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccacctctcctgcagggccagtaggagtgtacagtaagtacttaggctaggtaccaacgagaaacctggccaggctcccaggctcctcactccagtgactgcatccaacgtcgggtccctggccgtacccaggactggttcccgtgcaggtggtcgtagggacagtacgtcactctacgaccgtagacgcgacgtccgtggaccgtcgtgtactgttactttcgacgttaagtttaccttcgtagttcgaacgtcgtaacgtccggtttcccgaccgtaccggcccgtaccttccgttaccgggttcccggggaccgggggtaccgtagggggtacggagtacgtagggaacggtaacggaacgtcggtacggngttacgacgtaccgtatcgttcgtcttacg

SEQ ID NO: 111885 - DNA, 502 bp, Homo sapiens
  misc_feature: GYAE6OF02FPUFP.45.36.D03.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (499)..(499): a, c, t, g, unknown or other
  misc_feature (499)..(499): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacgggagaaatagtgatgacgcagtctccagccaccctgtctgtgtctccaggggaaangtcaccctctcctgcagggccagccagagtgtcagcagcgacttagcctggtaccagcagaaacctggccaggctcccaggctcctcatctatggtncttccncagggccatggtactcccagtcaggttcagtggcaggtgggtctggggacngtcgtttacnctcaccatcaacngcctccagtctagaagtattttgcttagtttattactgtcactagtataatagtgcctcgtgacgttcgacaagggacaggtagaatcgaaacgactgtggctgcaccatctgtcctntac

SEQ ID NO: 111886 - DNA, 561 bp, Homo sapiens
  misc_feature: GYAE6OF02GRKQY.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacacgggtccctggcctcccagacaggttccgtggcaggtgggtctgggacagagttcactctcaccgtcaacagcctggacgcctgatgtatttgctagtttacttctgtcagtcagtcgttccgccacgccgtcctcgtacgtttccgggccgggggtaccgtacggggtcggagtacgtaggacgacggtaacgtggtacggcgtcggacctaccgagttccgttcgttccttctacgttcccttccccg

SEQ ID NO: 111887 - DNA, 707 bp, Homo sapiens
  misc_feature: GYAE6OF02J1YIX.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttggggaggaactgctcagttaggacccagagggaaccatggaagccccagctcagctctcttcctcctgctactctggctcccagataccaccggaaaaattgtagttgacacagtctccaggccaccctgtctctgtctccgagggganacagccaccctctcctgccagggccaggtacggagtcgtcaagtaacgtacttaggctaggtaccaacagaaacctggaccaggcctcccgaggcctccgcatccatgatcgcaatccaacgcgggtaccctgggacctccgacgactacgggtcccgtggaccgtggttcggggtctggggaactaggtaacggtttcaacgtccgtacgacccgttcagtccacggtccgtaggacgtccgttagtacgtagttacgtttcgtacggttacgttttacgttccgttggtacctaacggtccgtacgtccggtttacccgaccgtacccggtacccgttacgttacccgtaaccggttttcccgggggaccggggggtaaccggtacggggtacggtacggtacggtacggtaacggaaccggtaaccggttccgggtagtacccggtttcggaccgtacccgtaacggtttcccgtggtttaccgttccgtaacttccccgg

SEQ ID NO: 111888 - DNA, 646 bp, Homo sapiens
  misc_feature: GYAE6OF02HVFVD.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccgagggganacagccaccctctcctgcagggccagtaggagtgtcagtaagtacttaggctggtaccaacagaaacctggccaggctccaggcctcctcatccatgatgcatccaacgacgggtcccctgggcctcccagaccgtacgggttccgtggactaggtcggggtctggggacctaggtacgtttccacttccgtacgacccgtcacggccacggtccgtaggacgtccgtaggattcggttattttgacttacgttttacttcttgttacagtacgtacgtccgttccgacccgtaccgcccgtaccgttccgtaccggtttcggggccggggggtaccgtaggggtacggaaggtagtaggacggtaacggtaacggtcggttcggacgtcggaccgaaccgtacgttccgttacgttccgtttacctacgttcccgttccccg

SEQ ID NO: 111889 - DNA, 595 bp, Homo sapiens
  misc_feature: GYAE6OF02HJ6CL.45.36.D03.1.454.CMB.1.raw
  modified_base (202)..(202): a, c, t, g, unknown or other
  misc_feature (202)..(202): n is a, c, g, or t
  modified_base (319)..(319): a, c, t, g, unknown or other
  misc_feature (319)..(319): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaaccaacagaaacctggaccaggcctacccgaggcctcctcactccatgatcgcatccaacncgggtccctggccgtccagacgtaggtcctggctagtcgggtctgggacagtacgttcacgtctcgacgtcacgctacgccgtggacgtcctgatgtactttgactagtttactctgtcgagtcagccttccgccaccggacctcccgtcgtaaccggttttccgggaccgggggtacccgagggttacggacggtagtacggtaacggacggtaacggtcggtacgggcgtacggaccgacctacggtcgttacgttccgttactacttccccgg

SEQ ID NO: 111890 - DNA, 601 bp, Homo sapiens
  misc_feature: GYAE6OF02GCAHQ.45.36.D03.1.454.CMB.1.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccgaggctcctcactccatgatgcatccaacncgggtccctggcctcccagacaggttccgnggctagtgggtctgggacagtcgttcactcgtcaccgtcacgcacgcctaggacgccgtagatgtattttgacttagtttacttcttgtctagctagtccgttccgaccgacgcccgtctaccgtaccggtttccggggaccggggggtaccctagggggtacggacgtaggtcggaacggtaaccggtaacgtcggtacgggtcgttacggtaccaccgtacgttccgttggttaccctttacctacgtttccccg

SEQ ID NO: 111891 - DNA, 556 bp, Homo sapiens
  misc_feature: GYAE6OF02GIKTJ.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctggtaccaacagaaacctggccaggctcccaggctcctcatccatgatgcatccaacagggtccctggccgtcccagacagggttccgtggcaggtgggtctgggacaggacgttcactctcgaccgtcagcagcctggacgctgatgtattttgctagtttacttcgttgtcagcagtccgttccgcctacgccgtcctcgtaccgtttcgggccgggggaccgtaggggtcggagtagtggacgacggtaacgtggtggttcgaccaccgtatccgttgttcctttcgacttccgttcccg

SEQ ID NO: 111892 - DNA, 574 bp, Homo sapiens
  misc_feature: GYAE6OF02FG7G7.45.36.D03.1.454.CMB.1.raw
  modified_base (265)..(265): a, c, t, g, unknown or other
  misc_feature (265)..(265): n is a, c, g, or t
  modified_base (351)..(351): a, c, t, g, unknown or other
  misc_feature (351)..(351): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaanagaaacctggccaggcctcccaggcctcctcatccatgatgcatccaacgacgggtccctggccgtcccagaccgtacggttccgnggcaggtcgggtctgggacagcgttcactctcaccgtcagcacgcgtggacgcctgattgtattttcgctagtttacttcttgtctagcgtcgtccgttccgccgtccgccgtcctcgtaccggtttcgggccggggtacctaggggtcggagtacgtggacgacggtaacgtggtcggtcgtcgaccgtaccgtcgttccgttgttccttcgtacgttcccg

SEQ ID NO: 111893 - DNA, 491 bp, Homo sapiens
  misc_feature: GYAE6OF02JC9KY.45.36.D03.1.454.CMB.1.raw
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (480)..(491): a, c, t, g, unknown or other
  misc_feature (480)..(491): n is a, c, g, or t
tcagacgcgatcgacacgaccggtgctcgatttagctgcgtcacgatctctcctgtgcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctggggcaaagggcctcggtcaccgtctccgcagcttcaccaaggccatcgtctcccctggcnccctgctcaggancacctctggggcacagcggccctgggctgcctggtcaaggctacttcctcgatcgcgtctgagcggctggcaggcgcgatagnnnnnnnnnnnn

SEQ ID NO: 111894 - DNA, 787 bp, Homo sapiens
  misc_feature: GYAE6OF02JSTBX.45.36.D03.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (783)..(783): a, c, t, g, unknown or other
  misc_feature (783)..(783): n is a, c, g, or t
tcagacgcgatcgacacgaccggtgctcgatttagctgcgtcacgatctctcctgtgcagtaactttggtttccactggtccgccaggttccaggcaagggctggaggtgggtggccctcatttccgaagatgggagtgagaaggcctactcagactccgtgaaggccgcttcaccatctccagagacaattccaagaatctcctnttttncaaatgaatagcctgtagagttgaacggacacgtctgtaccttattttcctgtcgtccgtagggggactacgtctagtggtacgttcgttgggttcgttacggtgttaacgttctaaacgtacttaactaacctcgtaattacggacggttaccgtgggggtaccctaaaagggggtacccttaccggggtaccgtaaacccggttccgtaccccggtacgtaaaccgtccctttaccccgaacccggtaaccggggtacccctaacgttccggggttaaccctttcccccccggtagggtccccgtccccgtcgtaccgtcccgtaacggtacgtacccgtaaccggtccgtccggggtaccgtaccgaacggtccccggaccggttccgggaccgttccggtccgttaccgggtccgtaacggggaacccttacccggttacccgtaccgtaccggtaccggtaccgttccggttacggtacccgggtcgggaccggtcgggtaaccgtacgggaccgtaccgggtaccggttaagtccggacgtcgacgtccgagtcgacgtcgacgtnacgg

SEQ ID NO: 111895 - DNA, 592 bp, Homo sapiens
  misc_feature: GYAE6OF02HELWV.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccccaggcctcctcatccatgatgcatccaacgacgggtccctggccgtcccagacctagggttccgtggccaggtcgggtctggggacagtacgttcactctcaccgtcagcacgcctggacgcctgatgtatttcgctagtttacttcttgtcagcagtccgttccgccgaccgcccgtctccgtaccggtttccggggccggggggtaccgtaggggtcggacggtacgtagggaacggtacggtaacgttgggtacgggcgttcggaccgaccgtacgttccgttcggtttccttccgtacttccccg

SEQ ID NO: 111896 - DNA, 507 bp, Homo sapiens
  misc_feature: GYAE6OF02JA6K5.45.36.D03.1.454.CMB.1.raw
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
  modified_base (421)..(421): a, c, t, g, unknown or other
  misc_feature (421)..(421): n is a, c, g, or t
tcagacgcgatcgacacgaccggtgctcgatttagctgcgtcacgatctctcttgggggaggaactgctcagttaggacccagacggaaccatggaagccccagcgcagcttctcttcctcctgctactctggctcccagaaaccattggagaaatactgatgacgcagtttccagccaccctgtctgtgtctccaggggaanagccaccctctcctgcctgggccagtcagagtgttacgcaaccacttagcctggtaccagcagaaacctggccaggcctccagctcctcatttatggttctctaccgagggccnctggtactcccagccaggttcagtgccaggtgggtctgggacagagttcactctcaccatcagcagcctgcagtctgtagtatttgcgtagtttatttctgtcngctagtatcatactgctgtatagtttggccgagggacagcgtaggtaactacgaaacacgtaggtcgctgaccacgtatctgtctc

SEQ ID NO: 111897 - DNA, 605 bp, Homo sapiens
  misc_feature: GYAE6OF02G03AA.45.36.D03.1.454.CMB.1.raw
  modified_base (341)..(341): a, c, t, g, unknown or other
  misc_feature (341)..(341): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctctcatccatgatgcactccaacgacgggtccctggcctccagactaggttccgnggcagggtgggtctgggacagtacgttcactctcgaccgtcagcacgcgtggacgtccgtagagtcgtattttcgcttagtttaccttcgttcgtctagctacgtccgttccgccacgcccgtcgtccgtacggtttccggggaccggggggtaccgtaggggtacggaggtagtacggacgtaaccggtaacgtcgggttacggtacgtcggtaccgtaaccggttacttccgttcggttacctttaccgtacctttccccgg

SEQ ID NO: 111898 - DNA, 292 bp, Homo sapiens
  misc_feature: GYAE6OF02H6L0W.45.36.D03.1.454.CMB.1.raw
  modified_base (264)..(292): a, c, t, g, unknown or other
  misc_feature (264)..(292): n is a, c, g, or t
tcagacgcgatcgacacgaccggtgctcgatttagctgcgtcacgattcgtctcttgggttttggggggaagaggaagactgacggtcctcccaggagttcaggtgctgggcaccttgggcacggggaggtgtgtcacaagatttgggctctgggcaccggtgggcatggggggtagtgtgtcactaagatttgggccctgggctgcctggtcaaggactacttccgtcgatcgcgtctgagcgggctggcgaaggcgcatagnnnnnnnnnnnnnnnnnnnnnnnnnnnnn

SEQ ID NO: 111899 - DNA, 584 bp, Homo sapiens
  misc_feature: GYAE6OF02FLXVI.45.36.D03.1.454.CMB.1.raw
  modified_base (263)..(263): a, c, t, g, unknown or other
  misc_feature (263)..(263): n is a, c, g, or t
  modified_base (340)..(340): a, c, t, g, unknown or other
  misc_feature (340)..(340): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatgatgcatccaacagggtccctggcctcccagacaggttccgnggcaggtgggtctgggacagagttcactctcaccgtcagcagcctggacgctgattgtagttttcgctagtttacttcttgtcagccagtccgttccgccgaccggccgtcctccgtaccggtttccggggccggggggtaccgtaggggtcggtaggacgttacggaacggaaccggtaacgtcggtacgggtcgtacggaccgtaccgtacgttccgttcggttccttaccgtacttccccg

SEQ ID NO: 111900 - DNA, 610 bp, Homo sapiens
  misc_feature: GYAE6OF02FKHBA.45.36.D03.1.454.CMB.1.raw
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccgaggcctcctcactccatgatgcatccaacgacgggtccctgggccgtccccaggacctagggttcccgtgggccgaggttcgggggtcctgggggaactaggtacgtttcaacttctccacccggtcaggccagccgtggacgccgtgattgtattttgcgtagtttacttcttgtcagtcagtccgttccgccacgcccgtctccgtaccgtttcggggaccggggggtaccgtaggggtacgaggacgtaggacggacggtaacggtggtacggtcgtcggaccgtaccgtacgttccgttcgtccgttactacgttcccg

SEQ ID NO: 111901 - DNA, 221 bp, Homo sapiens
  misc_feature: GYAE6OF02H695L.45.36.D03.1.454.CMB.1.raw
  modified_base (218)..(221): a, c, t, g, unknown or other
  misc_feature (218)..(221): n is a, c, g, or t
tcagacgcgatcgacacgaccggtgctcgatttagctgcgtcacgatctctcttggggggaggaactgctcagttaggaccagagggaaccatggaagccccagctcagcttctcctcctcctgctactctggctcccaggactgtggctgcaccatctgtcttcatcttcccgccatctgatcgatcgcgtctgagcgggctggcaaggcgcatagnnnn

SEQ ID NO: 111902 - DNA, 586 bp, Homo sapiens
  misc_feature: GYAE6OF02HRCM7.45.36.D03.1.454.CMB.1.raw
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccaggtaggagtgtcagtaagtacttaggctggtaccaanagaaacctggccaggctcccaggcctcctnactccatgatgcataccaacgcgggtccctggccgtacccgagaccgtaggttccgngggcaggtggggtctggggacaggtagttccaacttcctacgaccgtcagccagcgtggacgccgtgatgtatttcgcttagtttactcgttgtcagtcagtccgtccgcaccgtccgctcgtccggtttcggggaccggggaccgagggtggagtgtaggacgtaaccggtacgtcggtcgggccttcggaccctaccgtagtccgttcggttacctttcgaccgttccccg

SEQ ID NO: 111903 - DNA, 549 bp, Homo sapiens
  misc_feature: GYAE6OF02HK1GP.45.36.D03.1.454.CMB.1.raw
  modified_base (313)..(313): a, c, t, g, unknown or other
  misc_feature (313)..(313): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
  modified_base (502)..(502): a, c, t, g, unknown or other
  misc_feature (502)..(502): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccgaggctcctcatccatgatgcatccaacngggtcccctgggccgtcccaagacctacgggttccgtggctaggtcggggtctggggacaggtacgttcacttcaccgtaccgtcacgcacgcctggacgcctgatgtatttgctagtttacttctgtcngcngtccgttccgccnccgccgctccgtcgttccgggcgggggtaccgagggtggaggngtaggaggacgaacgtggtggctgcgctacgtctcgtcttctctccg

SEQ ID NO: 111904 - DNA, 672 bp, Homo sapiens
  misc_feature: GYAE6OF02I3JBC.45.36.D03.1.454.CMB.1.raw
  modified_base (355)..(355): a, c, t, g, unknown or other
  misc_feature (355)..(355): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccaggtaggagtgtcagtaagtactaggctggtaccaacagaaacctggccaggcctcccaggctcctcactccatgatgcactccgaacgacgggtccctggccgttcccgaagacgtacgggttccgnggcgtaggtcggggtcgtgggacaggacgttcacgtctccgacccgtcacgccgacgcccgtacgggacgccgtagtacgttgttacgttttcgacgttaacgttttacctttcgttgttacctagtccgtacggtcccgtttcccgacccgtaccggtcccgtccgttaccggttaccggttttccgggggacccggggggttaaccggacggggttacgggagtacggtacggaacggtaaccggtaacgttcgggtacggtcgtcggaccgtaaccgtacgttccgttcgtttaccgttaccgtaccgttcccg

SEQ ID NO: 111905 - DNA, 585 bp, Homo sapiens
  misc_feature: GYAE6OF02J1B6N.45.36.D03.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
  modified_base (573)..(573): a, c, t, g, unknown or other
  misc_feature (573)..(573): n is a, c, g, or t
tcagacgcgatcgacacgaccggtgctcgatttagctgcgtcacgatctctcttgggaggaactgctcagttaggacccagagggaaccatggaagcccagctcagcttctcttcctcctgctactctggctcccagataccaccggaaaattgtagttgacacagtctccaggcaccctgtctctgtctccgagggganacagccaccctctcctgcagggccaggtacgagtgtcagtagtacttaggctggtaccaanagaaacctggaccaggctccgaggctcctcatccaatcgatgcatccaanggtcccnggcctccagcgagttccgngacaggtggtctacgggacaggtacgttcgacttacgtcctaaccggtcagggtccagtccgtgctacggtctacgagtactttggacttagtttacgttctagtctcgacacgtcgtccgcgtaccgcctcgtactacgtttcgggccgggggtctacggggtgacgtagtcgacggtacggaacgttcggtacgtccgtaacgtcgtaaccgacgtacgttcgttacgttaccnccggtttaaccc

SEQ ID NO: 111906 - DNA, 640 bp, Homo sapiens
  misc_feature: GYAE6OF02HVYM4.45.36.D03.1.454.CMB.1.raw
  modified_base (202)..(202): a, c, t, g, unknown or other
  misc_feature (202)..(202): n is a, c, g, or t
  modified_base (427)..(427): a, c, t, g, unknown or other
  misc_feature (427)..(427): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcacctgtctctgtctccgagggganacagcccaccctctcctgcagggccagtaggagtgtcagtaagtacttaggctaggtaccaacgagaaacctggccaggcctcccgaggcctcctcatccatgatcgacactaccaacgacgggtccctggccgtcccagaccgtacgggttccgaggacgtaggtcgggtcacggggactaggtacgttacacctctaccaccgtcaagtcacgtcctaggacnccgtagattgttagttttcgcttagttttaccttgtcgttacacgtctacgtcccgttccgcccgtaccggcccgtactaccgttaccgggtttccgggggaccggggggtaaccgtaggggtcggaacgtgtaggtaacggtaacggtaacgttggtacgggtctacgacctaaccgtacgttcgttccgttaccttaccgtacgttccccg

SEQ ID NO: 111907 - DNA, 764 bp, Homo sapiens
  misc_feature: GYAE6OF02IPWVC.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggngacagcccaccctctcctgcgagggccaggtaggagtgtcagtaagtacttaggctacggtaccaacgaagaaaccgtggccaggcctcccgaggcctcctcactccagtcgactgcactaccaacgtcgggtccctggccgtcccaggacgtacggttcccgtggccgtagggtcgggtcgtacggggactaggtacgtttcgactccgttaccaacccggttcgacggccgtaacggtcccgtacggggtaacggtcccgttaggtaacgttacggtttaacgtttttacggaccgttttaaccggttttttacctttccgtttacgttaccgtaacggttccgtaaccgggttcccggttttaccccgacccgtacccgggtcccgttcccgttacccgttaccgggtttcccggggggaccggggggttaaccgtacggggttagggacggtaacgtcgggaaacggaccgggtaaacggttcgggtaccgggtccgtacggaacccgtaacccgttagttccggttacggtttcccgtttacgtaccctttccccgg

SEQ ID NO: 111908 - DNA, 269 bp, Homo sapiens
  misc_feature: GYAE6OF02HU4DB.45.36.D03.1.454.CMB.1.raw
  modified_base (263)..(269): a, c, t, g, unknown or other
  misc_feature (263)..(269): n is a, c, g, or t
tcagacgcgatcgacacgaccggtgctcgatttagctgcgtcacgatctctcttggggggaagaggaagactgacggtcctcccaggagttcaggtgctgggcaccttgggcacgggggagtgtgtcacaagatttggctctgggcaccgtgggcagtgggggagtgtgtcacaagatttgggctctgggcacagcggccctgggctgcctggtcaaggctacttcctcgatcgcgtctgagcgggctggcaaggcgcatagnnnnnnn

SEQ ID NO: 111909 - DNA, 608 bp, Homo sapiens
  misc_feature: GYAE6OF02GC1LQ.45.36.D03.1.454.CMB.1.raw
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctggtaccaacagaaacctggccaggcctcccgaggcctcctcatccatgatgcatccaacgacgggtccctggccgtcccaggaccaggttccgnggcaggtgggtctgggacnggagttcactctcaccgtcagcagccgtggacgcctgatgtattttgcgttagtttacttcgttgtcagtcgacgtccgttccgccgtaccgccgtctccgtaccggtttccggggaccgggggtaccgaggggttacggacggtacggtacggaacggtaaccggtaacggtgggtcgggtccgttacggacccgtaaccgtacgttaccgttacggttcctttaccgtacgtttccccg

SEQ ID NO: 111910 - DNA, 603 bp, Homo sapiens
  misc_feature: GYAE6OF02GXMCW.45.36.D03.1.454.CMB.1.raw
  modified_base (345)..(345): a, c, t, g, unknown or other
  misc_feature (345)..(345): n is a, c, g, or t
  modified_base (399)..(399): a, c, t, g, unknown or other
  misc_feature (399)..(399): n is a, c, g, or t
  modified_base (461)..(461): a, c, t, g, unknown or other
  misc_feature (461)..(461): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtactaggctaggtaccaacacgaaacctggaccaggcctccccaggctcctcatccatgatgcatccaacgcgggtccctggccgtccagacaggttccgnggctaggtgggtctgggacaggtagttcactcgcaccgtcagcagccgtggacncgtgtactggtactttgacttagtttacttcgttgtactagtcgtacgtccgttccgacccnccggccgtcctaccgtaccgttcggggaccgggggacctaggggtcgtagagtacggacggtaccggaacgttcgggtacggtcgttacggacccgtaacccgtcgttccggttacgtttccgtttaccaccgtttaccccg

SEQ ID NO: 111911 - DNA, 522 bp, Homo sapiens
  misc_feature: GYAE6OF02FWTS3.45.36.D03.1.454.CMB.1.raw
  modified_base (340)..(340): a, c, t, g, unknown or other
  misc_feature (340)..(340): n is a, c, g, or t
tcagacgcgatcgacacgaccggtgctcgatttagctgcgtcacgatctctcttggggagctctgggagacgagcccagcactggaagtcgccggtgttcctttcggtgatcatcactgaacacagaggactcaccatggactttgggctgacctgggttttcctcgttgctcttttaagaggtgtccagtgtcaggtgcaggtggtggagtcggggggagcgttgtccagcctgggagtccctgagactctcctgtgcagcctctggattctccctcagtaactttggttccactgggtccgccaggttccaggcaaggggctggagtgggtggccctnatttccgaagatggaagtgagaaggcctactcagactccgtgaagggccacttcaccatctccagagacaattaccaagaatgtccttcttttgactaaatgaatagcctgagagttgaggacacgtctgtctattctgtgccgaggggcatctatgagtcgtggttcgtagtgtatctaac

SEQ ID NO: 111912 - DNA, 522 bp, Homo sapiens
  misc_feature: GYAE6OF02F774C.45.36.D03.1.454.CMB.1.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccgaggcctcctcatccatgatgcatcccaacncgggtccctggccgtacccagacctagggttccgtggcaggttgggtctggggacaggtacgttcactctccaccgtcagccagccgtggacgcctgatgtattttgacttagtttacttctgtcagcagtcgtccgcacgccgctctacgttcgggcggggacngggtgagngngagacgtatggngctgccacntctntctcntcc

SEQ ID NO: 111913 - DNA, 542 bp, Homo sapiens
  misc_feature: GYAE6OF02JHKZ0.45.36.D03.1.454.CMB.1.raw
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggagtcggggggagcgttgtccagcctggggaggtccctgagactctcctgtgcagcctctggattcctccctcagtaactttggttccacttgggtccgccaggttccaggtcaaggggctggagtgggtgccctnattccgaagntggaagtgagaggcctactcagactccgtagaacgggccgcttcaccatctccagacgacaactccaagaactcgttacccttttgactaatagaatacgactgagtagtgagacacgtctcgtctattctgtgccgaggggactatctagtgtagtcgtcggttcgtagtagtaatctaactaacc

SEQ ID NO: 111914 - DNA, 759 bp, Homo sapiens
  misc_feature: GYAE6OF02J2JEM.45.36.D03.1.454.CMB.1.raw
  modified_base (387)..(387): a, c, t, g, unknown or other
  misc_feature (387)..(387): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggcccccagataccaccggaaaaattgtgttgacacagtctccaggcaccctgtctctgtctccgaggggagacagccaccctctcctgcgagggccaggtacggagtcgtcagtaacgtacttaggctacggtaaccaacgacgaaaccgtggaccaggtcctccgacggcctcctacactccagtgactcgacctatacccgaacgtacgggtcccctagggtccgtacccgagtaccgtacgggtttacccggnggtccgagggttcgggtacgtggggaacctagggtaacgttcccaacttccgtaccgtaaccggtctaacggccgtaacggtcccggtagggtaccctaccggtgtaacgtacggttattttccggaactttacggttttacctcgtcgtacgacgtaccgtacggtcccgttcccgaccgtaccgtcccggtaccgttaccgtttacccggggttccgggggtacccgggggtaaccgtagggggttaccggaagggttacgggtacgaacccgggtaggttaacccggtcgggttaccgggacgtccggtaacccgtaccgttccgttcggttaccgttcccttaccggttaccgttcccggttaccccg

SEQ ID NO: 111915 - DNA, 635 bp, Homo sapiens
  misc_feature: GYAE6OF02IL4DC.45.36.D03.1.454.CMB.1.raw
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggagacagccaccctctcctgcagggccagtaggagtgtcagtaagtacttaggctggtaccaanagaaacctggccaggcctccaggcctctcatccatgatgcatccaacncgggtccctggccgtcccaaggaccgtagggttcccgtggcctaggttcggggtctaggggaaccaggacgtttcactccttaccgacccgtcaagtcgacgccgtagggacgccctagattagtattttcgacttagtttacttcgttgtcagtcacgtccgttccgcctaccgcccgcctcgtaacggtttccgggaccgggggtacccgtaggggtacgacgtaggtacggaacggaccggtaaacggttggtacgggtcgttaccggaccgtaacccgttagttcccgttacggtttacccgtttaccgaccttttccccgg

SEQ ID NO: 111916 - DNA, 628 bp, Homo sapiens
  misc_feature: GYAE6OF02G78DJ.45.36.D03.1.454.CMB.1.raw
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (290)..(290): a, c, t, g, unknown or other
  misc_feature (290)..(290): n is a, c, g, or t
  modified_base (620)..(620): a, c, t, g, unknown or other
  misc_feature (620)..(620): n is a, c, g, or t
tcagacgcgatcgacacgaccggtgctcgatttagctgcgtcacgatctctcttggggaggaactgctcagttaggacccagagggaaccatggaagcccagctcagcttctcttcctcctgctactctggctcccagactaccaccggaaaaattcgtagttgacacagtctccaggcacctgtctctgtctcaggganacagccacctctccngcagggccagtacggattgcagtatactaggctggtaccaacgagaaacctggacctaggacctccgaaggtccnctcactacgactcgaatcgacactccaacgacggtccctgccgtccagactggtaccgtcgcgtaggtcggtctggggtacaggtacgttcactcgttacaccgttcgagcgacgactcggacgcgtacgagttcgtattcgtctaacgtttacttcgttacgttccgtagtccgaagtcgttcccgtaaccgtcccggtaccgcccgttaccgtacgttttccgggaccgggggttacccgggaggtacggggtactacggtacggtacggtaccgaagtacggtcggacgttacgcggtaaccacggttcttaacggttccgtacctnttacccgg

SEQ ID NO: 111917 - DNA, 786 bp, Homo sapiens
  misc_feature: GYAE6OF02GZPQD.45.36.D03.1.454.CMB.1.raw
  modified_base (343)..(343): a, c, t, g, unknown or other
  misc_feature (343)..(343): n is a, c, g, or t
tcagacgcgatcgacacgaccggtgctcgatttagctgcgtcacgatctctcttgggaggaactgctcagttaggacccagagggaaccatggaagcccagctcagcttctcttcctcctgctactctggctcccagataccaccggaaaattgtgttgacacagtcctcaggcacctgtctctgtctccagggagacgacgccacccttctcctcgacacggggtccaggtaacggagtcggttcaaggtaagttaaccttaggcttacggtaacccaacgtaacgaaaccgtggtacccgaggtcctccccgaaggtcctccgctaacgttccaagtgacnggcactccaaacgtacgggcccttggaccgttccccagaacgtaggttcccgtggacccaggttccggtacggacggtacggagaccggtttctaccgcgtttacccaaccggtccgaagccgtaaggcccgtaacggtacggcccgtaacggtatccggtaagtttttcgaccggtatttaccgtttacgtcgtttaacggacgttcgtaacgtccgttaccggacccgtaccggttaccgtcccgttaccgttacccggttacccgggtttaccggggggggaaccctttcgggggtaacgtacgggggtaccgtttagggaaccggtaaccggttaaaaccggggtctttaaaccgggggtccctttacgggggaccctttaaccggaccccggttaaggttaacccggtttttcccgttcccggtttaacgttaccccg

SEQ ID NO: 111918 - DNA, 577 bp, Homo sapiens
  misc_feature: GYAE6OF02HAAHO.45.36.D03.1.454.CMB.1.raw
  modified_base (202)..(202): a, c, t, g, unknown or other
  misc_feature (202)..(202): n is a, c, g, or t
  modified_base (464)..(464): a, c, t, g, unknown or other
  misc_feature (464)..(464): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctaggtaccaacagaaacctggccaggcccccaggcctcctcatccatgatgcatccaacgcgggtccctgggccgtcccagaccgtacgggttcccgtggccgtaggtcggggtctgggacagtcgttcactctcgaccgtcacgcacgccgtggacgccgtgactgtactttgacttagtttactctgtcgagtcgagtccgttccgccncgccgtctcgtcgttccggggcggggaccgtggggtacgagtgtaggagaccgtacgtcggacgtcgtacgccgtaccgagttccctgttaccttctacgttcccttaccccg

SEQ ID NO: 111919 - DNA, 550 bp, Homo sapiens
  misc_feature: GYAE6OF02HSDEV.45.36.D03.1.454.CMB.1.raw
  modified_base (203)..(203): a, c, t, g, unknown or other
  misc_feature (203)..(203): n is a, c, g, or t
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggctcccaggcctcctcatccatgatgcatccaacgcgggtccctggcctccagacagggttccgnggcaggtggtctgggacaggtgttcactcncaccgtcagcacgccgtggacgcctgatgtattttgcttagtttacttcgttgtcagtcagtccgttccgcaccgcccgtctccgtacgtttcggggccgggggtaccgagggtggagagtggacggaacgaacgtggtcggcgtcgaccacgtactcgttgtcttcgtacttcccg

SEQ ID NO: 111920 - DNA, 581 bp, Homo sapiens
  misc_feature: GYAE6OF02HLNDU.45.36.D03.1.454.CMB.1.raw
  modified_base (202)..(202): a, c, t, g, unknown or other
  misc_feature (202)..(202): n is a, c, g, or t
  modified_base (349)..(349): a, c, t, g, unknown or other
  misc_feature (349)..(349): n is a, c, g, or t
  modified_base (396)..(396): a, c, t, g, unknown or other
  misc_feature (396)..(396): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggcctcctcactccatgactgcatccaacgacgggtccctggcctcccaggactacggttccgnggcagggtgggtctaggggacaggtacgttcacgttctcctaccgtnacgccacgccgtgggacgtccgtgtagtgtagttttgctagttttacttcttgtcagctagtccgttccgcaccgccgtcctcgtaccgtttcgggccgggggtaccgagggtcggagagtggacgacggtaacgtcggtacggctacgccgtacctacgtccgttcgttccttcgtacttcccg

SEQ ID NO: 111921 - DNA, 644 bp, Homo sapiens
  misc_feature: GYAE6OF02JIONP.45.36.D03.1.454.CMB.1.raw
  modified_base (205)..(205): a, c, t, g, unknown or other
  misc_feature (205)..(205): n is a, c, g, or t
  modified_base (476)..(476): a, c, t, g, unknown or other
  misc_feature (476)..(476): n is a, c, g, or t
  modified_base (507)..(507): a, c, t, g, unknown or other
  misc_feature (507)..(507): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacngccaccctctcctgcacgggccagtaggagtgtcagtaagtactaggctggtaaccaacagaaacctggaccaggcctccgaggcctcctcactccatgatcgcatccaacgagggtccctaggccgtacccagaccgtacgggttccgcggactagggtcgggtcgacgggactacggtagttccacgttccgtacccgaacggtccaggaccacgggtccgtagggacctccgttagacgttgtattttcggaccttaaggtttttccngttcgtacgcgtccagttcccgtccgacccnggtccctcgtacgttaccggtttcgggggaccggggacgttgggtacgcgtagttacgggaacgtaacccggtagggtgtggggtaccctcggacccaccggtacttcggttcggttacctttacacccggtttccc

SEQ ID NO: 111922 - DNA, 614 bp, Homo sapiens
  misc_feature: GYAE6OF02JKQMV.45.36.D03.1.454.CMB.1.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtagtacttaggctggtaccaacagaacctggccaggctcccaggctcctcatccatgatcgacatcccaacgacgggtcccctgggccgtcccagaccgtacgggtttccgnggccagggttcggggtcctaggggacaggtacgttcactcgtaccaccggtcacgcacgccgtgggacgctggactggtatttcgctagtttactctgtcagcacgtccgttccgcaccgtccgtcctccgtaccggtttcggggacccgggggtacctaggggtacggtagacgttggaacggtaccggtaaccgtggttacgggtccttacggaccgtaccctagttccggttacgttcccgtttaccgtacgttccccg

SEQ ID NO: 111923 - DNA, 736 bp, Homo sapiens
  misc_feature: GYAE6OF02H5AKX.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcacgggccagtaggagtgtcagtaagtacttaggctggtaccaacagaaacctggccaggctcccaggctcctcactccatgatcgcactccaagcgggtccctggcctccagactacggttccgtggcaggtgggtcgtcggggacaggtacgttccacgttctaccgtaccggttcacggccacggtcccgtagggacgtcccgttaggacgttaggttacgtttttcggaccgtttaacggtttttaaccgtttccgttgttaccgtacggtaccgtaacgggttcccggtttaccccggcccgtaacccgggtccccgtacccgtttccccgttaacccgggtttttcccgggggggacccgggggggggttaaacccgtacggggggtttaacgggacgggttaacgttacgggaacgggtaaccggtaaacggttcgggtacgggtaccgttaccggacccgtaacccgtacgtttcccggttcgtttccgttaccgtaccgtttcccccg

SEQ ID NO: 111924 - DNA, 593 bp, Homo sapiens
  misc_feature: GYAE6OF02G8CWW.45.36.D03.1.454.CMB.1.raw
  modified_base (262)..(262): a, c, t, g, unknown or other
  misc_feature (262)..(262): n is a, c, g, or t
  modified_base (288)..(288): a, c, t, g, unknown or other
  misc_feature (288)..(288): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctccaggctcncatccatgatgcatccaacagggtccctggcctcccagacaggttccgnggccaggtcggtcngggacagagttcactctcgaccgtnacgcagcctggacgcctgatgtatttgacttagtttacttcgttgtcagcgtacgtccgttccgccacgcccgtctccgtaccggtttccggggccgggggtaccgtaggggtacggacggtacgtaggaacggtaacggtaacggttcgggtacgggtacgtacggtaccgtaaccgtacgttccgttacgtttaccgttaccgtactttccccgg

SEQ ID NO: 111925 - DNA, 602 bp, Homo sapiens
  misc_feature: GYAE6OF02G5EO1.45.36.D03.1.454.CMB.1.raw
  modified_base (354)..(354): a, c, t, g, unknown or other
  misc_feature (354)..(354): n is a, c, g, or t
  modified_base (457)..(457): a, c, t, g, unknown or other
  misc_feature (457)..(457): n is a, c, g, or t
  modified_base (526)..(526): a, c, t, g, unknown or other
  misc_feature (526)..(526): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccgaggcctcctcactccatgatgccatcccaacgacgggtccctggccgtaccccagacgtacgggttccgnggcgtagggtcgggtctggggacaggtacgttcactcctcgaccggtcagcacggccgtagggacgccgtagattggttattttcgacttacgttttcttcgngttcagtccagtccgtccgccacgcccgtctcgtaccggtttcggggccgggggtaccgtcgggtaggngtacgtaggacgtaccggtaacgtcggtcgggtctacggccacccgttgtaccgttgttccgttactacgttcccc

SEQ ID NO: 111926 - DNA, 755 bp, Homo sapiens
  misc_feature: GYAE6OF02I4SMA.45.36.D03.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcaggccagtaggagtgtcagtaagtacttaggctggtaccaanagaaacctggaccaaggcctaccgaggcctacccgtcactccagtgactgaccacgtacccaaacgtacgggttcccctggtaccgtcccccgaagaaccggtacgggtttcccggtaggtaccctagggggttaccgggtccgttacggggaacgtaaggtacggttttccaaccgttcctacccggtaaacccgggttcaacgggccgtaaccggccgttacgggacgtccccgttaggacgtttcggtaccgttttgggacctttaacggtttttaccgtacgttacgtcgacggtcgtaacggtcccgtttcccggacccgtacggccccgtaccgttccggttaacccggggttttcccggggggaccgggggtaaccgttacgggggtacgtacgggtacgtacggggaccggtaacggtaacggtgggtacgggtccgtacggaccgtaccgtagttccctcggtttacgtccctacgtttccccg

SEQ ID NO: 111927 - DNA, 826 bp, Homo sapiens
  misc_feature: GYAE6OF02JBTUW.45.36.D03.1.454.CMB.1.raw
  modified_base (360)..(360): a, c, t, g, unknown or other
  misc_feature (360)..(360): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggagacagccaccctctcctgcacgggccagtaggagtgtcagtagtacgtaggctcggtaaccaacgagaaaccgtggccgacggcctccgaggcctcctcactccatgactcgacactaccgaacgtacggtccctggcctaccgagacgtacggttccgngaccgtggtcgggtcgtacggggactaggtacgttccaacgttccgtaccgaccggtaccgaacgtccgtaaccgggtccgtacggggtaactccccggttaggtaacgttcgtttaacgtttttccgggaaccttttacggtttttaacccgttcgttaccgggttaaccgtaaccggttccgttacgggtttcccccggtacccggtacccggtaccccggtcccgtttcccggttaacccggttaccggggttttaccccgggggggacccggggggttaaacccggttagggggttaaccggggtaaccgggttaacggtttccggggaaaaccgggttacccgggttaaaccgggtcgggttaaaccgggtaccccgtacggttaaccccgtaccccggtttaggttttacccccggttgggtttaaccccctttccggaacccgtttttacccccccggg

SEQ ID NO: 111928 - DNA, 814 bp, Homo sapiens
  misc_feature: GYAE6OF02JPJD8.45.36.D03.1.454.CMB.1.raw
  modified_base (199)..(199): a, c, t, g, unknown or other
  misc_feature (199)..(199): n is a, c, g, or t
  modified_base (404)..(404): a, c, t, g, unknown or other
  misc_feature (404)..(404): n is a, c, g, or t
tcagacgcgatcgacacgaccggtgctcgatttagctgcgtcacgatctctcttggggaggaactgctcagttaggacccagagggaaccatggaagcccagctcagcttctcttcctcctgctactctggctcccagataccaccggaaaattgtgttgacacagtctccaggcacctgtctctgtctccgagggganacacgccaccctctcctgcgacgggccaaggtaggagtgtcaggtaagtacgttaggctacggtaaccaacgaggaaacctggaccaaggcctaccgaaggcctccgtcaacgtcccaatcggacttcggacctaacgtacccaaaccggacggggttcccctagggaccccgttacccgaacggaaccgttacgggtttcccgngggaccgtagggtcgggggttacctaggggacctagggtacgttcgaaccttcgtacccgaccgggttccaacgggtccgtacgggtaccccgtagggtaccggaccgttacggacgttcggttacttttacgggccgtttaacggttttaaccttccgttggttaaccgacggttacgtacggttacccggttcccgtaccgtaaccggtccccgtaccgtttacccgttaacccgggtttttacgggggacccggggggtaacccttaacgggggttcggaaccgggttacggttacggaaccgggtaacgggttaaaccgggtgggttaccgggtacgtacccggtaaccggttaccggtaaccgttcccgtttacgggtttacccgtttaccgtcgtttaccccgg

SEQ ID NO: 111929 - DNA, 713 bp, Homo sapiens
  misc_feature: GYAE6OF02HIGDQ.45.36.D03.1.454.CMB.1.raw
  modified_base (202)..(202): a, c, t, g, unknown or other
  misc_feature (202)..(202): n is a, c, g, or t
  modified_base (358)..(358): a, c, t, g, unknown or other
  misc_feature (358)..(358): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctaggtaccaacagaaacctggccaggctcccaggcctcctcatccatgatcgcatccaacgtacgggtccctgggcccgtacccgaggaccgtacgggttccggnggaccgtagggtcggggtacgtgggggaactaaggtagtttccaacttcgtaccgaccggtacacggccacggtccctgggacgtccgttaggtacgttggttaattttcggacgttaacgtttttaccttcgttcgtctacgtccgtacggttcccggttcccgaccgtaccggtccccgtccgtaccgttaccgggttttccggggggcccggggggtaaccggtacggggggttacggaacgggttaacgtacgggtaacggtaaccggtaacggtcgggttacgggccgttacggaccctaacccggtagttcccgttacggtttaccctttaccgtacccgtttccccgg

SEQ ID NO: 111930 - DNA, 232 bp, Homo sapiens
  misc_feature: GYAE6OF02HD0H7.45.36.D03.1.454.CMB.1.raw
  modified_base (227)..(232): a, c, t, g, unknown or other
  misc_feature (227)..(232): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnnnn

SEQ ID NO: 111931 - DNA, 510 bp, Homo sapiens
  misc_feature: GYAE6OF02G7INA.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccacgtggcactcccagccaggttcaggtggcggtgggttggctacagacttcactctcacatcagcagcctaccaacctgaagtattttgctagttctattactgtacaacagcgtacagtacttggccgtctcacgtttcggcgggtacggaccgaaggtggagagtacgaaacgtactggtgctgaccacgtac

SEQ ID NO: 111932 - DNA, 755 bp, Homo sapiens
  misc_feature: GYAE6OF02HCGFJ.45.36.D03.1.454.CMB.1.raw
  modified_base (266)..(266): a, c, t, g, unknown or other
  misc_feature (266)..(266): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccaggtaggagtgtcagtaagtacttaggctggtaaccaanagaaacctggaccaggcctcccgaggtcctcctcactccatggatcgacctactacccaaacgtaccggggtcccctacgggcccgtaccccgtaaggacccgttaacggggttttccccgtggggccgtaacggggttccgggggttaccgttacggggggaacctagggtaacgttttacggaaccctttcgtacccgacccggttacaacggccgacgggtccccgtggggaaccgtcccgttaggtaacgtttggtaactttttcgggacttaacgggtttttaccttcgttacggtcctaggcctaacggtcccggttcccgcctacccggcccgtaccttccgtaaccggtttcgggggcccggggggtaaccgtcggggtacgggtagacggtacgaacggtacggaacggttcgggtacggccgttaacgaccgtaaccgtcgtttccgttacggtttccttaccggtacctttaccccgg

SEQ ID NO: 111933 - DNA, 657 bp, Homo sapiens
  misc_feature: GYAE6OF02JQXFM.45.36.D03.1.454.CMB.1.raw
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcaggccagtaggagtgtcagtaagtacttaggctggtaccaacagaacctggaccaggcctcccgaggcctcctcactccagtgactgcctatccaaacgtcgggtccctagggccctaccaggacgtacggttccggtcggacgtacgggttcgggtcgtagggacaggtacgttcacgtccgtacctaccgtcncgcgacgcgtacggacgcctgntcgtatttgcttagtttcttcgttacgtcacggtcctacgtccgttccgccgtaccgtcccgtaccgttaccgttaccgggtttcccggggaccgggggtacccggtacggggtacggtacggttacgtacgggaacggtaccgggtaaccggttgggtacggtccgtacggtaccgtaccgtacgttaccgtcggttccttaccgtaccgtttcccg

SEQ ID NO: 111934 - DNA, 696 bp, Homo sapiens
  misc_feature: GYAE6OF02GNF8M.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggaggtcggggggaggcgttgtccagcctgggaggtccctgagactctcctgtgcagcctctggattcctccctcagtaacttttggtttcccacgttcgggtcccgccgaggttccagggcgaaagggggctgggaggttggggtacggccccttcgtacgttttcccggaaagtagttagggaaaggttggaaggtaaacggcccgttaactacgaagaccgttcccggtaggaaacgggcccgtactttaccgaaccctatacccgtacccgaaggaacgtaacctaaactttacccaaaggtaacttccgttaccctttacgtttttacgacttaaaagttcgtaaacgtacgtacctaggaagtaaggtttaggaagggtactaccggttctgttcttagtttcgtgtcgaccggtaggggtaacagttactagtaggtacgttacgttgggtttacgttaggttagttaacgtcctaaaccg

SEQ ID NO: 111935 - DNA, 523 bp, Homo sapiens
  misc_feature: GYAE6OF02GKIMF.45.36.D03.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggagaaattgtcttgacacagtctccagccattctgtctctctctccagggganacagccaccctntcatgcagggccagtcagagtatagaacatacttggcctggtatcaatacaagcctggccacgggtccccggctcctcatctatgatgcttccagcagggccacgtggcactcccagccaggttcagtggcggtggttgcacgagacttcactctcacaatcagcagcctaccaacctgaagtatttagctagtctattactgtacaacagacgtacagtacgttcgccgctactacgtttcggacggagggtaccgaagggtaggacgaagtaccgaaacgtacgtaggtacggcgtacgaccactacg

SEQ ID NO: 111936 - DNA, 616 bp, Homo sapiens
  misc_feature: GYAE6OF02IO3IL.45.36.D03.1.454.CMB.1.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccgaggcctcctcatccatgatgcatccaacncgggtccctggccgtcccagacacggttccgtggcctaggtcgggtctaggggacctaggacgttcgaactcctacgaccgtcagcagccgtggacgtcctggatgtattttcgctacgtttacttcgttacgtctagcgtacgtccgttccgccaccggtcccgtaccgtccgtaccgtttccggggccggggggtacccgtaggggtacgtaggtacgtacggacggtaccggtaacgtacggtcgggtaccgtcggtaccgaccgtacgttccgttcggttccttaccgtacgttacccg

SEQ ID NO: 111937 - DNA, 569 bp, Homo sapiens
  misc_feature: GYAE6OF02G9F6I.45.36.D03.1.454.CMB.1.raw
  modified_base (342)..(342): a, c, t, g, unknown or other
  misc_feature (342)..(342): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggagacagccaccctctcctgcagggccagtaggagtgtcagtaagtacttaggctggtaccaacagaaacctggccaggctcccgaggctcctcatccatgatgcatccaacgtacgggtcctggcctccagacgtaggttccgnggctaggtgggtctggggacaggagttcacgtctacgaccgttcagcagccgtcggacgccgtgagttagtatttgtcgtagtttcgttacttcgtctagctacgtcgttccgccgacgcccgccgtccgtacgtttcgggccgggggtaccgacgggtgggtacgagtggaggtacggacgtcggtacggcgtcgacgacgtacgttctcgtcttcgtaccttccg

SEQ ID NO: 111938 - DNA, 610 bp, Homo sapiens
  misc_feature: GYAE6OF02GBX1R.45.36.D03.1.454.CMB.1.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (350)..(350): a, c, t, g, unknown or other
  misc_feature (350)..(350): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctaggtaccaanacgaaacctggccaggcctacccgaggctcctcatccatgatcgacactaccaacgtacgggtccctggcctccagacacggttccgnggctagggtcgggtctggggactaggtacgttcactcgtaccaccgtacacgcacgtccgtaggactcgtgtatgtacttttgcttagtttctcttgtctgtcacgtccgtccgccacgccgtctccgtaccggtttccggggaccgggggtaccgtacggggtacgacggtacgtacggacggtaaccggtaacggtggtacgggtacctcggacccgtacgtaacgttccgtacttacccgttaccgctttaccccgg

SEQ ID NO: 111939 - DNA, 554 bp, Homo sapiens
  misc_feature: GYAE6OF02I7OJI.45.36.D03.1.454.CMB.1.raw
  modified_base (203)..(203): a, c, t, g, unknown or other
  misc_feature (203)..(203): n is a, c, g, or t
  modified_base (286)..(286): a, c, t, g, unknown or other
  misc_feature (286)..(286): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctctctccgagggganacagccaccctctcatgcgagggccagtcagagtattagaacatacttggcctggtatcaatacagctggccagggtccccgntcctcatcatgatgcttccagcagggccagtgcatcccagccaggttcaggtggtccgggtgggttcgcaactgtacttcgacttctacactaactcagcacgcctaccaacctgaatntttcgntagtccttaattacncgtaccaacgcgtacgtactagtacttcgggacctccttaactccgtttacgggccgggtaagggacctaagggtcggaacggtacaacgaaaccgtcgtagggtcgctcgacctacgtactcgttcg

SEQ ID NO: 111940 - DNA, 547 bp, Homo sapiens
  misc_feature: GYAE6OF02JDGQN.45.36.D03.1.454.CMB.1.raw
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggagtcggggggaggcgttgtccagcctggggaggtccctgagactctcctgtgcaggcctctggattcctccctcagttaacttttgggtttcccactggggtcccgccaggttccaggcaaggggctgggagtgggtggccctnatttccgaagntggaagtgagaggcctancagactcgtgaacgggccncttcaccatctccagagacaacttcaagaatcgtccttcttttgactaaatagaatacgctagagagttagagacacgtctgtacttattctgtgcgaggggactagtctatgtagttcgttggttacgttagtagttatctaac

SEQ ID NO: 111941 - DNA, 514 bp, Homo sapiens
  misc_feature: GYAE6OF02GFU45.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctggcctcccagacaggttccgtggcaggtgggtctggggacagagttcactctcaccgtcagcagcctggagcctgatgtattttgctagtttacttcttgtcagcagtcgttccgccacgccgctcacgtttcgggcgggggaccaggggtgagagtgagacgaacgtggtggctgcacactctgtcttcatccg

SEQ ID NO: 111942 - DNA, 710 bp, Homo sapiens
  misc_feature: GYAE6OF02JLZ9U.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctcggccccagactaccaccggaaaattgtgttgacacagtctccaggcacctgtctctgtctcgagggganacacgccaccctctcctgcgacgggccaggtacggagtcgtacgaagtaacgtacgtaggctacggtaaccaacgagtaaaccgtggaccgaacggcctacccgaggtccttcccgtaccacttccatggactcgacaactaccgaaacgtccgggtcctggcccgtaccctaggacgtacgggttccgtggtccgacggttcggggtcctaggggactagggtacgttccaaccgttcgtacccgacccggttacgacgtaccgacggtcccgtagggaccgtccagtacgtgttagtttacgactttaggttttacctgtacggtctacggtacttacggtccgttacccggacctcccggtaccgtcgttacccggtaccgggtttccgggggacccgggggtacgtaggggtcgacgtacgtcgggacggaacgtacgttggacgggcttacggacccttacggtacttcgggttcttacccgtaccgtccgtttccctacccgg

SEQ ID NO: 111943 - DNA, 676 bp, Homo sapiens
  misc_feature: GYAE6OF02GWXNV.45.36.D03.1.454.CMB.1.raw
  modified_base (215)..(215): a, c, t, g, unknown or other
  misc_feature (215)..(215): n is a, c, g, or t
tcagacgcgatcgacacgaccggtgctcgatttagctgcgtcacgatctctcttggggcagagctctggggaggaactgctcagttaggacccagacggaaccatggaagccccagcgcagcttctcctcctcctgctactctggctcccagagacctccggagaaattgtcttgacacagtctccagccattctgtctctctctccgagggganacagccaccctctcatgcagggccagtcagagtattagaacatacttggcctggtatacaatacaagcctggcctacgggtcccccggctcctcatctatgatcgtccttccagcagggccacgtggcactcccagccgtaggttccaggtcgggtcgggttggggtttcggacacgtaacggtaccgtttaccgtactctaccaactaactccgaacgccgtaacgtccctacccgaaaccttcggtaaacgttacgtttttacgaccgttaagttaccctttaagttaccgttagtaaccgtaaaccgtaacgtaccgttaaacgacgttaaccgtttaccgggacccgttaccttaccggttaaccggttttccgggggaaccggggttaaacgggacccggtaaaggggttcgggaaacggtaacgttaaccgggtaaaaccggtaaggttacgggg

SEQ ID NO: 111944 - DNA, 926 bp, Homo sapiens
  misc_feature: GYAE6OF02JJHAT.45.36.D03.1.454.CMB.1.raw
  modified_base (188)..(188): a, c, t, g, unknown or other
  misc_feature (188)..(188): n is a, c, g, or t
  modified_base (211)..(211): a, c, t, g, unknown or other
  misc_feature (211)..(211): n is a, c, g, or t
  modified_base (263)..(263): a, c, t, g, unknown or other
  misc_feature (263)..(263): n is a, c, g, or t
tcagacgcgatcgacacgaccggtgctcgatttagctgcgtcacgatctctcttggggaggaactgctcagttaggacccagagggaaccatggaagccccagctccagcttctcttcctcctggcactctggctcccagactacccgaccggagaaattgtcgttgacacagtcctcagccaccctnttctttagttccgaggggtaaancgacccacctcctccgtcgacgacgggcctagtccgagggttagttaaaccnccgtcttaacttacgggacccttaggtaaaccccaaaacgtaaaaaacccgttcgggacccgtaaggtcccgttaaccccgacgggttacctcccgtaaacttacccggtaaacttaccttaaaccgttaccgggaaacccgtaccgtaccgttaaccgggaaaacccgtacggggtaccctaaccggtccgggtaacctaaccgtccccgaccggtacccgttaaacgggggtcctaaacggtccgggtaaccttacgggtcccgggggtttaacgtaccgggggtaacctaaccgttaaccgggtttccctaaccgttcgtaaccccgtaaccgaacgtaccgtaacgccgtaccgacccgtttacgggaaccgttaggtaaccgttagtttacgggtccttaagtttacccgtacgttacgtacccgtagacgtacgggtacgtccgggaaccgttaacggcgtacccgttaccggtaccttaccgggttacccggggtaccgggttaacgggaacccggtaaaggggtttaccggacggttaaccgtaaccgggtaaaaaccggttccgggacgggtttacgtaccccgggtaagttaccccgaacggtttaccgtccggttaacccgtttccgggtaactttaacccggttcccccgg

SEQ ID NO: 111945 - DNA, 612 bp, Homo sapiens
  misc_feature: GYAE6OF02I73NR.45.36.D03.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (317)..(317): a, c, t, g, unknown or other
  misc_feature (317)..(317): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (383)..(383): a, c, t, g, unknown or other
  misc_feature (383)..(383): n is a, c, g, or t
  modified_base (469)..(469): a, c, t, g, unknown or other
  misc_feature (469)..(469): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacgttagctggtaccaanagaaacctggaccaggctccagctccncatccatgatgcatccaacgacggtccngcctcccgagacgacggttccgnggcaggtgggtctggganaggtacgttcactctaccgaccgtnagccaggcctgggaactcgtgactgttatttcgccttaagttttacctcgtgtcgagtccaggtcccgttccgcccgtacgcccgnttccgttacgtttcgggggtaccgggggaacctaggggtgtaacgacgtaggaacggtaaccggtaacggttagggtaccgggtcttaaccggcctaaccgtactttacggttccgtaccgttttaccgacgtttccccccgg

SEQ ID NO: 111946 - DNA, 682 bp, Homo sapiens
  misc_feature: GYAE6OF02JZUC9.45.36.D03.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (262)..(262): a, c, t, g, unknown or other
  misc_feature (262)..(262): n is a, c, g, or t
  modified_base (429)..(429): a, c, t, g, unknown or other
  misc_feature (429)..(429): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctntcctgcagggccagtaggagtgtcaagtagtacttaggctggtaccaanagaacctggaccaggctcccgaggcctcctcatccagtcgattcgccatcccaaacgtcgggtcccctgggacccgtcccaagaccgtacgggttccgtagggacctagggttcgggtcttaggggaaccctagggtacgtttaccgactttccgacgtacccggtnaacggtccaggtccctgggtaccgtcctacggtactacggtacgttttacgcttaaggttttccttcgttacgtcgtaaggtcctaacggtccggttacccgaccgtaccggtccgtcttacccgtacggtttccggggaccgggggtaccgtagggttcggaacggtacgttacgggacggtaacggtaacgttcggtcggtaccgttcgacgtaccgtacggtccgttacggtaccgttccgacgttcccg

SEQ ID NO: 111947 - DNA, 700 bp, Homo sapiens
  misc_feature: GYAE6OF02HZ5DV.45.36.D03.1.454.CMB.1.raw
  modified_base (205)..(205): a, c, t, g, unknown or other
  misc_feature (205)..(205): n is a, c, g, or t
  modified_base (667)..(667): a, c, t, g, unknown or other
  misc_feature (667)..(667): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaccggaaaaattgtgttgacacagtctccaggcaccctgtctctgtctaccgagggganacgagcccaccctctcctgcgacgggccaggtacggagtcgtacaagtaacgtattaacgggcttacggtaaccaaacgagaaaacccgtggaccaagggcctcccccgggtactcctacattccgtcgtggtcgaccacaccaccggaggccccacgtggtaacctcccaaggtcccaggttaccaggttcgaaccgtagggtcgggtcgtacggggaactaggggttccctaccgtctaaccaagttccgaacggggtacctttacgacgtaccgtaggaagttaagttttacggcgtttaaaggtttacttaacgttacgtactaagttacaacgttactacgtactacggtacgggactaacgtacggtttttaccgggaccgtaacggggtaaccgacggtacgtggaacgtaacgtaacgaaacgtaacgtggtacgcgtacgtcaaccgttacgngttcgtacttctacgtccttacccgtactaccg

SEQ ID NO: 111948 - DNA, 594 bp, Homo sapiens
  misc_feature: GYAE6OF02FMN2A.45.36.D03.1.454.CMB.1.raw
  modified_base (352)..(352): a, c, t, g, unknown or other
  misc_feature (352)..(352): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagccaccctctcctgcagggccagtaggagtgtcagtaagtacttaggctggtaccaacagaaacctggaccaggcctcccaggcctcctcatccatcgatgcatccaaacgcgggtccctggccgtacccagaccgaggttccgnggcctaggtcgggtctggggaacaggtacgtttcacttctaccgaccgtcagcacgccgtggacgcgtgatgtatttcgactacgtttacttcttgtcagtcgtagtccgttccgccaccgtccgcgtccgtaccggttccgggaccggggggtaccgtaggggtacgtaggtagtcggaacgacggtaacgtcggtcggcgtacgacgtaccgacgttcgtacgttccttactacttcccg

SEQ ID NO: 111949 - DNA, 542 bp, Homo sapiens
  misc_feature: GYAE6OF02GPX3Z.45.36.D03.1.454.CMB.1.raw
  modified_base (293)..(293): a, c, t, g, unknown or other
  misc_feature (293)..(293): n is a, c, g, or t
  modified_base (400)..(400): a, c, t, g, unknown or other
  misc_feature (400)..(400): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctccncatccatgatgcatccaacacgggtccctaggccgtcccagaccacggttccgtggcctaggtgggtctgggacagacgttcactctcaccgtcagcagcctggacncctgatgtatttgctagtttacttctgtcagcagtccgttccgccacgccgtctcgtacgtttccggggaccggggtaccgtagggtgacgagtgacgacggtaagtggtcggctcgcaccatccgtggtcttcacttcccg

SEQ ID NO: 111950 - DNA, 566 bp, Homo sapiens
  misc_feature: GYAE6OF02FJ0QS.45.36.D03.1.454.CMB.1.raw
  modified_base (350)..(350): a, c, t, g, unknown or other
  misc_feature (350)..(350): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcggggccaggtaggagtgtcagtaagtacttaggctggtaccaacagaaacctggccaggctcccaggctcctcactccatgatgcactccaacgcgggtccctgggccgtacccagaccagggttcccgnggccaggtggggtctggggaccaggtagttcactctcgaccgtcagcacgcctggacgctgatgtatttgcttagtttactctgtcagtcacgtcgtccgccacgccgctccgtacgtttccgggcgggggtaccgaggggtcggacgagtcgacggacgtacgtggtcggtcgtcgaccgacgtacgtcgttcgttccttctacgttccttcccg

SEQ ID NO: 111951 - DNA, 603 bp, Homo sapiens
  misc_feature: GYAE6OF02INPAY.45.36.D03.1.454.CMB.1.raw
  modified_base (202)..(202): a, c, t, g, unknown or other
  misc_feature (202)..(202): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
  modified_base (394)..(394): a, c, t, g, unknown or other
  misc_feature (394)..(394): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtacagtagtacttggctggtaccaacagaacctgccaggctcccaggcctcctcatccatgatgcataccaacgacggtccctggcctcccgagactaggttccgnggcaggtggtcngggacagtacttcactctcacgtcagcacgccgtcggacnccgtagacgttgtatttcgacttagtttacttcgttgtacgacgtacgtacgtccgttaccgcccgtaccggtccgtccgttccgtaccgttccgggggaccggggtaccggacggggtcggacggtagtacgggacggtaccggtaaggttggtacggtcggtacgaccgtacgtacgttccgtacgtttccgttaccacgtttcccg

SEQ ID NO: 111952 - DNA, 778 bp, Homo sapiens
  misc_feature: GYAE6OF02JL4BF.45.36.D03.1.454.CMB.1.raw
tcagacgcgatcgacacgaccggtgctcgatttagctgcgtcacgatctctcttggggaggaactgctcagttaggacccagagggaaccatggaagcccagctcagcttctcttcctcctgctactctggctcccagataccaccggaaaaattgtgttgacacagtctccaggcaccctgtctctgtctcaggggagacagccacctctcctgcacgggccagtaggagtcgcagtaacgtacttaggcctaggtaccaaacgacgaaaccttggacccaagggctaccccgaagggtcctccgtacacttcccaattcgacttcggcctaagtcccaaacgtacggtcgtacccccgtgggcccgttaccccaaggtaccgtaaccgggtttcccggtaggtacccgtaacggggtttcggggtccttacggggggacctaagggtaacgttttccgaacctttccgttaccgaacccggttacaacgggtcccgtacggtacccgttacggggaaccgttccccgtaggtaacgttacgggtacgtttttaccggacttaacggtttttaaccgttcgttacggttcgacggtcgtacggtcccggtttacccggcccgtacgtccccggtaccgttacctaaccgggttttccggggaccggggggtaccgtacgggggttacgggacgtaggtacggtacggtaaccgggtaacttcgggtcggtacggttagcccggtaactccgttaccggtcgttccgttactaaccgg

SEQ ID NO: 111953 - DNA, 699 bp, Homo sapiens
  misc_feature: GYAE6OF02HJWM3.45.36.D03.1.454.CMB.1.raw
  modified_base (136)..(136): a, c, t, g, unknown or other
  misc_feature (136)..(136): n is a, c, g, or t
  modified_base (161)..(161): a, c, t, g, unknown or other
  misc_feature (161)..(161): n is a, c, g, or t
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
tcagacgcgatcgacacgaccggtgctcgatttagctgcgtcacgatctctcttgggagctctgggagacgagccagcactggaagtcgccggtgtttccttcggtgatcatcactgaacacagaggactcaccanggacttggctgacctgggttttccncgttgctctttaagaggtgtcagtgtcaggtgcaggtggtggaggtcgggggaggngttggtaccgagccgtgggaggtccctggagctctccgtntaggccaggtcctctaggacttcctccccgtataggttaaaccttttggggtttcccaacggttcggggtcccgtccgaaggtttccccgaaggtccgaaacggggcgtacgggaggttcgggtcggcccctcgtaactttacccggaagtacgtaggaagtacgggagtaaacggcctaacgtcaacggacgtccgtgggaacgggacccggtctaccgaacacgttcaccgtaagacgataacgtacaacgaagtctactacttttacgacaacttagaagtactaccgtagaacgtagttacggaacgggaactaccgtaagttcgtaacgtttaacgttcgtttaaccggcgttacccgggaggggtaacccgtaattccgtaagttccggaagttacgtccggtttacgtaaggtacgttaacgtaccgtaaaaccg

SEQ ID NO: 111954 - DNA, 701 bp, Homo sapiens
  misc_feature: GYAE6OF02IIZW2.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccgagggnacagccaccctctcctgcagggccagtaggagtgtcagtaagtacttaggctaggtaaccaacgagaaaccgtggacctacggacctccccgaggctacactacattctagtcgacgctacgtacggaacgtacgggtccgtggaccgtcccaaggacctagggttacccgtggacgtaggtcggggtctaggggactaggtacggttccaacgttccgtaccaacccggttcgaacgtccgaaccggtccgtacgggacggtcccgtaggtacgttagttacgttttcgacgttacgttttaccttcgttagttccgtacgtaccgtacggttcccgttcccgacccgtaccgcccgttaccgtccgttaccgggtttcccgggggacggggtaccggtaggggttacgggaacgtacggtaggaccggtagaaccggttggtacgtcgtcgaccgtaccgtacttcggttcgttacctacttaccgttaccgttcccg

SEQ ID NO: 111955 - DNA, 659 bp, Homo sapiens
  misc_feature: GYAE6OF02FN8RM.45.36.D03.1.454.CMB.1.raw
  modified_base (266)..(266): a, c, t, g, unknown or other
  misc_feature (266)..(266): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccaggtaggagtgtcagtaagtacttaggctaggtaccaanagaaacctggccaggcctcccgaggcctcctcactccatgatgccatacccaacgtacggggtcccctgggcccgtaccccgaggaccgtacgggttcccggtggaccgtagggtcggggtcgtggggacctaaggtacgttccacgttcgtaccgacccgtcacggcgacgcctagggacgtcctggtacttgttagttttcgacgttacgtttacttcgttgtacagtctacgtccgttcccgcctaccggtccgtcccgtccgtaccggtttccgggggcccggggggtaaccgtcggggtagggagtacgtaggaacggtacggtaacggttgggtacggcgttcggaccgtacccttgttaccgttcgtcctttaccgtccgttcccg

SEQ ID NO: 111956 - DNA, 605 bp, Homo sapiens
  misc_feature: GYAE6OF02FRGSV.45.36.D03.1.454.CMB.1.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (325)..(325): a, c, t, g, unknown or other
  misc_feature (325)..(325): n is a, c, g, or t
  modified_base (424)..(424): a, c, t, g, unknown or other
  misc_feature (424)..(424): n is a, c, g, or t
  modified_base (576)..(576): a, c, t, g, unknown or other
  misc_feature (576)..(576): n is a, c, g, or t
tcagacgcgatcgacacgaccggtgctcgatttagctgcgtcacgatctctcttggggagggaactgctcagttaggacccagagggaaccatggaagcccagctcagcttctcttcctcctgctactctggctcccagataccaccggaaaaattgtgttgacacagtctccaggcaccctgtctctgtctccagggganacgagtccaccctctcctgcagggccagtaggatggtcagtaagtacttaggcctggtaccanagaactggaccaggctcccaggcctcctcatcccatgactgcatcccaactagggtccccngggtccgtccccaggacctaggttcccggttgggccaggtcggggtctgggggaaccaggaggttccacgttcgttcaccgtcgagcagccgtgacgcncgagtcagtttcgctagttacgtttcttgtctagtacgacgtcgtccggtccctacgccggtacctcgtaacctttccgggtccgggggcctaacggggtggtacggacggttgacggacggtaacgacggtcgggtacgttgaccgttacncgttaccgtcgtccgtacttacgttcccg

SEQ ID NO: 111957 - DNA, 629 bp, Homo sapiens
  misc_feature: GYAE6OF02F5HPI.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctaggtaccaacagaaacctggccaggctcccaggcctcctcactccatgatgcatccaacgtacgggtccctggccgtcccagaccgtacggttccggtggcaggttcggggtcgtggggactaggtacgttcacttctccgaccgtcacgcacgccgtaggacgtccgtggtattgtattttcggacttagttttaccttcgttgtacctaggtcctacggtccgttcccgtccgaccgtcccgtcctccgtaaccggttttccggggaccggggggtaccgtaggggtacgggaggtacgtgggacggtacggtaacgtcggtcgggtcgtcggaccgtaccgtagttccgtcgttcttccgtacttccccgg

SEQ ID NO: 111958 - DNA, 702 bp, Homo sapiens
  misc_feature: GYAE6OF02JO6L0.45.36.D03.1.454.CMB.1.raw
  modified_base (196)..(196): a, c, t, g, unknown or other
  misc_feature (196)..(196): n is a, c, g, or t
  modified_base (385)..(385): a, c, t, g, unknown or other
  misc_feature (385)..(385): n is a, c, g, or t
tcagacgcgatcgacacgaccggtgctcgatttagctgcgtcacgatctctcttgggaggaactgctcagttaggacccagagggaaccatggaagcccagctcagcttctcttcctcctgctactctggctcccagataccaccggaaaattgtgttgacacagtctcaggcacctgtctctgtctccagggganacagcccacctctcctgcacgggccaggtaggacgtgtctaggtaacgtacttaggcctaggtaccaacacggaaacctcggaccaggcctccgagctctcacgtcaagtcgatcgctactaccaacgtacggtccctggccttacccaaggacgtacgggttccgtacggccgtagggttcggggtcncgggggtaacacggtacggtttccaaccgttccgtactacccgggtcagtaccgtacgtcccggtaggacggtcctagacgtttagtacgttttacggcgtttaaacggttttccgttccgacggtttacctacggacgtaccgggtttccggtaccccggttcccgaacccgggttcccttacccgtaccgttacggtttcccggggacgggggtacccggtagggtccggaaggtaccgtcgggacggtaaccggtccgtagggtccggacggttacgccgaacgtcgttccgttagtcccttacgtctacccgg

SEQ ID NO: 111959 - DNA, 597 bp, Homo sapiens
  misc_feature: GYAE6OF02GKS30.45.36.D03.1.454.CMB.1.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
  modified_base (422)..(422): a, c, t, g, unknown or other
  misc_feature (422)..(422): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacacgaaacctggaccaggcctcccgaggctccgtcatccatgatcgacatccaacgacgggtccctgggccgtacccgaggactacggttccgnggctaggtcgggtcgtgggacaggtacgttcacttcgtaccgaccgtcacgccacgccgtaggacnccgtgattgtattttgacttacgtttacttcttgtactagcacgtccgttccgccgccgccgcttccgtccggtttccggggccgggggtaaccgtgggtaggacgtacgtggacggtaccggtaagtcggtcgggcgtcgaccgaccgtgtacgtcgttacttcctacttcccg

SEQ ID NO: 111960 - DNA, 580 bp, Homo sapiens
  misc_feature: GYAE6OF02IQTQ2.45.36.D03.1.454.CMB.1.raw
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccacccctctcctgcagggccagtaggagtgtcagtaagtactaggctggtaccaacagaacctggccaggctccaggctcctcatccaatgatgcatccaacgcgggtccctgggcctccaagacgtaggttccgngctaggtgggtctgggacnggtacttcacgtctccgaccgtgacgtcagccgtaggacgtcctgatgtattttcgacttacgtttcttcgttgtcagctacgtccgttccgccacgccctctcctacggttcgggaccgggggtacgcgggtaggacgtagtacggacgaacggtaacgtgggtcggtacgtcggacctaaccgtgttaccgttacggttccttacgcgtttaccccg

SEQ ID NO: 111961 - DNA, 711 bp, Homo sapiens
  misc_feature: GYAE6OF02JUG7Y.45.36.D03.1.454.CMB.1.raw
  modified_base (465)..(465): a, c, t, g, unknown or other
  misc_feature (465)..(465): n is a, c, g, or t
  modified_base (551)..(551): a, c, t, g, unknown or other
  misc_feature (551)..(551): n is a, c, g, or t
tcagacgcgatcgacacgaccggtgctcgatttagctgcgtcacgatctctcttggggaggaactgctcagttaggacccagagggaaccgatggaagcccagctcagcttctcttcctcctgctactctggctcccagataccaccggaaaaattgtgttgacacagtctccaggccacctgtctctgtctcgagggagacagcccaccgtctcctgcacgggcccagttacgggagttcgtcagttaacgtacgttaggcttcgggttaaccaaacgtaaggaaaccccgtggaccgaggtccctacccgtaggtcctcccgtcagtcccagttcggactcgctaactcccaaacgcgggtccctcgggccgtaccccgagtaaccgtaccggtttcggtacggccgtaacggtcggggtactcggggaagacgtacggtttccacgttctaccgccggtacncgggtacaccgccgtacggacgtccgtacggtatacggttactttaacggtgttaacgttttccgttacgtttaccgtcggtaccncggtacgtcggttcccgcgtacccgtccgtacctccggtacgtttcccggggacgggtaccggtagggtcggaaggttcgaacggtggtaccgtaacggttggtacggtccgtcggaccgtacggtaccgttagtccgtttacgttccgtacgttccccg

SEQ ID NO: 111962 - DNA, 771 bp, Homo sapiens
  misc_feature: GYAE6OF02GRUVK.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagccaccctctcctggggggggcagggccagtaggagtgtcagtaagtacttaggctggtaccaacagaaacctggccaggctcccaggctcctcatccatgatgcatccaacgacgggtccctggccgtcccagacacgggttccgtggcagtggggtctggggactaggagttcactcctcaccggtcacgtcaacggcccgttagggaacgtcccgtgtacgttacggtaacttttttcgggacctttaacgggtttttaaccctttcggttacgttaccgtacggtaccttaacggggttcccggttttaccccggaccccgtaacccgggtccccggttaccgtttacccggttaaccgggtttttcccgggggggggaacccggggggggttaacccgttaacggggggggttacgggaaacggggtacggtttacggggaaacccgggttaaccgggtaaaccggttggggttaccggggtaccgttaccggacccgttaaacccgtacggttttccggtaccgggttttccgtttacccgtaacgttttccccccgg

SEQ ID NO: 111963 - DNA, 665 bp, Homo sapiens
  misc_feature: GYAE6OF02J2C7J.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggacacagcccaccctctcctgcacgggccaggtaggagtgtcaagtaagtacttaggctggtaaccaacagaaacctggccaggcctccgaggcctcctcgactccatgatcgacactaccaacgtcgggtccctagggcccgtaccccaggtaccgtacgggttccgtggacgtagggttcgggtcgtaggggacctaggtacgttcaccgtcgtccgacccggtcacggtccacggtcccgtggaccgtcctaggacttggtacttttcggctttacgtttaccttgtcggttcacgtccgtacggttcccgttcccgaccgccgtcccgttctaccggttccggttccggggggccggggtaccgtaggggttcgaacggtcgtaggaccggtaacggtacggttcggtacggtccgtagtacccgccttaggtccgttcggtacctttccgacctttcccg

SEQ ID NO: 111964 - DNA, 859 bp, Homo sapiens
  misc_feature: GYAE6OF02H36YH.45.36.D03.1.454.CMB.1.raw
  modified_base (161)..(161): a, c, t, g, unknown or other
  misc_feature (161)..(161): n is a, c, g, or t
  modified_base (185)..(185): a, c, t, g, unknown or other
  misc_feature (185)..(185): n is a, c, g, or t
  modified_base (282)..(282): a, c, t, g, unknown or other
  misc_feature (282)..(282): n is a, c, g, or t
tcagacgcgatcgacacgaccggtgctcgatttagctgcgtcacgatctctcttgggagctctgggagacgagccagcactggaagtcgccggtgtttccttcggtgatcatcactgaacacagaggactcaccatggacttgggctgacctgggtttccngttgctctttagaggtgtccagtntcaggtgcaggtggtggagtcggggggagtcgttggtccaggcctggggacgtccctggacgtctctccgttgtcggcacggtcctcgtggatttcncccctgtaagttaaccttttcgggtttaccaacgttcgggtaccccaccgtaggtttaccccgaggtaccgtaacgggggtcctaggggtacgggttcgggtaccgggcccctttacgacggttttacccggaagttacgtaacgggaacgttagggacggtaaacgcccctttaagaccgaaacgggtccgtaccggttacggggaaaccgggggtcccggtcctttaaccgaaccccgtaacgttcccgtaccccgtaagggtaaccgtaaacggttaaacctttaaccggaaacgtaaacgtttacggttaccctttaccggttttacgtttaaccgaaaacgttacgtaaaacgttacggtacccgtgggttaaaaccgttaggttacggtaacggtaaccgtaaccggtttacgtaacggttacgttaacgttttaccgacggtttacgggtaacccgggttaaccggggtaccgttaaacgttcgttaaaccgttcggtaaacgggtttccgtttaagggtttaccgggtttaaacgtttaaccgggttacttaaccccggtttaaaaccg

SEQ ID NO: 111965 - DNA, 652 bp, Homo sapiens
  misc_feature: GYAE6OF02ICLLV.45.36.D03.1.454.CMB.1.raw
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcacctgtctctgtctccgaggggagacagccaccctctcctgcagggccagtaggagtgtcagtaagtacttaggctggtaccaacagaaacctggccaggctcccgaggctcctcatccatgatgcactccaacgaggtccctggccgtccagacnggttccgnggcaggtggtcgtgggacaggagttcacgtctcaccgtcagcacgccgtggacgccgtgacgtgttatttgactagttttaccttcgttcgtcgacgtcgtacgtccggtttaccgccgtaccggtccgtccgttaccgttacccggttttccgggggaccgggggggtaacccgtacgggggttcggggtaacggtacgggttacggaaccggggtaaccggtaaaccggtcgggttcggggtccggttcggtacccgtaacccggtacgttcccgtttacggtttacccggttcctacgtttcccccgg

SEQ ID NO: 111966 - DNA, 664 bp, Homo sapiens
  misc_feature: GYAE6OF02GMJ4H.45.36.D03.1.454.CMB.1.raw
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggactttgggctgacctgggttttcctcgttgctcttttaagaggtgtccagtgtcaggtgcaggtggtggaggtcggggggaggcgttgtccagccgtgggacggtccctgagactctcctgtgcagcctctggattcctccctctagttaacttttggtttacccacgtcggggtcccgccgtaggttcccaagggcaacgggggctgggaggtcggggtcggcccctcgtagtttcccggaaagtagtacggaagtgaaggaacggcctacgtcgaagaccgtccggtaggaacgggccctcgtttaccaccgtactaccgtccaagacgaactaacgttaccgaaagtaacttcgtacctttcgttttacgtactaaatagtaaatacgtaccgtagtagtagttaggacgacgtacgttcgttagtcttacgtttcgtgttcgaccggtaggggtactaacgttcgttagttagtacggttcgttcgggttacgttaggtacgttaacgtaccttaaaccg

SEQ ID NO: 111967 - DNA, 590 bp, Homo sapiens
  misc_feature: GYAE6OF02GV0OS.45.36.D03.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
  modified_base (453)..(453): a, c, t, g, unknown or other
  misc_feature (453)..(453): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggcctccccaggctcctcatccatgatgcatccaacgacgggtcccnggccgtcccagacgacggttccgtggcaggtcgggtcngggacaggtagttcacgttcgcaccgtnacgcacgcctggacgcctgatgtagttttgcttagtttacttcgtgtcagtcgagtccgttccnccgaccgccgtctccgtacggtttcggggccgggggtaccgaggggtggacgtagtaggacggtaccggaaacggttgggtacggccgtacggacctaccgtattaccggttgttacctttaccgtactttccccgg

SEQ ID NO: 111968 - DNA, 819 bp, Homo sapiens
  misc_feature: GYAE6OF02IL0S9.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaaccggaaaattgtgttgacacagtctccaggcaccctgtctctgtctccgagggagacagccaccctctcctggcgacgggcctaggtaggagtcgtacaggttaagtacttaggcttacggtaaccaacgacgaaaccgtggaccgtacggccgtacccgaggtccttaccgtcaacgtcccgagtcgaacgttcgacctaccgttaaccaaccggtacgggtcccgttcggacccgttacccgaaggtaccggtacgggtttccggacggtaccggtacgggttcggggttaccgtacggggactacggtacgttaccgtacgttaccgtaccgtaccggtacacggtaccgtacggtacctcgggaaccgtcccgtaggtaacttcgttaacgtttcggaactttacggttttacccgttcggttacgtaccgtaacggccgtaacggttcccggtcccgtaaccgtaccggtccgttacccgttaccgtaccgggttttaccgggggaacccgggggttaccggtaacgggggttaccgaacggtaccggttacgggaaaaccggttccggtaaacgttccgggggttaccgtaccggttaccggtaaccgtacccggttacgtacccgttttacgggttaccctttaccgtacccgtttaccccggg

SEQ ID NO: 111969 - DNA, 737 bp, Homo sapiens
  misc_feature: GYAE6OF02ICNNW.45.36.D03.1.454.CMB.1.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (355)..(355): a, c, t, g, unknown or other
  misc_feature (355)..(355): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccgagggganacagccacccctctcctgcagggccagtaggagtgtcagtaagtacttaggctggtaccanagaaacctggccaggctccgaggcctcctcactccatgatcgacactccaacgtcgggtccctggccgtccgagtaccgtacggttccggnggacgaggttcgggtcgtaggggacctaggtacgtttccacgttccgtacctaacccggttcgaacgtccgaccggtaccggtagggaaccgtcccgttaggtacgtttcggttaagtttttcggacgtttaacggtttttacctttcgttacgttacgacgttacgtaccggttccggtttcccgacccgtaccggtcccgttaccgttcccgttaaccggggttttccgggggacccggggggtaccgtagggggttacggaacgggtagtacgggaacggtaccggttaacggttgggtaccgggtactaccgggtacctaaccggttacgtttccgttaccggtttcctttaccgttacccgttcccgttacccccgg

SEQ ID NO: 111970 - DNA, 549 bp, Homo sapiens
  misc_feature: GYAE6OF02FMDPV.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccagccaccctgtctttgttccaggggaaagagccacctctcctgcagggccagtcagggtgttaacagctacttagcctggtaccaaacaaaaacctggccaggctcccaggctcatcatctatgacgcatcgaacagggccacgtggcatcccagcccaggttcagtgcaggtgggtctgggacaggacttcactctacaccatcacgcacgcctggaccctggagtattttgactagtttactcgtgtcagctagtcgttccgccacgcctctctacgtttcggggccgggggtaccagggggtgacgagtcgagtacggaactggtcggctacggcacctagtctcggttccttacacttccgttcccgaccg

SEQ ID NO: 111971 - DNA, 780 bp, Homo sapiens
  misc_feature: GYAE6OF02IHICC.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcagggtggtggaggtcggggggaggcgttgtccagcctgggaggtccctgagactctcctgtgcagcctctggacttctcccctcagttaacttttggtttcccacgttcggggtcccgtccctacgggtttccgaggcgaagggggcctgggaggtggggtcggcccttacgtacgttttaccggaaaggtacgttaggaaggttgaaggaaacgggcccttaacgtcgaagtaccgtccgtagggaacgggtcccgtactttaccaccctactacctcccgaaggaacgaactaaactttacccgaaagtaaacgttcgtttaccctttaccgtttttacgtaactaaaagttaacgtaaacttaacggtacccgttaggaacggttaacgggtttacggaacgggtaacgtaaccggttaccgttaaggtttaccttaacgtttttcgtttacggttcggtaacccgggtaacggggggtaacctaacgttaccgttaacgttacggttaacggttccggttttacggggttttacccgttaaggtttaacgtttaaccgttaaccgttaaaacccg

SEQ ID NO: 111972 - DNA, 670 bp, Homo sapiens
  misc_feature: GYAE6OF02JNOIT.45.36.D03.1.454.CMB.1.raw
  modified_base (202)..(202): a, c, t, g, unknown or other
  misc_feature (202)..(202): n is a, c, g, or t
  modified_base (465)..(465): a, c, t, g, unknown or other
  misc_feature (465)..(465): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgccaccctctcctgcgagggccagtaggagtgtcagtaagtactaggctaggtaccaacacgaaccgtggaccacggcctaccgaggtcctccgtacacgtccagtgatcgccacgtacccaacggtaccgggtcccgtcgggtcccgtacccgtacggtaccgtacgggttccgtaggacgtagggttcggggtcgtacggggaactacggtacgttcaccgtccgtccgaccggtcacggaccacggtccgaggacnccgttagatcgttatttcggacttacgttttacgttcgtacgtacgcgtctacggtccgttacccgcgtacccgtcccgtcttaccgttacgggttacccgggggaccggggtaaccggtagggtacggtaacgtagcggaccggtaacggtcggtggtcgacgtcgaccgtacgtcgttaccgtcgttacctacgtccgtcccg

SEQ ID NO: 111973 - DNA, 242 bp, Homo sapiens
  misc_feature: GYAE6OF02GFVOK.45.36.D03.1.454.CMB.1.raw
  modified_base (232)..(242): a, c, t, g, unknown or other
  misc_feature (232)..(242): n is a, c, g, or t
tcagacgcgatcgacacgaccggtgctcgatttagctgcgtcacgatctctcttggggcagagctctggggaggaactgctcagttaggacccagacggaaccatggaagccccagcgcagcttctcctcctcctgctactctggctcccaggaactgtggctgcaccatctgtcttcatcttcccgccatctgatcgatcgcgtctgagcgggctggcaaggcgcagtagnnnnnnnnnnn

SEQ ID NO: 111974 - DNA, 596 bp, Homo sapiens
  misc_feature: GYAE6OF02FUT9S.45.36.D03.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaanagaaacctggaccaggcctcccaggctcccnactccatgatgcatccaacgagggtcccctggcctcccaggaccagggttccgtggctagggtcgggtctggggacaggtacgttcacttctacaccgtcacgcacgccgtggacgcctgacgttgtattttcgcttaggtttacctttcgttcgtcgagtcacgtccgttcccgccgacgtcccgctccgtaccggtttccggggccggggtaccgacggggttcggacgtacgtggaggtaacggtacgtcggtcggcgtcggacctacgacgtccgttacgtccttccgtactttcccg

SEQ ID NO: 111975 - DNA, 570 bp, Homo sapiens
  misc_feature: GYAE6OF02HY13I.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgacatcccaagacgggtccctggccgtcccagactacggttccgtggcaggtgggtctggggacaggtgttcactcacaccgtcacgcagccgtggacgtcgtgagtgtatttgcttacgtttacttcgtgtcagtctacgtccgtccgccgacgccgctcgtaccgtttcgggccggggggtaccgagggtacggagtagtcggaggaccggaacgttggtcggtcgtcgaccgtacctacgtccgttacggttcttactcgttcccg

SEQ ID NO: 111976 - DNA, 621 bp, Homo sapiens
  misc_feature: GYAE6OF02GJD6F.45.36.D03.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcagggccagtaggagtgtcagtaagtacttaggctggtaccaanagaactggaccaggctccagctcctcatctattatgcataccaagacggccacgtgacactcccagacgtagttcaggtgacaggtggtcgtagggactaggacttcactctacacctataccgagacagacgtcggacgcgtagaagtagttttcgacgtagttgttaattacgtacgtaactaaacgtacgttacgttacggttacccttccgttaccgtttccgttccgtttcccggtacccgttacgggtaaccgtaaacggttacgtacgtaacgtaaccgtaaaccgtaacgttacgggtacgtacgttacgacccgtaccgtacttaccgttacgttccgttacctaaccg

SEQ ID NO: 111977 - DNA, 611 bp, Homo sapiens
  misc_feature: GYAE6OF02JWS1Z.45.36.D03.1.454.CMB.1.raw
  modified_base (200)..(200): a, c, t, g, unknown or other
  misc_feature (200)..(200): n is a, c, g, or t
  modified_base (436)..(436): a, c, t, g, unknown or other
  misc_feature (436)..(436): n is a, c, g, or t
  modified_base (465)..(465): a, c, t, g, unknown or other
  misc_feature (465)..(465): n is a, c, g, or t
  modified_base (527)..(527): a, c, t, g, unknown or other
  misc_feature (527)..(527): n is a, c, g, or t
  modified_base (596)..(596): a, c, t, g, unknown or other
  misc_feature (596)..(596): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtactaggctggtaccaacagaaacctggaccaggcctcccaggcctcctcactccatcgatcgacactaccaacgtacgggtcccctaggcccggtacccagaccgtacggttccgtgggctagggtcgggtcgtagggactacggtagtttaactcgtaccaccggtcaggaccacggtccgtagggactccnggacttgtattttgccttagtttctcgtntcgagtcgtacgtccgtccgacccgacgcccgtctccgtaccggtttcgggaccggggtacnggggtacgagtacgtggagaccgtacggtcggtggacgtcgaccacgttacgtccgttacgtccttacnccgttcccgtacccg

SEQ ID NO: 111978 - DNA, 604 bp, Homo sapiens
  misc_feature: GYAE6OF02I2UCJ.45.36.D03.1.454.CMB.1.raw
  modified_base (351)..(351): a, c, t, g, unknown or other
  misc_feature (351)..(351): n is a, c, g, or t
  modified_base (393)..(393): a, c, t, g, unknown or other
  misc_feature (393)..(393): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtagtacttaggctggtaccaacagaaacctggccaggcctcccgaggctcctcatccatgatgacactccaacgacgggtccctgggcctacccgagaccgtaggttccgnggcgtaggtgggtctggactaggacgttcactctcaccgtcncgtcacgtcgtcggacgcgtgagtgtatttcgcttacgtttcttcttgtcagtcacgtccgtccgccgcgtcccgctccgtaccggtttccggggaccgggggtaccgaggggtacggaggtacgtaggacggtaaccggtaacggttaggtcgggacgtcggaccgtacccgtacgtttccgtcggtttaccttccgtacgtttccccgg

SEQ ID NO: 111979 - DNA, 511 bp, Homo sapiens
  misc_feature: GYAE6OF02FIWUZ.45.36.D03.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccagccattctgtctctctctccagggganacagccaccctctcatgcagggccagtcagagtattagaacatacttggcctggtatcaatacaagcctggccagggttcccggntcctcatctatgatgcttccagcagggccactggcatcccagccaggttcaggtggcggttgggttggcacagacttcactctcacaactcagcacgccctccaacctgaagtactttgctagtcttattactgtactaacagtacgtacagtattgccgtctctacgttcggcggtacggaccgaaggtggagatcgaaacgactggtggactggctacatcg

SEQ ID NO: 111980 - DNA, 680 bp, Homo sapiens
  misc_feature: GYAE6OF02G6VJ3.45.36.D03.1.454.CMB.1.raw
  modified_base (367)..(367): a, c, t, g, unknown or other
  misc_feature (367)..(367): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagccaccctctcctgcagggccaggtaggagtgtacagtaagtacgttaggctggtaccaacagaaacctggccaggcctccgaggctcctcatccatcgatcgcactcccgaaacgtcggggtccctgggcccgtcccgaaggaccgtacgggtttccgnggcgtacggtgggtcgtagggacctaggtacgttcacgtcgtccgtaacgtcgacgcgacgtccgtaggcgtccgtgacgttcgtagtttcggacgtttacggttttacctttcgttcgttaccgtacgtcgtacggtccgttcccggtacccgaccggtcccgtaccgttcccgttaccggttttccggggaccggggggtaccgtacggggtacggaggtacgtacgggaacgtaacggtaacggttcggtacggtcgtacggtaccgtaccgttacgtccgttacggttctttaccgtcctttaccccgg

SEQ ID NO: 111981 - DNA, 742 bp, Homo sapiens
  misc_feature: GYAE6OF02JUJXJ.45.36.D03.1.454.CMB.1.raw
  modified_base (177)..(177): a, c, t, g, unknown or other
  misc_feature (177)..(177): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (450)..(450): a, c, t, g, unknown or other
  misc_feature (450)..(450): n is a, c, g, or t
tcagacgcgatcgacacgaccggtgctcgatttagctgcgtcacgatctctcttggggaggaactgctcagttaggacccagagggaaccatggaagccccagcctcagcttctcttcctcctgctactctggctcccagactaccaccggaaaattcgtgttgacacagtctaccnggcacctgtcctctgtctccgagggacgacagccaccctctccgtgccacgggccaggtacggagtgtacgagtaagtacgttagctaggtaaccaagacgaaaccgtggacccaacggcctccccgaagggtcccttcccgtcaaacgtccctaagtgaactgaccacgtacccaacggtacggtcccncgggacctccacgtaacgtcggttccgngaccgtaggtcgggtactcgggacacggtgttacccacttaccgtccaaccggtnaaccggtccgacgtccgtacggaccgtcgtacggtacgtcgtttaagtttccggacttacgtttaccgtttcgtacgttcgtacgtacggtaccgtccggttttccgacccggaccggtcccgtaccgtttcccggtaccgttttaaccggggggcccggggttaacccgggtaggggtaccggttaacggaggtccggaacgggtaaccgttaccggggtcggttaggtcccggacggtaccctacggtaaccgttcggttaccgttacggttacgtaccgtttcccccgg

SEQ ID NO: 111982 - DNA, 666 bp, Homo sapiens
  misc_feature: GYAE6OF02JNNNT.45.36.D03.1.454.CMB.1.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccacctctcctgcagggccagtaggacgtgtcagttaacgtacttaggctacggtaccaacagaaacctggaccaggcctcccgaggtcctccgtcatccatggactgcataccaacgacgggtccctaggccgtccagcgtacggttccgnggcgaggtggtcgtgggacagtacgtcacgtcctacgaccgtcgaagccgtaacgcccgttgggacgtccgtacgacgttagtacgtttacgtcgttaacggttttccttacgttacgtacgtaacgtccgtaaggttccgttccggacccgtaccggtcccgtaccgtcgttaaccggttcggggaccgggggtaccgtaggggtacgggtaggtacgtacggtaaggtaccggtaacgttcgggtacggtccgtacggtaccgtaacgtacgttccgttaccggttacgtcctaacgttccccg

SEQ ID NO: 111983 - DNA, 607 bp, Homo sapiens
  misc_feature: GYAE6OF02FWMO7.45.36.D03.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtaggagtgtcagtacgtacttaggctggtaccaanagaaacctggccaggcctccgaggcctcctcactccatgatgcatccaaacgtcgggtccctggccgtcccagacaggttcccgnggctaggtgggtctgggganaggtacttcactctcaccgtcagcagctagcgcctgatgtatttgcttagtttacttcttgtctagtcgtacgtccgttcccgacctaccggccgccgttccgttaccggtttccggggaccggggggtaccgtacggggtcggtaacgagttacggaagtaccggtaaacgttcgggtacggtcgttacggaccgtaccgtacgttccgttcggtttaccgttactaccgttccccg

SEQ ID NO: 111984 - DNA, 551 bp, Homo sapiens
  misc_feature: GYAE6OF02F03GA.45.36.D03.1.454.CMB.1.raw
  modified_base (263)..(263): a, c, t, g, unknown or other
  misc_feature (263)..(263): n is a, c, g, or t
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
  modified_base (375)..(375): a, c, t, g, unknown or other
  misc_feature (375)..(375): n is a, c, g, or t
  modified_base (473)..(473): a, c, t, g, unknown or other
  misc_feature (473)..(473): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaacctggccaggctccagctctcatccatgatgcatccaacgngggtccctggcctccagacaggttccgnggaagtgggtctgggacaggtagttcactctcacccgtnagcagccgtggacgcctgatgtatttgctagtttactctgttcagtcacgtccgtccgccaccgccgtctcgtaccgtttccggggccgggggtaccnggggtggagtacgtagacgacggacgtggtcggctggcctacgacgttcgttcgttccttctaccgttccgttccccg

SEQ ID NO: 111985 - DNA, 656 bp, Homo sapiens
  misc_feature: GYAE6OF02I9M8P.45.36.D03.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccagggganacagccaccctctcctgcagggccaggtaggagtgtcagtaagtacttaggctggtaccaanacgaaacctggaccaaggcctcccaggcctcctcactccatgatgacatccaacgaggtcccctggccgtcccagacgtacggttccgtggcgtaggtgggtacgtgggacaggtacgttcgactctaccaccgtcaagccagccgtaggactcgtgatagtatttcgacttacgttttactcttggtacagtccgacgttccgttcccgacctacccggccgtaccgttaccgtaacggtttcccgggggaccgggggtaccgtaacgggggtccggtaacgtacgtacggtacggtaaccggtaaccggttggggtaaccgggccgttcgaccccgtaacgtacgtttccgttccggttacccttttcgaccgtttcccgttacccccgg

SEQ ID NO: 111986 - DNA, 777 bp, Homo sapiens
  misc_feature: GYAE6OF02GH0P1.45.36.D03.1.454.CMB.1.raw
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaacagaaacctggaccaggctccaggctcctcatccatgatgcactccgaacgtacgggtcccctgggcccgttacccgagtaccgtacgggtttcccggtcggtaccgtagggttcgggggttcgtacgggggaactagggtacgtttaccgaaccgtttcccgttacccgacccggttaccacggtaccctaacggtcccgttacggggaaccgtcccggtacggtagttacggttacttttttacggaccgtttaacgtttttaaccgtttccgttacgtaccgtacggtccgtaacggttccccggtttacccggcccccgtaaccggtccccggttcccgtttaccgttaacccggttttccggggggaccggggggttaacccgtacgggggtacgggacgtaggtacgggaacgggtaacccggtaacggttacgggtcgggtaccgtcggtacccgtaccgtacgttcccggttacggtttccttacccgtacgtttccccccgg

SEQ ID NO: 111987 - DNA, 670 bp, Homo sapiens
  misc_feature: GYAE6OF02I6DVV.45.36.D03.1.454.CMB.1.raw
  modified_base (334)..(334): a, c, t, g, unknown or other
  misc_feature (334)..(334): n is a, c, g, or t
  modified_base (394)..(394): a, c, t, g, unknown or other
  misc_feature (394)..(394): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacacgccaccctctcctgcgacgggccaggtaggagtgtccagtaagtacttaggctggtaacccaagaacgaaacctcggaccaggacctcccgaggcctccgtcaactccagtgactgcacgtccgaaacncgggtccctggccgtacccgagaccgtacggttcctaggcgtaggtcggtactgggaacngtacgttacacgtcgtcccgaaccgtcgaacgcgtaacgcgttacggacgtacctggtatcggttagttttcgacgttaacgttttaccgttcgttagttacccgtgtaccgtacgttcccgtacccgtacccgtacccgcccgttccgtaaccgttcccggtttacggggaccgggggtaccgtcgggtacggtagtacggtcgaccggtaacgacgttcgggtcgtaccgtcgaccgtaaccgtactcggttacgtccgttaccgtacgttccc

SEQ ID NO: 111988 - DNA, 667 bp, Homo sapiens
  misc_feature: GYAE6OF02GYCR9.45.36.D03.1.454.CMB.1.raw
  modified_base (352)..(352): a, c, t, g, unknown or other
  misc_feature (352)..(352): n is a, c, g, or t
  modified_base (407)..(407): a, c, t, g, unknown or other
  misc_feature (407)..(407): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtagagtgtcagtaagtacttaggctggtaccaacagaaacctggccaggcctccgaggcctcctcatccatcgatcgcactccaaacgcgggtccctggcccgtcccgagtacgacggttccgnggcaggtgggtctggggacagtacgttcactctcaccggtcagcagccgtaggcnccgtgagtgtagttttgacgtagttttacttcgtgttacagtctacgtccgttaccgcccgtaccggcccgtacgttcccgttaccggtttccgggggaccggggggtacccgtagggggttacgggaacgtacgggttacgggtaacggtaaccgggtaaccgtttcggggtaccgggtaccggtttacggaccccggtaacccttaacggtttcccggttacggtttacccgttttacccttacggtttaccccccgg

SEQ ID NO: 111989 - DNA, 713 bp, Homo sapiens
  misc_feature: GYAE6OF02HP2KL.45.36.D03.1.454.CMB.1.raw
  modified_base (206)..(206): a, c, t, g, unknown or other
  misc_feature (206)..(206): n is a, c, g, or t
  modified_base (344)..(344): a, c, t, g, unknown or other
  misc_feature (344)..(344): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccgaggccaccctgtctctcgtctccgagggganacacgcccaccctctcctgcgacgggccaggtaggagtcgtactaagtaacgtacttaggctacggtaaccaaacgaacgtaaaccgtcgggaccaacggccctacccgaaggcctacccgtacactaccagtagtancgacactaccgaaacgtccgggtccctcggaccgtacccgaaggtaccgtacgggttccgaggtacgtacggggttcgggtccgtacgggggaactacggtacgttacctaaccggttcctaccgtaacccgttcgaacgtcccgtaacggtcccggtagggaactccgttaggtacgtttacggttagttttacgacgttttaacggttttaccttcgtaggtaccgaatccggtaacgtccggtacccgccgtaccgccgtctccggtaccggttacgggggcggggtaccgtagggtacggatacgtggaacgtacgtacggtgtcggcgtacgaccacgtctacgttcgtactcgtaccttcccg

SEQ ID NO: 111990 - DNA, 735 bp, Homo sapiens
  misc_feature: GYAE6OF02IEOWY.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcgacgggccagtacggagtgtacagtaagtacttaggctaggtaaccaacgagaaacctggaccgaggcctaccccgaggcctcctcactccatagatgcactccaaacgcgggtccctagggccgtacccaagaccgtacgggttcccggtggccgtagggttcggggtccgtaggggtacctaagggtacgttccaactccttacccgaccggttaccaaggccgtaccggtaccggtcgggtaaccgtcccgttaggtagttaggttacttttcggtaccgttacgtttttaccgttccgttgtaccgtaggtccgtaacggtcccgttacccggcccgtacccggtcccgtccgtacccgtaccggttttacccgggggaccgggggtaccgtagggggtacggtaacggtacgtaggaacggtaacggtaacggttcgggtacggtacgtacggtaccgtaaccgtacggttaccgttcggtttacctttacccgtactttacccccgg

SEQ ID NO: 111991 - DNA, 701 bp, Homo sapiens
  misc_feature: GYAE6OF02IHAHH.45.36.D03.1.454.CMB.1.raw
  modified_base (287)..(287): a, c, t, g, unknown or other
  misc_feature (287)..(287): n is a, c, g, or t
  modified_base (409)..(409): a, c, t, g, unknown or other
  misc_feature (409)..(409): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgcttcttttaagaggtgtccagtgtcaggtgcaggtggtggaggtcggggggaggcgttgtccagccgtgggaggtccctgagactctcctgtgcagcctctggacttcctcccctnaagttaacttttcggtttccacgttcgggtcccgcctacggttccgaggcgaaggggctgggacggtggggtacgccctcgtacgtttccggaagtagtggaagtggaaggaacggcctacncgaaggtcgtaccggtaggaacgggcccgtcttaccaccgtactcctaccacgtaacgaacaacttaccaagtaaattcgttacctttcgtttttacgacctaaagtagtaaagtacgaccgttagacggtagttaggaacggtaaccgtacggttcgttacgttacgtttactttacgttacggtcgtacccgggtaacgggggtaacttacgttacgttaagttacggtacgtttccggtttacgggtttaccggtttaaggttaacggttaacgttaccgttaaacccg

SEQ ID NO: 111992 - DNA, 865 bp, Homo sapiens
  misc_feature: GYAE6OF02IIXTO.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggccacctgtctctgtctccgaggggacacacgcccacctctcctgcgacgggccaggtaggacgttcgtactaaggttaacgtacgttaggccttacggtaaccaaacgaacgtaaaaccgtcgggaccgaacgggtcctaccccggaagggtcccttacccgtactaaccttcccgtaatacggtaacttcggacctaacgtaacccgaaacgtaccggggttccccgtacgggtcccgttaccccgaacggtaaccgtaaccgggttcccggttagggaccgtaggggttccggggtacggttacgggaaccgtagggttacgttaccgtaacccgttcgtacccgtaaccgttcgaaacggtacgtcggtacccgtagggtaaccggtcccgttaggtactacgggttttaactttcgggtaacctttaggttttaccgttacgttaccgggttactaaacgggtccgtaacgggttcccggttacccggtaccggttaaccccggccgttacccggttacccgtttaaccggggtttcccgggggggtaacccgggggtaacccgggttagggtacggggtaacccgtaagggttacggaacgggtaaccggtacggttcgggtcgtaccgacggtaccctaccggacgtttccgttaacgttccgttaccgtcggtttaccccg

SEQ ID NO: 111993 - DNA, 585 bp, Homo sapiens
  misc_feature: GYAE6OF02FXR0O.45.36.D03.1.454.CMB.1.raw
  modified_base (459)..(459): a, c, t, g, unknown or other
  misc_feature (459)..(459): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccaggctcctcatccatgatgcatccaacagggtccctggcctcccagacctaggttccgtggctaggtcggggtctggggacaggacgttcactcctcaccgtcacgccaacgtcgagcctcgatagtagtttgtcgtacgtttacgttcttgtctacgtcacgtcgttcccgtccnccgaccggccttcgtaccgtttaccgggtccgggggaccgggtacggtgggtacgacgtagacggaacgtacgtacggtggtcgtcgacgtaccgactcgttcgtcgtttctacgtccgttccccg

SEQ ID NO: 111994 - DNA, 772 bp, Homo sapiens
  misc_feature: GYAE6OF02GR3HI.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccaccctctcctgcagggccagtaggagtgtcagtaagtactaggctaggtaccaacaagaaacctggaccgaggcctcccgaggtcctcctcactccatgatgaccactacccgaacgtaccgggtcccgtcggacccgtacccgaacggtaaccgtaccgggtttccggtacgggccgtaggggttcggggtcgtacgggggaaccgtaggtacggttccaaccgttccgtaccctaacccggttacacggccacggccgtacgggacggtccctggtaacgttggttaattttcggacctttacgttttactttcgttcgtacgtacgtaccgtacgtacccggtttcccggaccgtaccggtacccgttcccttaccgggttcccgggttttaccgggggggaccggggggttaccgtaaaggggggttcggaacgggtacggttacggggaaccggtaaccggttaacgggttacggttacgggaaccggttacggtaacccggtaacccgttcggttaccgtttaccggttacccttttacgtaaccctttcccccgg

SEQ ID NO: 111995 - DNA, 703 bp, Homo sapiens
  misc_feature: GYAE6OF02GMQK8.45.36.D03.1.454.CMB.1.raw
  modified_base (263)..(263): a, c, t, g, unknown or other
  misc_feature (263)..(263): n is a, c, g, or t
  modified_base (415)..(415): a, c, t, g, unknown or other
  misc_feature (415)..(415): n is a, c, g, or t
  modified_base (693)..(693): a, c, t, g, unknown or other
  misc_feature (693)..(693): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggagacagccaccctctcctgcagggccagtaggagtgtcagtaagtacgttaggctaggtaccaanagaaacctggaccaggctcccgaggctcctcatccatcgatgaccactccaacgacggtccctggcgtcccagacgtacggttccgtggctaggtcggtctcgggacagtacgtcacgtcctctaccgtcgacgcacggtcccgtaggaccnccgttaggacttggttaactttttcggaccgtttaacgtttttacccgttttcgtaacgggtttcctaagttccgtaacgggttcccggtttaccccggacccgtacccccgggtcccgttaccgtttaccccgttaccgggttttcccgggggggacccgggggggtaacccgttaggggggttaccgggtaaggtacggtacggtaaaccggtaccgggtaacggttacgggtacgggtcgtacgaccgaccgttaggtccttcggtacctttacnctttccccgg

SEQ ID NO: 111996 - DNA, 705 bp, Homo sapiens
  misc_feature: GYAE6OF02GM2SQ.45.36.D03.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (450)..(450): a, c, t, g, unknown or other
  misc_feature (450)..(450): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaattgtgttgacacagtctccaggcaccctgtctctgtctccaggganacagccacctctcctgcagggccagtaggacgtgtcagtaagtacttaggctggtaccaanagaaacctggaccagctccccaggacctccgtcactaccatcgactgcctatcccgaaaacgtcgggtccccgtggcccgttacccgaacgtaccggtaacgggttcccggtacggcgtacgggtcgggggttaccttagggggaacctaagggtacgtttaccgtaaccgtctaccgacccggttanaacgtcgtacggcccgttacggacgtccctaggtacgttaggttaattttccggacgttacgtttaacgtttccgtcggttacctacggtcgaacgggttccgttcccgacgtaccgcccgtctaccgtaccggtttccggacggggggtaccctaggggtacgtacggtagtacggtacggtaaccggaacgtcggttacggccgttacggacctaccgtacgttcgttacggtacctttcgtacttaccccgg

SEQ ID NO: 111997 - DNA, 708 bp, Homo sapiens
  misc_feature: GYAE6OF02HIK6Z.45.36.D03.1.454.CMB.1.raw
  modified_base (203)..(203): a, c, t, g, unknown or other
  misc_feature (203)..(203): n is a, c, g, or t
  modified_base (321)..(321): a, c, t, g, unknown or other
  misc_feature (321)..(321): n is a, c, g, or t
  modified_base (448)..(448): a, c, t, g, unknown or other
  misc_feature (448)..(448): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcctaccctctcctacgcgaacggggccctaggtaaggagtgtcaaggtaaagtacgttaagggcttggtaacccaagacggaaaacctggccaaggcctacccgaggcttccntaactccaatcgatcgacactccaaacgcgggtccctaggcctaccgagctagggttccaggcctagggtcggctaggggacagtacggttcacgtcctacaccggtcaggtccagccttaggaccnccgtgtaacgtgtacgttttcggactaacggttttacttacgtcggttccgaatccggaagttccgttacccgggtcccgaaacccggtcccgttaccctaccgttaccggttttacccgggggtcccgggggggggaaaccttacggggtacggtaaggtcccggttaagggaacggaccgggtaacccggttaaggtcgttccgggacgttaccggacccttaacggttcttacgggtctttacgtacccgtttccgg

SEQ ID NO: 111998 - DNA, 231 bp, Homo sapiens
  misc_feature: GYAE6OF02F5M3Q.45.36.D03.1.454.CMB.1.raw
  modified_base (226)..(231): a, c, t, g, unknown or other
  misc_feature (226)..(231): n is a, c, g, or t
tcagacgcgatcgacacgaccggtgctcgatttagctgcgtcacgatctctcttgggttttgggggaagaggaagactgactgtcctcccaggagttcaggtgctgggcaccttgggcacgggggaggtgtgtcacaagatttgggctctgggcacagcggcctgggctgcctggtcaaggactacttcctcgatcgcgtctgagcgggctggcaaggcgcatagnnnnnn

SEQ ID NO: 111999 - DNA, 746 bp, Homo sapiens
  misc_feature: GYAE6OF02ITOSZ.45.36.D03.1.454.CMB.1.raw
  modified_base (198)..(198): a, c, t, g, unknown or other
  misc_feature (198)..(198): n is a, c, g, or t
  modified_base (358)..(358): a, c, t, g, unknown or other
  misc_feature (358)..(358): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctcaggcacctgtctctgtctccgagggngacagccacctctctgcgacggccagtacggagtgtcagtagtacttggctggtaaccaacgagaaaccgtggaccacggctcccgaggcctcgtcactccgatcgatcgcaacgtccaaacgtcgggtccctggcccgtaccacgacgtagggttccgnggctaggtcgggtactcgggactagtacggtttacacgttccgcgtaaacccggttcgaaccggccgtaacggtcccggtacgggtacgtcccggttagtaaccggtttgttaacgttttcggtaaccgtttaacgtttttaccggttcgttacggttaccgtacgtacgttaccgggtcccgtttaccccggaccgtacccggtcccgttaaccggttccgttaaccccgggtttcggggacccgggggggttaaacgtaccgggggtacgttaacggggtactacggggtaaccgtaacgggtaaccgttgggttaccgggtacgtaccggtaccgttaccggacgtttaccgttaccgtttaccgttccgtacccgtttacccgg

SEQ ID NO: 112000 - DNA, 736 bp, Homo sapiens
  misc_feature: GYAE6OF02GFXAQ.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccaccctctcctgcgacgggccaggtaggagtgtcagtaagtacttaggctacggtaccaacaacgaaaccgtggaccaggcctcccgaggcctcctcactccatgatgctactaccgaacgtcgggtccctgggcctacccgacggaccgtacggttccggtggacgtacggtcggggtcgtcgggacgacggtacgttcacttctaccgaccgtcgacgcacggtccgtaggacgtccgtaggtactggttactttcggactttaggttttaccttcggttacgtcgtacgtccgtaccggttcccgttacccggcccgtaacccggtcccgtacccgtttacccggttaccgggggttttacccggggggaccgggggggttaaccggtacggggggtacggtaacgggtacggttacgggaaccggtaaccgggtaacggttcgggttaccgggtaccgtacgggtacctaacccgttacgttaccgtttccggtttacccgttaccgtacccgtttacccccg

SEQ ID NO: 112001 - DNA, 729 bp, Homo sapiens
  misc_feature: GYAE6OF02IRNVL.45.36.D03.1.454.CMB.1.raw
  modified_base (209)..(209): a, c, t, g, unknown or other
  misc_feature (209)..(209): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccagggganacagcccaccctctcctgacgacgggccaggtaggagttgtcaagtaagtacgttaggctggtaccaacgaagaaccgtcggccagcctccaggcctcctcactccagttcgagtcgactaactccaacgtacggtccctacggtccgtacccgagtacgtacggtttcccgtggacgtacgggttgggtcgtaggggactaaggtacgtcctacgttcctaccgaccggttcacggtacgacggtacccgttgggaaccgccgttaggtaacgtttacggttaagtttttcggacctttacggtttttaaccgtttcgtcgttacgtacgtaccgtacggttcccgttccggacccgtaccgtccgttaccgtaccgtttacccggggttttcggggacccgggggtaccggtaaggggtacggtacggtacggttacgggaacgggttaaacccgaggtttaccgggagggttcctcgaaccggttacctaccggttacgttcgttacccgttaaccg

SEQ ID NO: 112002 - DNA, 785 bp, Homo sapiens
  misc_feature: GYAE6OF02I3969.45.36.D03.1.454.CMB.1.raw
  modified_base (199)..(199): a, c, t, g, unknown or other
  misc_feature (199)..(199): n is a, c, g, or t
tcagacgcgatcgacacgaccggtgctcgatttagctgcgtcacgatctctcttgggggaggaactgctcagttaggacccagagggaaccatggaagcccagctcagcttctcttcctcctgctactctgctcccagataccaaccggaaaattgtgttgacacagtctccaggcacctgtctctgtctccgaggganacacgccaccctctcctgaccgacgggccagtaggacgtgtcgagtaagtacgttacggctcggtaacaaccgaagaaaccgtggacctagggcctacccgaggcctccgacacgtccatgactgaccactaccaacggacgggttccctacggcccgtaccccgagtaaccggtacgggttccgtacgggaccgtacggggtggggttaccgcgggggtaaacctagggtactttacccggaccgtttccgtaacccgtaccgggtacgaccgtacggtacgccgttacgggaacgtcgacggtagtttcggttaaaccgttttgaaccgtttaacgtttttacccgttactacggttaccttacggccgtttaacgggtccccgttacccgacccgggtaacccttcccgggtccgtttaccgttaaccccgggtttcggggggaacccggggtaacccggttgggttaacgggacggtaagtccgggtaaacgggacggttacccggtaggtccggggtcttaaccggacccgtaacgtaggttccctttaccgggaccttttaccggtaccttacccccggg

SEQ ID NO: 112003 - DNA, 724 bp, Homo sapiens
  misc_feature: GYAE6OF02GTFHM.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgcagggccaggtaggagtgtcagtaagtacttaggctaggtaaccaacgagaaacctggaccaggcctccaggcctcctcactccatgatgactactccaacgacgggtccctgggccgtccagaccgtacggttccgtggactagggtcgggtacgtaggggactaggtacgttccacgtcctcgaccgtcacggtcacgtccgtagggaccgtccgtagtacgttacgttagtttttcggactttaacggtttttccttcgttaggttacccgtacggttacctacgggttaccccgtttacccgaacccgtacccgggttacccgtcccgtttaaccgtaccgggttttcccgggggacccgggggggtaacccgtagggggtacgggacgttaacggtacgggaaccggtaccgggtaacggttcgggtcgggtaccgtcggacccgtaccgttacggttccgttaaccggtttcctttacccgtacgtttacccccgg

SEQ ID NO: 112004 - DNA, 587 bp, Homo sapiens
  misc_feature: GYAE6OF02GHVP3.45.36.D03.1.454.CMB.1.raw
  modified_base (350)..(350): a, c, t, g, unknown or other
  misc_feature (350)..(350): n is a, c, g, or t
  modified_base (579)..(579): a, c, t, g, unknown or other
  misc_feature (579)..(579): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaaggcctccaggctctcatccatgatgcactccaacgtacgggtccctggccgtcccgaagaccgtaggttccgnggacgaggttcggggtctggggacaggtacgttcactctacgaccgttacagcacgccgtaggacgcctagagttgtattttcgacttaagtttaaccttcttacgtctacgctagtccgtttcccgccgaccgcccgactccgtacggttcgggccgggggtacgagggtgagtagtagaacggacgtaacgtggtacggctgacctacgtacttacgtgttccttanacttcccg

SEQ ID NO: 112005 - DNA, 765 bp, Homo sapiens
  misc_feature: GYAE6OF02H1Q0D.45.36.D03.1.454.CMB.1.raw
tcagacgcgatcgacacgaccggtgctcgatttagctgcgtcacgatctctcttgggggagctctgggagacgagcccagcactggaagtcgccggtgttcctttcggtgatcatcactgaacacagaggactcaccatggactttgggctgacctgggtttcctcgttgcttcttttaagaggtgtccagtgtcaggtgcagggtggtggaggtcggggggaggtcgttgtccaggccgtgggaggtccctgagactctcctgtcgcaggcctcgtggacttcctcccctctaagttaaccgttttcgggtttcccacgtcggggtccccgcctacgggtttccgaaggccgaaggggcctggggaggtggggtcggcccttcgtaacgtttccggaaagtaggtacggaagtggaaaggaacggccttaacgtcgaacgtaccgtccgggttacggaaacggggtcccctacgtttacccaacccgtacgttacccgtacccgaagtaacggaaacctaaaacgtttaccgaaaacggtaacttacggtttaccctttacgtttttacgaacctaaaagttacgaaagttacggacccttagggaggtaaggtttaggaacggtaacgtaaccgttacgttcggttacttagttttccgtaggtcggtcccggtaacggggggtaactacgttcggtaagttacggtacggtttccggttacgggtttaccggttaaggtttacgttaactacccttaaaccg

SEQ ID NO: 112006 - DNA, 621 bp, Homo sapiens
  misc_feature: GYAE6OF02F7GNX.45.36.D03.1.454.CMB.1.raw
  modified_base (201)..(201): a, c, t, g, unknown or other
  misc_feature (201)..(201): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctcaggcaccctgtctctgtctccgagggganacagcccaccctctcctgcagggcagtaggagtgtcagtaagtacttaggctggtaccaacacgaaacctggccaggctaccccgaggcctcctcactccatgatgcactccaagcgggtccctggccgtaccagacgtaggttccgnggacaggtcggtcgtgggacngtacgtcactctcgaccgtnacgcagccgtaggactcgtagagttgttatttcgacgttacgttttacttcgtcgtacgtacgtacgacgtccgtttccgacccgtaccggtcccgtaccgttaccgttaccgggtttccgggggcccgggggtacgtacggggtagggacggtagtcggaacggtaacggtacgtaggtcgggtctcggacccgtacgtcgttcgtacggttccttacgtacgtttcccg

SEQ ID NO: 112007 - DNA, 801 bp, Homo sapiens
  misc_feature: GYAE6OF02JMJMJ.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtcctccaggccaccctgtctctcgtctccgagggacgacacgcccacccttctcctgccgacgggccaggtaggagtcgtacgaagttaacggtacgttaggctacggtaaccaaagaacgtaaaccgtcggaccgaacggtcctacccgacggtccttacccgtacgtaaccttaccgaacgtcgaacgtcgaccgtaacgttacccgaaaccggtaccggggttcccctacgggacccgttacccgaaaccgggtacggtaaccgggttccggtacggacggttaacgggttccggggtacgtacggggaaccgtaagggtacgtttaccgtaccgttaccgtaccgacccggttcgaacggtccgaacggtacccgtaggaccgtccgtacggtagttacggttacgttttcgaacgtttacgttttaacgtcgttaacgtgtaccgtaccgtacggttccgttacccgggacctaccggtcccgtacgtttcccgggtaacggtttccggggacccggggtacgttcgggtacgtacgtagtacgggaacggtaaccgtcggttggtaccgggtctaacggtcctaaccggtcgtttaccgtacgtttcccgtacggtccttaaccccg

SEQ ID NO: 112008 - DNA, 615 bp, Homo sapiens
  misc_feature: GYAE6OF02GWLKU.45.36.D03.1.454.CMB.1.raw
  modified_base (485)..(485): a, c, t, g, unknown or other
  misc_feature (485)..(485): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggaggtcggggggaggcgttgtccagcctgggaggtccctgagactctcctgtgcagcctctggattctccctcagtaactttggtttccacgtgggtcccgccgaggttcccagggcaaggggcctgggaggtgggtcggccccgtctacgtttccgaagctgggaagtggagaaggcctacgtcagactccgtagaacgggcccgactttcgaccatcctaccagacgactaacttaccgaaagtaactcgtccttcgtttttacgactaaagtntaaacgtacgtcctagtaggtagttggacggacgtacgttcgtcgttacttatttcgtgttacgccggagggggtactacgttctatcggtagttcgttcggttacgttaggttcgttaatactaaaccg

SEQ ID NO: 112009 - DNA, 648 bp, Homo sapiens
  misc_feature: GYAE6OF02F4BA0.45.36.D03.1.454.CMB.1.raw
  modified_base (355)..(355): a, c, t, g, unknown or other
  misc_feature (355)..(355): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggaggtcggggggaggcgttgtccagcctgggaggtccctgagactctcctgtgcagcctctggattcctccctcagttaacttttcggtttccactggggtcccgcctaggttccaggcaagggggctgggagtgggtcggccctntagtttccgaagagtggaagtgaggaacggtcctaacgtcgagactccggtaggaacgggccgtactttcacctactcctaccgacgacgaactaacttaccgaaacgtaattcgtaccttcttttacgactaaagtagtaagtacgtaccgtagtagtaggttaggacggtaacgtacggttactagttacgttagtttcgtggtcggtccggtagggggtactaacgttcgttagttacggtacggttcgttacgggtttacggttaggttacgttaacgttacttaaccg

SEQ ID NO: 112010 - DNA, 690 bp, Homo sapiens
  misc_feature: GYAE6OF02JE6B9.45.36.D03.1.454.CMB.1.raw
  modified_base (289)..(289): a, c, t, g, unknown or other
  misc_feature (289)..(289): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggagacagccaccctctcctgcagggccagtaggagtgtcagtaagtactaggctggtaccaacagaaacctggccaggctcccgaggctccncactccatgatgcactccaacgtacgggtccctggccgtcccaggtacctacgggttccgaggccgtaaggttcggggtcctacggggacaaggtacgttaccaacgtccgttaccgacccggttcgacgaccgtacgtcccggttggaacgtccgtaggtacttcggtacgttttcggaccgttaaggttttaccgttccgttacggttacgaccggtcgtaacgtccggttcccggttcccgaacccggttcccgtcccttaccggtaccggtttccgggggcccggggggtaacctagggggttacggacggtacgttacgggacgtaccggtaacgttcggtacggtccgttacggacctaccgtattccgtggttaccgttcctacgtttccccgg

SEQ ID NO: 112011 - DNA, 562 bp, Homo sapiens
  misc_feature: GYAE6OF02I6SKS.45.36.D03.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (492)..(492): a, c, t, g, unknown or other
  misc_feature (492)..(492): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccagggganacagcccaccctctcctgcagggccagtaggngtgtcagtaagtactaggctaggtaccaacagaaacctggccaggcctccaggcctcctcattcatgatgcactccaacgacgggtccctgggcctccccagacgtaggttccgtgctaggtgggtctggggactaggagttcactctaccgacgtcagccagccgtggacgctgatgtatttgctagtttcttctgtcagcagtccgtccgccgaccgccgtctccgtacgttcgggcggggacctaggggtcgagngtaggacgtacggaacgtggtacgcgtcgtaccgaccgtacttcgttcgtcttcgtacttcccgtacccg

SEQ ID NO: 112012 - DNA, 731 bp, Homo sapiens
  misc_feature: GYAE6OF02GS485.45.36.D03.1.454.CMB.1.raw
  modified_base (273)..(273): a, c, t, g, unknown or other
  misc_feature (273)..(273): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggccaccctgtctctgtctccgaggggacacacgccaccctctcctgcgagggccagtaggagtgtacagttaacgtacgttaggcttaggtaaccaanacgaaaccgtggccacggcctacccaggcctcctcactccatgactcgactactcccaaacgtacggtcccgtggacccgtccgtagtacgttcggtacccggtggaccgtacgggtggggtacgtcggggaacgtaggtacgttacgactccgtaccgtacccggtcgtacgacgtacgtcccggtagggtaccgtccgttagaacgttcggttaacgttttacggaaccgttttaaccggttttacctttcggttaccgtccgttaacggtccgttaaccggtcccggtttcccgaaccccggtccggtccccgttaccgtcggttacccggttccgggggaccgggggttaaccgtaggggttacgacggtacgtaggaaccgttaacggacgttcggtcgggtctcggaccctacgtacgtttacgtcggtttcccttacgtaccgttaccccg

SEQ ID NO: 112013 - DNA, 558 bp, Homo sapiens
  misc_feature: GYAE6OF02GQNUV.45.36.D03.1.454.CMB.1.raw
  modified_base (545)..(545): a, c, t, g, unknown or other
  misc_feature (545)..(545): n is a, c, g, or t
  modified_base (549)..(558): a, c, t, g, unknown or other
  misc_feature (549)..(558): n is a, c, g, or t
tcagacgcgatcgacacgaccggtgctcgatttagctgcgtcacgatctctcctgtgcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctgggcaaagggacctcggtcaccgtctccgcagcttccaccaacgggcccatccggtccttccccctggccgccctgcctcccgaggacgccacccgtcgtgggggccacgacggccggcccgtgggcctcggcccgttggtaccgaacggaccttaccgttcccgtcgacgtccggccgttcgtcggacggccgggcgtcgggaccgagggcgacgagtagnacgnnnnnnnnnn

SEQ ID NO: 112014 - DNA, 223 bp, Homo sapiens
  misc_feature: GYAE6OF02F6ZX4.45.36.D03.1.454.CMB.1.raw
  modified_base (219)..(223): a, c, t, g, unknown or other
  misc_feature (219)..(223): n is a, c, g, or t
tcagacgcgatcgacacgaccggtgctcgatttagctgcgtcacgatctctcttgggggaggaactgctcagttaggacccagacggaaccatggaagccccagcgcagcttctcctcctcctgctactctggctcccaggaactgtggctgcaccatctgtcttcatcttcccgccatctgatcgatcgcgtctgagcgggctggcaaggcgcatagnnnnn

SEQ ID NO: 112015 - DNA, 534 bp, Homo sapiens
  misc_feature: GYAE6OF02G3WRQ.45.36.D03.1.454.CMB.1.raw
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggactttgggctgacctgggttttcctcgttgctctttaagaggtgtccagtgtcaggtgcaggtggtggagtcggggggaggcgttgtccagcctgggaggtccctgagactctcctgtgcagcctctggattctccctcagtaacttggtttccactgggtccnccaggttccaggcaaggggctgggagtgggtggccctcgatttccgaagntggaagtgagaaggcctactcagactccggtgaagggccgcttcaccatctccaganacaattccaagaatgtcctnttttgctaaatgaatagcctgagagttgaggacacgtctgtcttattcgtgtgccgaggggtccatctagtgtagtcgtggttaccgtaggttgtatctaacg

SEQ ID NO: 112016 - DNA, 844 bp, Homo sapiens
  misc_feature: GYAE6OF02JUWDG.45.36.D03.1.454.CMB.1.raw
tcagacgcgatcgacacgaccggtgctcgatttagctgcgtcacgatctctcttggggggaggaactgctcagttaggaccagagggaaccatggaagccccagctcagcttctcttcctcctgctactctggctcccagactaccaaccggtaaaaattgtgttcgacacagtcctccaggccaccctgtcctctcgtcctccgaggggacacacgtcccaccctctcctgccgacggggccctaggtacggagttcgtaccgaacggttaagtaccgttacggggcttacggtaaccaaacgacggaaacccgtggaccgtaggcccttacccgaggtcccttcccgactaacctaccgtacgtcgacgtacgcctaacgtacccaaccggtacgggtcccgtcgggcccgttacccacggtaaccgtacgggttccgtcgggaccttaggggtacggggttcgtacggggaaccgtaacggtcgttacccgaacttaccctcccgggaaccggttacacgggcctaaacccggtccggtacgggtacgtacccgttaggtacgttacggttaccgttttacggtacctttaaccgggttttaccttaccggttacctttacggtaccgttacggtaccgtttccccggtaccgtaccccggtaccggttaccccgtaccgtttacccgttaaccggggttcccgggggttaaccggggggtccccgtaaggggttacggaacggtagtaccgggtaacggtaacccgggttaacggttcggtaccggtcggtaccgttccgaaccggttcgtacgtcggtacctttccgaccgtttacccg

SEQ ID NO: 112017 - DNA, 701 bp, Homo sapiens
  misc_feature: GYAE6OF02JEKXM.45.36.D03.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcagggccaggtaggagtgtcagtaagtactaggctggtaccaacagaaacctggccaggcctccaggctccncatccatagatgcactaccgaacgacggggttccccngggtccctccccgagaaccgtaggttcccggnggccgtagggtcgggttcgtaggggtaccaggtacgttccgaccttcctaccgaccgtcgaacgccgtacgtccgtgggaccgtcgttagtacgttagttaacgtttttacggttaacgttttaccttacgttcggttacgtacgtaccgtacgtccggtttcccgacccgtaccggtcccgtaccgttaccgtaccgggttttccggggacccggggggtaaccgtagggggtacggtaacgggtagtacgggtacgtaacggtacggtacggtcgggtacgtcggtaccgtaccgtacgttccgtcggtttacccgttacgttcctcccgtttaccccg

SEQ ID NO: 112018 - DNA, 773 bp, Homo sapiens
  misc_feature: GYAE6OF02GTPVH.45.36.D03.1.454.CMB.1.raw
  modified_base (314)..(314): a, c, t, g, unknown or other
  misc_feature (314)..(314): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggagtcggggggaggcgttgtccagcctgggacggtccctgagactctcctgtgcagccctctggacttcctccctcagttaactttgggttccacttggggtccnccgaggttccaggcgaaggggtctgggagtggggtcggccctgtactttccggaaagtcgtggaaagttggaaggtaacgggtccctaacgtccgaacggtaccgtcccggtaggaacggggtccctcgtttaccacccgacgtcctcccgaaggtacgtaaccgtaacgtttacccaaagtaacttccggtaccctttcgtttttacgaacctaaaacgttacgtaaacgttaacggacccgttaggaacgttaaggtttacgggaacgggtaaccgtaaccgggttaccgtttacggttaccgttttaacgttttaccgtacgggttacgggtacccgggtaacgggggggtaaccttaacggtttaccgttaacggttaggttaacgggtttacccggtttcggggtttttaccggtaacggttttaacggtttaaccgttacccgttaaaacccg

SEQ ID NO: 112019 - DNA, 730 bp, Homo sapiens
  misc_feature: GYAE6OF02IEWG4.45.36.D03.1.454.CMB.1.raw
  modified_base (359)..(359): a, c, t, g, unknown or other
  misc_feature (359)..(359): n is a, c, g, or t
tcagacgcgatcgacacgaccggtgctcgatttagctgcgtcacgatcgtctcttggggagaactgctcagttaggacccagagggaaccatggaagccccagctcagcttctcttcctcctgctactctggctccccagactacccgaaccggtaaaaattgtcgttagacaccagtcctccaggccaccctgtcctctcgtcgtccgaggggacacgacgtcccacctctccgtgcgacggcctaaggtggacgtcgtacgaagttacgttacgtcggtcgttacggaaccaacgaacgtaaaccgtcggacccacggccgtacccaaggtccctccgtacaccttccgatacgacncgttaacaacgttccaaaccggtcgggtaccctcggaccgtaccacggtaccgtcgggttccgcggacgtacgggtcgggtcgtacgggacacggtacgtacctaacgtccttaccgaccgttcgacgtacgacgtaccgtacgtccggtaccgttcggtaacgttacgttacgtttacgtacgttacttttcgtacgttcgttcgacgtcgtaccgtcctacccgtccgccgtaccgtccgtaccgtccggtttaaccgggccgggtacgacggggtacgtacgggtacgtacggaacgtacggaaacggttcggtaacggtcgttacgaccgtcgtacgttccgtcgttaccgttacgtaccgttcccg

SEQ ID NO: 112020 - DNA, 649 bp, Homo sapiens
  misc_feature: GYAE6OF02FR13W.45.36.D03.1.454.CMB.1.raw
  modified_base (201)..(201): a, c, t, g, unknown or other
  misc_feature (201)..(201): n is a, c, g, or t
  modified_base (366)..(366): a, c, t, g, unknown or other
  misc_feature (366)..(366): n is a, c, g, or t
  modified_base (440)..(440): a, c, t, g, unknown or other
  misc_feature (440)..(440): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccagtacggagtgtcagtaagtactaggctggtaccaacagaaaccgtggccaggcctcccgaggcctcctcactccatgatcgcactacccaacgtacgggtcccctagggtccgtcccgaggtaccgtacgggttcccgnggcgtaaggttcggggtctaggggacaggtacgttccacgttccgtacacccggtcacgcgacgccgtaggacnccgtaggtattgtattttcgacgttagttttcttacgtgtacaggtccgaacgtccgttccgccgtaccgcccgtcgtaccgttaccgggtttccggggaccgggggtaccgtacggggtagggacgtacgtagggacggtaccggtaacggttcggtcggtacgtcgacctaccgtattcccgttacggtctttaccgactttccccg

SEQ ID NO: 112021 - DNA, 656 bp, Homo sapiens
  misc_feature: GYAE6OF02HQO3T.45.36.D03.1.454.CMB.1.raw
  modified_base (648)..(648): a, c, t, g, unknown or other
  misc_feature (648)..(648): n is a, c, g, or t
  modified_base (653)..(653): a, c, t, g, unknown or other
  misc_feature (653)..(653): n is a, c, g, or t
tcagacgcgatcgacacgaccggtgctcgatttagctgcgtcacgatctctaccgtgtgcagtaactttggtttccactggtccgccaggttccaggcaagggctggagtgggtggccctcatttccgaagactggaagtgagaaggcctactcagactccgtgaagggtccgcttcaccatcctccagagacaattccgaaagaattgtccttctttttgactaaatgaaactacgccttgagtagttgaggtacacgtctgtacttatttctgtgccgaggggacatacgtagtcggacgttccgtggtttcgtagttgtaatcaacttactactacctcaagtcggacgttcgtcggggacaaacgggtccttcgtcaccgtctccgctacgccttaccaccgaacggcccacgttcccggttcctttcccccgtcggtccgcccttagcctaccgtacggaacgtcctaccgtaccggtcgggggtaccacgacggtcccggtcccgtgggtccgtcggttcccgtggttaccgaaggttaccgtaccttccgtaccgtatcccggtcgttccgtacgggacggtccgggcgttccggaccgtacgggcctacggtaacgtcgacgagtctcgcgacgtcgacnctcgntac

SEQ ID NO: 112022 - DNA, 583 bp, Homo sapiens
  misc_feature: GYAE6OF02GH1W4.45.36.D03.1.454.CMB.1.raw
  modified_base (263)..(263): a, c, t, g, unknown or other
  misc_feature (263)..(263): n is a, c, g, or t
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatgatgcatccaacacgggtccctggcctcccagacctaggttccgnggcaggtgggtctgggacaggtagttcactctcaccgtnagcagccgtaggcgcctgatgtattttcgactagtttacttcttcgtcagcacgtccgttcccgccgtaccgcccgtctccgtaccggtttccggggaccggggggtaccgtaggggtggacgtacgtaggaacggtacggtaacgtcggtacggcgtcgaccgtaccgtacgttccgtcgttccgttactacgttccccg

SEQ ID NO: 112023 - DNA, 588 bp, Homo sapiens
  misc_feature: GYAE6OF02HX5YZ.45.36.D03.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (354)..(354): a, c, t, g, unknown or other
  misc_feature (354)..(354): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctccaggctcctnatccatgatgcactaccaacgtacgggtccctgggccgtacccaggaccgtacgggtttccgnggacctagggtgggtctggggactaggacgttcactctcaccgtcagcacgcgtggacgcctagactgtatttcgacttagtttacttcgtgtcagctagtccgttccgcgaccgtccgtctcgtaccggttcggggacgggggtaccgtaggggtacggagtagtaggaacggacggtaacggtcggtacgggcttacggcctacgtacttcgttcgtactttcgacttcccg

SEQ ID NO: 112024 - DNA, 737 bp, Homo sapiens
  misc_feature: GYAE6OF02GZJ6F.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctcaggcaccctgtctctgtctccgaggganacagtcaccctctcctgcgaggccagtaggagtgtcagtaagtacgttaggctaggtaaccaacgagaaacctggaccgaacggcctccccgaggcctcctcatccaatgactgacacgtaccgaacgcggtacctggccgtacccgaggactacgggtttccgcggacgaggttcggtacgtagggacaggtacgttaccaacgttcctaccgtaaccgtacgaacgtacgtacgtccgttaaggggccgtaccgtacggtaagttacggttaacgttttacggacgtttaacgtttttacgttccgttacgtactaacggtaccgtaacggttccgtttcccggaacccgacccggtacccgttacccgtttaccggtaacccgggtttttccgggggaccgggggggtaaaccccggtaggggttaacggggaactacgggttacgggaacggtaacccgtaagggttacggacgggttcgtacggacgtaacctccgtttacgtacggtttcccttacgtaccttaccccgg

SEQ ID NO: 112025 - DNA, 230 bp, Homo sapiens
  misc_feature: GYAE6OF02HI5DA.45.36.D03.1.454.CMB.1.raw
  modified_base (228)..(230): a, c, t, g, unknown or other
  misc_feature (228)..(230): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnn

SEQ ID NO: 112026 - DNA, 665 bp, Homo sapiens
  misc_feature: GYAE6OF02IR3AX.45.36.D03.1.454.CMB.1.raw
  modified_base (392)..(392): a, c, t, g, unknown or other
  misc_feature (392)..(392): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgcccaccctctcctgcagggccagtaggagtgtcaagtaagtacttaggctcggtaccaacagaaacctaggccaggcctacccaggcctcctcactccatgatgcactaccaacgacgggtcccgtcggtccgtacccgacgacgtacggttccgtggcgtaggtcgggtcgtacgggacgtanacggggggtctacctcgtcgtaccgtcgtacgcgtacgccgtggacgtccgtgtacgtgttagtttcgtcgttacgtttacgttcgttacgttctacgtcgtacgtccgttcccgcccgtaccgcccgtcgtcccgttaccggttccggggtaccgggggtaccgggtacgggtacgggacggacggtagacggaccggtaacggttcggtacgggtccgtacggtaccgtaccgtacgttacgttacgttccgttacctacgtttaccccgg

SEQ ID NO: 112027 - DNA, 585 bp, Homo sapiens
  misc_feature: GYAE6OF02GATI0.45.36.D03.1.454.CMB.1.raw
  modified_base (259)..(259): a, c, t, g, unknown or other
  misc_feature (259)..(259): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggttccactgggtccgccaggttccaggcaaggggctggagtgggtggccctcattccgaagntggaagtgagaaggcctactcagactccgtgaagggccgcttcaccatctccagagacaattccaagaatgtccttctttttgctaaatgaatagcctgacgagttgaggacacgtctgtctatttctgtgccgagggggactagtctatgtagtctggttcgtagtgtaatacaactactaacttacctacagtgtacgtcgtgggacgaacggaccgtcggtactaccgtctccgcacgtccttaccaccgacggccctacgtccgtcccttccccgtacggcccgtccctcgtccgtcccgacggacgtccgacccgtccggg

SEQ ID NO: 112028 - DNA, 791 bp, Homo sapiens
  misc_feature: GYAE6OF02ITD33.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggtttcctcgttgctctttaagaggtgtcctagtgtcaggtgcaggtggtggaggtcgggggagcgttgtccaggcgtgggaggtccctgagactctccgtgtcgcacgcctccgtggtacttcctcccttacaggttaacctttcggtttacccacgttcgggtcccgccgtacggttcccgaggtacgaagggggtccgtagggacgttgggggtcgtccccgttcgtacgtttaccggaaaggtacttagggaaggttacggaacggtaacggtaccccgttacgtacgaacggaccgttaccggttaggaaaccggggtcccgtacctttaccgtaacccgtaacgtcccgtaccgaaggtaacgtaacctaaaccgtttaaccgaaacgtaagtttaccgttaccctttacggtttttagaaccttaaaagtacgtaaagttacgtaccgttacggtaacggttaacggtttacggaacggtaacccgttaacggttcgttaacgttaccgtttagtttaccgttcgtcggtaccggtaagggggtaactaccgtacgttaagtaccgtaaggtttcggttaacggttacggttaacggttaacggtttaaccgtacgttaaaacccg

SEQ ID NO: 112029 - DNA, 803 bp, Homo sapiens
  misc_feature: GYAE6OF02F30SY.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctgctcccagataccaccggaaaaattgtgttgacacagtctccaggcaccctgtcctctgtctaccgagggganacagccaccctctcctgacacgggccaggtaggactgtcaggttaacgtacttaggctaggtaccaacgacggtaaacctggacctaaggtcctaccccgagggtcctcccttacacgtcccgtaagtcggaacttcggacctaacgtacccgaaaccgtaacggggttcccctaggggtacccttaccccgaaaggtacccgtaacggggttccccggtagggacctacggggttcggggtccggtacgggtaacgtacggtaacggttctaacccgtcgtacccgaaccggttcgaacgtcgaaccgccgttaggacccgtcgtacggagttcgttagtttcgaccgttgttaaccttcgttacgacgtttacgcgttacgtcccggtttcccgaccgtaccgggtcccttccggtaccgttttaacccggttcccggggggacccggggggttaacccgtaaacggggggtcggtacggtaccggtagtaaaccgggttaaccggtaacggttccgggtaggttacccggtaccggtacgtaacccggtcccgtttacggttcggtttaccccttacgggtaccctttcccccggg

SEQ ID NO: 112030 - DNA, 810 bp, Homo sapiens
  misc_feature: GYAE6OF02I6IF9.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgcttcttttaagaggtgtccagtgtcaggtgcgaggtggtggaggtcggggggagtcgttgtccagccgtgggacggtccctgacgctctcctgtcgcagcctcgtggtacttccgtccctactacgttaacttttcggtttcccacgttcgggtcccgccgtacggttccgagggtcgaacggggtcgtagggtacggtcgggtacggtccccttacgtacgtttaccggaaagtaggtacggtaaaggtcggaacggaacggtacccttaacgtcgaacgtaccgttaccgggtacggaaaccggggtcccgtacgtttacccgaacctaccgttaccgtacccggaaagaaccgtaacctaaacttaaccgaaagttaacgttcgttacccttttacgtttttacgaaccgttaaagttacgtaaacgttacgtaccgttagggaaccggttaggttacggtaacgggtacctaccgggtttaccgttacggtttacgtttaacgttttccgttacggttaccggtaccgggtaacgggggtaaccttacgttaacgttaaggttaccggtaacggtttaccggttacggggttttacgttaacgggtttaacgttaacgttacccgttaaaacccg

SEQ ID NO: 112031 - DNA, 611 bp, Homo sapiens
  misc_feature: GYAE6OF02GBHLR.45.36.D03.1.454.CMB.1.raw
  modified_base (349)..(349): a, c, t, g, unknown or other
  misc_feature (349)..(349): n is a, c, g, or t
  modified_base (389)..(389): a, c, t, g, unknown or other
  misc_feature (389)..(389): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcacgggccagtaggagtgtcagtaagtacttaggctggtaaccaacagaaacctggaccaggctcccgaggcctcctcactccatgatgctactccaacgcggtcctgggccgtacccagacaggttccnggcgtagtcgggctgggacagtgttcactcgtcaccggtnacgcacgccgtgacgcgtgagtgtatttgactacgtttactctcgtagacgtcgtacgtccgttaccgaccgtaccgtcccgtccgttaccgtaccggtttccgggggccggggggtacccaggggttacgggacgtaacgtcgggaacggtaaccggaacgttcgggtcggtacgtacgccgtaccgtacgttccgttcgttacctttcgtaccgttcccg

SEQ ID NO: 112032 - DNA, 760 bp, Homo sapiens
  misc_feature: GYAE6OF02GUM0N.45.36.D03.1.454.CMB.1.raw
  modified_base (370)..(370): a, c, t, g, unknown or other
  misc_feature (370)..(370): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagcccacctctcctgcagggccagtaggagtgtcagtaagtacttagctacggtaccaacaacgaaaccgtggaccgaggcctcccgaggcctacctcactccatgactcgaccactcccgaacgtacgggtccctggcccgtaccaggtaccgtacgggtttccgnggaccctagggtcggggtccgtacgggggaactagggtacgtttaccgaacgttccgtaccgaacccggttgaaccggccgtaacggtcccggttaacggaacggtcccgttaacggtaacgtttaggtttaacgttttcggtaccgtttacggtttttaacctttcggttcgttacgttacggtaccgtaccgttcccggttaccgtaccccgaccggtccctccgttaccggtaccggtttacccgggggaccggggggtaacccgtaggggtacggtacggtacgtacgggtaacggaccggtaaacggttcggttacggtacccgttacggacccgtaaccgttacggtttaccgttaccggttacctttaccgtccgtttccccg

SEQ ID NO: 112033 - DNA, 636 bp, Homo sapiens
  misc_feature: GYAE6OF02HWE7Q.45.36.D03.1.454.CMB.1.raw
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (392)..(392): a, c, t, g, unknown or other
  misc_feature (392)..(392): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcacctgtctctgtctccaggggagacagcccacctctcctgcagggccagtacggagtgtcagtaagttacttaggctggtaccaacagaaacctggaccaggcctacccgaggcctcctcatcccatgatcgctanccaacgacgggtcctggcctccagtcgnggttccgnggacgtaggttcgggtcgtgggactaggtacgttccacttcnccgaccgtcacgccacgccgtcggactcgttgagttgtagttttcgctttagttttacttcgttcgtcacgtcgtacgtcccgtaccgccgaccggccgtccttaccgtaccggttccggggaccgggggtaccgtaggggtacggtagacgttacgggaacggtaacgtacggttcggtagggtccgttacggaccgtaccgtacgttcctttacggttaccctttaccgtacccttccccgg

SEQ ID NO: 112034 - DNA, 525 bp, Homo sapiens
  misc_feature: GYAE6OF02IHK3A.45.36.D03.1.454.CMB.1.raw
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
  modified_base (466)..(466): a, c, t, g, unknown or other
  misc_feature (466)..(466): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggaggtcggggggagcgttgtccaggcctggggagtccctgagactctcctgtgcagcctctggacttctccctnagttaacttttggttccacttgggtcccncctaggttccagggcaagggggctgggagtgggtcgccctnatttcgaagntggagtgagagcctactcagctcgnggaacggccncttcacatctcagagacatcaagatgtactntttcgataatgaatagacctgagtagtgagacacgtntgtctagttctgtcgccgagggcatctatgagtcgtggttcgtagtagtactactaacc

SEQ ID NO: 112035 - DNA, 855 bp, Homo sapiens
  misc_feature: GYAE6OF02JEG5L.45.36.D03.1.454.CMB.1.raw
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggactttgggctgacctgggttttcctcgttgctcttttaagaggtgtccagtgtcaggtgcaggtggtgggaggtcgggggggagcggttgtccgaggtcctgggggacggtccctggacgactcctcctggtcgtcaggcctcgtggtattcctcccctcagttaaccgttttggtttacccacgttcggggtccccgtccgtaacgggtttcccgagggtccgaaacggggggtccgttaggggtaacggttcgggggtcgggtaccccttccgtaacggttttcccggaaaggtacgttagggaaacggttgggaacggaacgggtcccttaacgtcgtaacggaccgttacccgggttaggaaaccgggggtcccgtaccttttaccgaacccgtacgttaccgtacccgtaaggaacggtaaacctaaacgttaaccgtaaacgtaaacgttaccggttacccgtttaccgtttttaccgtaaccgtaaaacgttacgggtaaacgttacgtaccgttacggtaacggttacgggttaacggtaacgggtaaccgtaaccggttccgtttacggttaccgtttaaccgttttacgttaccggtacgggtacccggtacggggggtaacctaacggttaccgttacgtacggttacggttacggttacgggtttaccggttaaggtttaacgtaacgttaccgttaaacccg

SEQ ID NO: 112036 - DNA, 592 bp, Homo sapiens
  misc_feature: GYAE6OF02GJ6PI.45.36.D03.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (449)..(449): a, c, t, g, unknown or other
  misc_feature (449)..(449): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccacctctcctgcagggccagtaggagtgtcagtaagtacttaggctggtaccaanagaaacctggcaggctccaggctcctcatccatgatgcanccaacgcggtccctggcctacccagaccaggttccgnggcaggtcgggtctgggacngtacgttcactctcaacatcagccacgccctaccaacctgtaaacgtattttacgaccgtaagttccttaatttaccgtgtaccaaacgngacgtaacagtaacgttcgggacccgtctacgtacgtttccgggacgggtaacggaccgtaagggtcgacgtacgtacgaaacggtacgtaggtacggaccgtacgacaaccgttctaccgttcgtctttaccgactttcccg

SEQ ID NO: 112037 - DNA, 666 bp, Homo sapiens
  misc_feature: GYAE6OF02HR4UP.45.36.D03.1.454.CMB.1.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
tcagacgcgatcgacacgaccggtgctcgatttagctgcgtcacgatctctcttgggggaggaactgctcagttaggacccagacggaaccatggaagccccagcgcagcttctcttcctcctgctactctggctcccagataccactggagaaatagtggtgacgcagtctccaggcaccctgtctctgtctccgagggganacagcccaccctctcctgcagggccagtaggagtgtcagtaagtacttaggcttaggtaccaacagaaacctggccaggcctcccgaggcctccctcatccatgatcgcactccaacgtacgggtccctggccgtacccaggtacctacggtttcccgngggacctagggtcgggtctagggactaggtcgttaccacttcctaccgaccgtcacgcgacgtcccgtagggacctcccgtaggtacttggttacttttcggactttacggttttaaccttcgtcgttcaacggtcctaccgggttcccgtttacccgacccgtacccggtcccgtacgttacccggttaccgggtttcccgggggggaccggggtaacccgtaggggggtcgtacggtacgttacgggaacggtaaccgtacggtgggtacgccgtacgccacgtcgttcgttcgttctaccg

SEQ ID NO: 112038 - DNA, 595 bp, Homo sapiens
  misc_feature: GYAE6OF02IQ9F7.45.36.D03.1.454.CMB.1.raw
  modified_base (265)..(265): a, c, t, g, unknown or other
  misc_feature (265)..(265): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (471)..(471): a, c, t, g, unknown or other
  misc_feature (471)..(471): n is a, c, g, or t
  modified_base (523)..(523): a, c, t, g, unknown or other
  misc_feature (523)..(523): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctaccgaggggagacacgcccaccctctcctgccagggccaggtaggagtgtcagtagtactgcgtggtaccaanacgaacctggaccaggcctacccgaggctccgcactaccatgactcgctactaccaacgtcgggtccctaggccgttaccgngtaccggtcggttccggnggacgtgggtcgggttcgtgggactaggtacgttacgactcgtccgaccgtcgacgccagccgtaggacgcttgattcgttagttcgacttacgtttcttcgtgtnacgctacgtccgttccgcctacgccgtactctccggttcgggcgggtacggnggttagagtgtacgacggacgtaaggtggcgtacgtcgaccgtcacgttctacgttccttcaccgttcccgg

SEQ ID NO: 112039 - DNA, 670 bp, Homo sapiens
  misc_feature: GYAE6OF02GT6HC.45.36.D03.1.454.CMB.1.raw
  modified_base (349)..(349): a, c, t, g, unknown or other
  misc_feature (349)..(349): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccgaggcctcctcatccatgatgcactccaaacgagggtcccctggcctcccgagactacggttccgnggcaggtcgggtcgtggggacagtagttccacgtcctacgaccgtcagcacgtccgtaggacgccgtgattgtagttttcgacttaacggttttacttcgttcgtacacgtcgtacggtccggtttcccgcccgtaccggcccgtaccgttaccgttaacccggtttccgggggacccggggggaaccgtacgggggttacggaaggtaacgttacgggaacggtaaccggtaaacggttggggttaccggccgttacggtaccctaacccgtaacgtttcccgttacggtttaccgttttaccctacgttttccccccgg

SEQ ID NO: 112040 - DNA, 738 bp, Homo sapiens
  misc_feature: GYAE6OF02FJUEN.45.36.D03.1.454.CMB.1.raw
  modified_base (357)..(357): a, c, t, g, unknown or other
  misc_feature (357)..(357): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccacctctcctgcagggccagtaggagtgtcagtagtacttaggctaggtaccaacagaaacctggaccaggtcctccccaggcctcctcactccatcgatcgcactccaaacgcgggtccctggccgtacccaggtactacggtttccgnggcagggttcggggtctgggggaacaggtacgtttcaaccgttcgtccgacccgttaccgagtccgacggtccgtcgggacgtcccgtaggtacgttcgtacgtttttcgaccgtttaacggttttaccctttcggttacgtaccgtacggtaccgtacggtcccgtttacccggcccgaaccggtccccgttaccgttacccgttcccggggttttacccgggggacccggggggtaaccgtacgggggttacgggtaacgggtacggttacgggacgggtaaccgggtaaccgggttcgggtacgggtccgttacggaccccgttaaccgtacggttttaccgtcggtttacccgtttaccgtacccggtttacccccg

SEQ ID NO: 112041 - DNA, 745 bp, Homo sapiens
  misc_feature: GYAE6OF02IORBE.45.36.D03.1.454.CMB.1.raw
  modified_base (504)..(504): a, c, t, g, unknown or other
  misc_feature (504)..(504): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaattgtgttgacacagtctccaggcacctgtctctgtctcgagggagacagccacctctcctgcagggccagtaggagtgtcagtaagtacgttaggctaggtaaccaacgaacgtaaccgtcggaccgacggcctacccgaggcctccctcacttcccgatacgatcggacctactacccaacggtacgggttccccgtacgggtcccgtacccgaacggtaaccggtacggggtttcccggaggtccggtacggggttcggggttcggtacgggggaactacggttacggtttaccaccgttccgtaccgaacccgtcgacggtcgacggggtcccgtaggggtaccnccgttggtaacttggttacgtttcggtacctttaaggttttccttcgttagtaccgacgtccggtacgtcccggtacccgccgtaccgtccgtaccgtttcccggtaacgggttcggggggacccgggggtacgtaggggtacgaggtacggtacggtaacccggtgttacgggtccggtacggtccgtaccgtaaccgttctaccggtttccttcgtaccgttccccgtacttaccccgg

SEQ ID NO: 112042 - DNA, 691 bp, Homo sapiens
  misc_feature: GYAE6OF02FHTX1.45.36.D03.1.454.CMB.1.raw
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccaggtaggagtgtcagtaagtacttaggctggtaaccaacagaaacctggccaaggcctcccaggctccgtcactccatgatgcacncccaacgcgggtcccnggtccgtcccgagtacgtacggttccggtggccgtagggtcgggtacgtggggactaggtacgtttccgaactccgttaccgaccgtccaagccgacgtcccgtaggaacgtcccgttaggtactcgttagttttacggacgttacgttttacctttcgttacggtactaacggtcgtacgttcccggtttccccgaccgaccggtcccgtacgttcccgttaaccgggtttcccgggggaccggggggtaaccgttcgggggtacggtacgggtacgtacgggaacggtaccggtaacgtgggtacgggtccttacggaccaccggttctaccggtttcgtaccttacgtaccgtttccccg

SEQ ID NO: 112043 - DNA, 780 bp, Homo sapiens
  misc_feature: GYAE6OF02JO2BD.45.36.D03.1.454.CMB.1.raw
  modified_base (209)..(209): a, c, t, g, unknown or other
  misc_feature (209)..(209): n is a, c, g, or t
  modified_base (426)..(426): a, c, t, g, unknown or other
  misc_feature (426)..(426): n is a, c, g, or t
tcagacgcgatcgacacgaccggtgctcgatttagctgcgtcacgatctctcttgggaggaactgctcagttaggaccagaggaaccatggaagcccagctcagcttctcttcctctcgctactctggctccctagactaccacggaaaaacttgtacgttgacacacgtcctccagcaccctgtcttctgtcctccgaggggtacacngccctacccgtctcctgccagggtcccaggtaggacgtcgtacaacggtatacgttacggcttccggtaccaacgtaacgaaaccgtggaccgtacggccgtaccgtacgggcttaccgtcctaactacccgtatcgactcgtcaactccgaaaccgtcgggtaccctggccgtaccgaacgtaccgtaccggtccggttcgacgtcggtgggtccncgggaacgtacgacgttacgaccgttcgtaccctaccgtcaacgggttccgaacgtcccgtacggaccgtccgtacgtacgttcgtacgtttacgtaccgttaccggttttacttaccgttacggtttacctacggtaccgttacggtacccggtttcccggtaccccgtaacccgtaccccgggttacccgttacccggttaacccgggttttaccggggttcccgggggtaaccgggttaaccggggtacggggtacggtacggtaccggtacgggtaacggaaccggttacggtcgggtcgtttacccggcttaccgtactacggttccttacggttccgtacccttccgg

SEQ ID NO: 112044 - DNA, 728 bp, Homo sapiens
  misc_feature: GYAE6OF02GAFRX.45.36.D03.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccaggcaccctgtctctgtctccgagggganacagcccaccctctcctgcagggccagtaggngtgtcaagtaagtacgtaggctaggtaaccaanacgaaaccgtggaccacggctcccgaggcctaccncactccatcgatgcatccaagtcggtccctgggcctacccgagaccgtacggttccgtggacctagggtcggtacgtcgggaacgtacggtacggtttccaaccgtttccgaccgtacccgttacgaacggtaccgacggtcccggtagggaaccgtcgttacggtacgttaggttacttttacggtacgttaacgttttaacgtttcttacggtactaacggtccgtaacggtccggtttacccgacccgtaccggtcccgtaccgttaccggttccgggttttaccgggggaccggggggtaacccggttacggggtacgggtaacggtacggttacgggaacgggtaacgtaacgggttcggtacgggtccgtacggaccgtaccgtagttccgttacgtaccgtttccgtacgtttccccg

SEQ ID NO: 112045 - DNA, 935 bp, Homo sapiens
  misc_feature: GYAE6OF02I2EPZ.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtcctctcgtctccgagggagacacgcccaccctctaccgtgcgacggccagtacgacggtaagttaacttaacggaactacttacgttcggccgttaggttactactaaacgtaacgaacgtccgtacggcccggtaaccggggttccccccgtaccttccctacctaacttaccgttaacgttcgtaacgttcgtacccgtttacccgacgggtaccgaaccggggccctaacggtcggtacctaacccgttaccccgaacggtacccggttacgggtttacccaagggggtttccggggttacgggggttttacgggggttttcggaaccgttaacgtaacgggttaaccctttaccaacccggttacctttacccaaacgttaacgtacccgaacgggtacccgtaacggtaccccccttaacccgttaaacccggtacggtaaacgtttacgtttttacccggacgtttaaccggtttaaccgtttaacgtttaaccggttaccgtttaacccgtaaaaccgttaacggttaacccggttaaaccgttaacggttacggttaccgggtacccgttaccgttaacccgtttaccgggtttaccggggaaccgggtaaccggggtaacccgggtaacgggtacgggggtaaacgtaccggttaaaaccggtaaaccggttaaacggttcgggtaaccggttacggtaccggtaacccgtaaccggttacgttaccggttcgtttacccg

SEQ ID NO: 112046 - DNA, 695 bp, Homo sapiens
  misc_feature: GYAE6OF02HC2WW.45.36.D03.1.454.CMB.1.raw
  modified_base (496)..(496): a, c, t, g, unknown or other
  misc_feature (496)..(496): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcgagggccagtaggagtgtcagtaagtacttaggctaggtaccaacgagaaacctggccaggcctcccaggcctccgtcatccatcgattcgacctactacccgaacgacgggttcccctcgggccgtacccgaggtaccgtacgggttccggtacggactaggggttcggggtacgtaggggactaggtacgttccgacgttcctaccgaccgtacgacgccgacggcccgtggaacgccgtagagtcggttagtttcgacgttaagttttcctnttacggtcacgtccgtacggtccgttcccgaccaccggtccgcgtttaccgtaccgggtttcccgggggaccgggggtaaccgtagggggttcggaacgttacggacgggtaaggacccggttaaggtacggggtcgtccgtacggtacctaacccgtgtttccggttaccgtaccgtttactcccgtttaacccccgg

SEQ ID NO: 112047 - DNA, 988 bp, Homo sapiens
  misc_feature: GYAE6OF02I5Z6W.45.36.D03.1.454.CMB.1.raw
  modified_base (200)..(200): a, c, t, g, unknown or other
  misc_feature (200)..(200): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctcaggcaccctgtctctgtctccgagggganacacgccaccctctcctgcacgggccaggtaggagtgtcagtaagtacttaggctacggtaaccaacgaacgtaaaccgtgggacccgacgggccttaccccggaacgggtcccttaccctacgaacttaccctaagttcggtaacgttcggacctaaccgtacccggaaaaccggtaccggggttccccgtacggggtaccccgttaccccgaacggtaacccggttaccggggttttaccccggtaggggtacccggttaacgggggttccggggggttaccggttaccggggggtaaacccgtaaggggttaacccggttttaccgtaaccgtttccccgttaccccggtaaaccccgggtttaccgaacccggggtaccgtaaaccgggttccccgggttaacgggggtaacccggttaccccgggtttaagggtaacgtttacgggtttaacgttttttaccggtacccgttttaaacggtttttaccctttccgggtttaacgttaacccggtaacggttacccggtaaacccgggtttccccggttaaccccggtaccccggtaacccggttccccggttaccgttacccgggtttaacccggggttttcccgggggggaacccgggggggtttaaaccgtacggggggttaacggtaacgggtaacggttacgggaacgggtaacccggttaacggttcggggtaccggtaccgtaccggtacccgttaaccgtcggtttaccgttaccggttacctttacctacccggtttacccccgg

SEQ ID NO: 112048 - DNA, 865 bp, Homo sapiens
  misc_feature: GYAE6OF02J219D.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggganacagccaccctctccgtcgcgacgggcctaggtacggagtgtacgagtaagtacgtaggctacggtaccaacaagaaccgtggaccacggcctcccgaggtacctccgtacactaccgagttagactacgactacttaccgaaccgtaccgggtcccgtcggccgtacccgaacggtaccgtacgggttccggtacggacccgtagggttccgggtcggtacgggacgaacggtacgtctaccgtcctaccgaaccgttcgacgtacgtccggcgttacggcgtaaccgttcggaatttcggtttaaccgttttacggacgttttaaccgggttttacctttctaccgggggttaaccttaaccgggtcgttacccgggttaccccgggtttcccggtaacccgttccccggtaaccccggtttaccggtttaccccggggttaaaccgggttttaccccgggggggggacccggggggggttaaaaccggttacggggggttaaccggggtaaggggttacccgtacgggggtaaacccggttaacccgggtaacggggtttccggacggggttacccggtaccgggtaacccccggttaaccggttacggtttcccgttttaccgggtcccttttaaaccggggttccctttaaccccccgg

SEQ ID NO: 112049 - DNA, 583 bp, Homo sapiens
  misc_feature: GYAE6OF02I8PIM.45.36.D03.1.454.CMB.1.raw
  modified_base (342)..(342): a, c, t, g, unknown or other
  misc_feature (342)..(342): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggcctcctcatccatgatgcatccaacagggtccctggccgtcccagacaggttccgnggccaggtcgggtctgggacaggacgttcactctaccgaccgtcacgcagccgtggacgcctgatgtatttgctagtttacttcgtgtcagctagtccgttccgccgacgccgtctccgtacggtttccggggaccgggggtaccgaggggtcggacgtaggtaggacggtaccggtaacgttgggtcggtacgtcgaccgtaccgtacgttccgttcggttacctttcgacgtttccccg

SEQ ID NO: 112050 - DNA, 938 bp, Homo sapiens
  misc_feature: GYAE6OF02FY4OD.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggagacagccaccctctcctgcacgggccagtaggagtgtcagtaagtactaggctggtaccaacagaaacctggaccaggcctcccgaggccttcccgtcacgtccagtgaactggaccacttaccgaaccgtacggggttcccctaggggtcccgttaccccgaacggtaccgtaacggggttttccccggtcgggtaccgtaacggggttcgggggtccgttaacgggggtaaccgtaagggttacggtttaccgtaaccgttccgtacccgtaacccggttaccgaacggacccgtacggtacccggttacgggaccgtcccgttacgggtaactttcggttaaacgttttttcgggaccgtttaacggtttttaccgtttaccggttcggtttacccgacggttaccgtaaccgggttcccggtttaccccggacccgttaaccccgggtaccccggttcccgtttacccgggttttaacccgggtttttaccccggggggggaacccggggggggtttaaaccccttacggggggggtttaaccggggtaacgggtttaaacccgggttacgggggtaaacccgggtaaacccggggttaaacccgggttttaccggggttaccggggttaacccggtttaacccgggaccccgttaacccggttaaccggttttcccgggtttaaccggttttacccccgtttaaccgggttcccctttttaacccccccgggg

SEQ ID NO: 112051 - DNA, 852 bp, Homo sapiens
  misc_feature: GYAE6OF02FEASF.45.36.D03.1.454.CMB.1.raw
tcagacgcgatcgacacgaccggtgctcgatttagctgcgtcacgatctctctggaggaactgctcagttaggacccagagggaaccatggaacgccccagctcagcttctcttcctcctgctactctggctcccagataccaccggaaaacttgtgttgacacagtcctccaggccaccctgtctctgtctccgagggtacaccacgccaccctctcctcgccgacggcctaggtacggacgtcgtacaagttaacgtccgttaggctacggtaacccacgaacgtaacccgtcggaccacggtcctacccgacggtcctccctacacttcccagtacgacttcgacctacgtaccgtaacggtccgggtcccgtggtaccccgtacccgtaaggtacccggttacgggttccgggtcggacggttacggggttacggggtaccggttacgggggaaaccttacggttacccggtttaccacccgttacccgtacccggacccggttacgaaccgtccgtaaccggtccgtacgggtaccgtacccgttagtaacgtttacgttacgtttaccgtaccgtttaacgttttcccgtaccgttacgttacccgacggtacccgtaccgggtttcccccggttaccccgaacccgtacccggtccccgtttaccggtttaacccgggtaacccggggttttacggggggaacccgggggttaactagggggggtactaaccggttacggtacggtaaccggttaacccgggtaacgtttcgggaccttaccgccgtaccctaaccgttcgttacccgttaccgttacccgtttaccgtaccccgtttcccccgg

SEQ ID NO: 112052 - DNA, 610 bp, Homo sapiens
  misc_feature: GYAE6OF02I12XR.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctcgtctccgaggggacacacgccaccctctcatcgcgacgggccagtcagagtattagaacattacgtcggcctggtatcaatacaagcctggccacgggtccccgctccctcactctatgactcgtctccgagccgacggaccacgtcggcctactcccgagccgtaggttcgacggtgggtcgggttgggttcgacgtacgtacgtaccttcgacgtctacacgtacgtacgacgctaccgtcctaccgtaacgtacgtaacgttatttcggactacgttactacttctacgtactaacgcgtacgtacgtacgtacgtcggcctacgtcgtacgttcgggacgtacggacgtacggtaggtaacgtactaacggtaaacggtcgtacggtcgtacgtacgacctacgttactcgtaccg

SEQ ID NO: 112053 - DNA, 700 bp, Homo sapiens
  misc_feature: GYAE6OF02HDRNS.45.36.D03.1.454.CMB.1.raw
  modified_base (199)..(199): a, c, t, g, unknown or other
  misc_feature (199)..(199): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctcagggganacacgccacctctcctgcacgggccagtacggagtgtcagtaagtacttaggcgtaggtaccaacgacgtaaaccgtggacctaaggctaccccgaggcctcgatcagtctatgaccgtacacgtcgaacgcgggcctacgtcggactaacgtccccgaggccctaggtttacacggtcggaccgtaaggttcggggtactcggggaacctaggtaccctttacgaccttcgaccgacccgtataccgacgtacgacggaccttacgggaccctaggtaaacggttctttacggtaccttaacgtttcgtacgttcgtacgtacgtaccgacggtacggttcggaccggtaccgtaacgtccgtaccgtttaccgtacccgggtttcggaccggggaacggtaccgggtaagggtcgggtaacggtaactaaccggtaaaccggtacgttacgggaccggttacgtacgtacccgtactaacggtttcccgttacgttccg

SEQ ID NO: 112054 - DNA, 931 bp, Homo sapiens
  misc_feature: GYAE6OF02H0UVH.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggaccagagggaaccatggaagccccagctcagcttctcttcctcctgctactctggctcccagactaccaaccggaaaaattgtgttgacacagtctccaggcaccctgtctctgtctcgaggganacacgccacctctcctgcgacgggccaggtaggagtcgtacaaggttaacgtacttaggcgttacgggtaacccaaacgaaggaaaacccgtggacccgaaggtcccgtaccccgaagggtcccttacccgacgtaacctcccgaagttcgaacttcggacaaccttacccgaaaccgaccggggttcccctacgggtcccctaccgaacggtaaccggtacggggttccccggtagggtaccgtacggggttcggggttccgtaggggtaaccgtaggttacggtttacctaccgtttaccgtacccggaacccggttacgacgggtaccgtaacggtccggttacggggacctaccccggttggaacggtttacggttaacgtttttcggtaaccgtttaacgttttttacccgttaccgttacgggttacccgtagtacccggggttaacgttcccgggtttaacccccggacccgtacccgggttacccccgttcggtttaccccggttaacccggggttttccccggggggggaaccggggggggttaccccgtaaaggggggtttccgggaaacggggttttcccgtaaagggggttaacccggggtaacccggtaaacgtttccggggggtttacgggccccgtttaaggaccccggttaacccggtttacgtacccgggtttttcgtttacccgtacccggtttaccgtttaccccccggg

SEQ ID NO: 112055 - DNA, 769 bp, Homo sapiens
  misc_feature: GYAE6OF02HUSQI.45.36.D03.1.454.CMB.1.raw
  modified_base (321)..(321): a, c, t, g, unknown or other
  misc_feature (321)..(321): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctgctcccagataccaaccggaaaattgtgttgacacagtctccaggcaccctgtctctgtctccgaggggagacagcccaccctctccgtgcgacgggccagtaggagtcgtacgaagttaacgtacttaggcttacgggtaaccaaacgacgaaaccgtggaccacggcctaccccgaggcctcccgtanactccatcgagtccgactactacccgaacgtaccggggtccccttagggaccccgtacccgtaacggtaacccgtcgggttacccgggtggaccgtaaggggttccggggtagtccggggaaacgtagtaaccgttcgtacctccgttacgaccgtcgacgcgtaccgtccggtacggagtcccggtgtaacttcggttacgtttcggacgtttaacgttttacgtttactgggtttaccaacgtccggtacgtcccggtaccccggtacctaacccggtccccggaccctttaccgggttaacccgggttttccccggggggaccggggggtaccgtacgggggttaacgtaggtaaccggtagggccggtaaccggtacggttcggtcggtacgtccgaccggttaccacggttccgttaaccgtcggttacctacccggttcccc

SEQ ID NO: 112056 - DNA, 747 bp, Homo sapiens
  misc_feature: GYAE6OF02I89R8.45.36.D03.1.454.CMB.1.raw
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctccaggcaccctgtctctgtctccgaggganacacgccaccctctcctgcngggccagtaggagtgtacagtaagtacgttaggctcggtaaccaacgaacgaaaccgtggaccgaaggcccctaccggaggtccctaccgactaccgtaccaagtcgatcgacctacgtaccaaacggtccggtaccctagggtcccctaccggaacgtaccgttaaccgggttccggtacggaccgtaggggttccggtacggtacggggaacctaagggtacttaccgacgttccgaccgtacccgtacgacgtacgacgtccgtaggaccgtcgtagtacgtgttaagtttcggacgtttacgtttaccttacgttacgtacgtagtaccgtacggttccggtcccgtaccgtacccggcccgtaccgtccgttaccggtttccggggggaccggtaccgggtacggggtaccgaaggtacggttacgggacggtaaccggtaacgtcggggttaaccgtacggttaccggtaacccgtaaccgtacgttaccgttacgttacccgttacgtacgttaccccg

SEQ ID NO: 112057 - DNA, 582 bp, Homo sapiens
  misc_feature: GYAE6OF02G2U31.45.36.D03.1.454.CMB.1.raw
  modified_base (573)..(573): a, c, t, g, unknown or other
  misc_feature (573)..(573): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtacggagtgtcagtaagtacttaggctggtaccaacagaaacctggccaggctcccaggcctcctcatccactgatgcatccaacacgggtccctggccgtcccagaccacggttccgcggcaggtgggtcgtcgggacagtacgttacactctcgaccgtcgagcagtccgtggacgccgtgattgtaattttgacgttagtttacgttctgtcgatcgacgtccgtccgccgaccgcccgtcgtcctaaccggtttccggggccgggggtaacctggggtacgtggacgtggacggaccggtaactggtcggtactcgaccaccgtagtccgtcgtcttaccncttaccccg

SEQ ID NO: 112058 - DNA, 812 bp, Homo sapiens
  misc_feature: GYAE6OF02JS9RD.45.36.D03.1.454.CMB.1.raw
  modified_base (205)..(205): a, c, t, g, unknown or other
  misc_feature (205)..(205): n is a, c, g, or t
  modified_base (681)..(681): a, c, t, g, unknown or other
  misc_feature (681)..(681): n is a, c, g, or t
  modified_base (717)..(717): a, c, t, g, unknown or other
  misc_feature (717)..(717): n is a, c, g, or t
  modified_base (766)..(766): a, c, t, g, unknown or other
  misc_feature (766)..(766): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcacctgtctctgtctccgaggggagacngccaccctctccgtgaccgtacgggcccaaggtacgggtacgtcgtacgtaacgttaaacgtacgttagggccttacggggtaaccaaacgtacggtaaaacccgtcgggaccgaagggtaccccacccgtaacggtccttccccgtacgtaacctacccgtagttacgacgtcggtacccaagtaccctaaaccggtaaccggggtttcccctaggggtacccccgtaccccgtaaggaaccggttaaccgggtttcccgggtcggtaccgtacggggttcggggttcccgtaacggggaccggtagtacggttaccaccgttaccgtccggtaaccccgtaggaacgtccgtaacggtcccgtaagggtacccgtctacgggaatttcggtaattttccgggaactttaccgggttttactcgttccgggtacacggtttccgacggtaccgttcccggaaccctggccccgtnttacggttacccggtcggggggaccggggtaacccnggggtacgagtacgtaggaccggacccggttaaggtcgttacgggccgngtaacccacgttgtccggtttcggttcccttaaggtccggttcccc

SEQ ID NO: 112059 - DNA, 736 bp, Homo sapiens
  misc_feature: GYAE6OF02I9U79.45.36.D03.1.454.CMB.1.raw
tcagacgcgatcgacacgaccggtgctcgatttagctgcgtcacgatctctcgttgggggaggaactgctcagttaggacccagagggaaccatggaagccccagctcagcttctcttcctcctgctactctggctccagataccaccggaaaaattgtgtgacacagtctccaggcaccctgtctctgtctccgagggagacacgcccacctctcctgcagggccaggtaggagtgtcaaggtaagtacgttaggctcggtaaccaacgacgaaacctcgggaccaggtcctacccgacggtcctacccgtcactccagtcggatcgacaactcccgaacgaccggggtccctcgggcccgtacccgaaggaccgtacgggttcccggtggtaccgtagggttcgggtcgttacggggaacgtacggtacgtttccgaaccttccgtacccgtacccggtacgaacgtccgaacggtccgtacgggtacggtccgtcgtagttacgttacgtttcgtacgttaacgtttccttacgttcgtacgtcggtaccgtacggtcccggtacccgccgtaaccggtcccggtacgttacccgttccgggtttaccggggaccggggggtaccggtaacgggggtacgggaacgtcggtacgggacggtaaccgggtaacgtcggtacggtcgtacggacctacgtacgttaccgttaggtccgttacgtccgtttccccg

SEQ ID NO: 112060 - DNA, 594 bp, Homo sapiens
  misc_feature: GYAE6OF02HI6A7.45.36.D03.1.454.CMB.1.raw
  modified_base (284)..(284): a, c, t, g, unknown or other
  misc_feature (284)..(284): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
tcagacgcgatcgacacgaccggtgctcgatttagctgcgtcacgatctcccttggggagggaactagctcagttagggtacccgacgagggaaccgaactggaaggaccccacgctcagcttctcttcctcctgctactctggctcccagataccaccggaaaaattgtgttgacacagtctccaggcaccctgtctctgtctccaggggagacacgccaccctctcctgcacgggccagtaggagtgtcagtaagtacttaggctggtaaccaacagaaccnggccaggctcccaggctcctcatccatgactgcaatcccgaacaggggtcccctggccgtacccagaaccgtcggttccggtgcgagtcggggtctagggacagtgttcactcgtcaccggtcagcacgccgtggacnccgtagagtgtntttgcgtagtttacttctgtcgagcgtacgcgttccgccacgtccgtcctcgtaccgtttcggggccgggggtaaccgtaggggtgacgagtcggacgaaccggtacgtggtcgggtactacggaccacgtcttccgtgtacgttctacgtcccttcccg

SEQ ID NO: 112061 - DNA, 693 bp, Homo sapiens
  misc_feature: GYAE6OF02JKMRO.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccacctctcctgcgaggccagtaggagtgtcagtaagtactaggctggtaccaacagaaaccgtggaccaggcctcccgaggcctccgtacactcccagtgactgacactaccaacgtccgggttccctgggccctacccaggtaccgtaggggttacccgtggacgtagggttcgggtccggtaggggaccgtaggtacgttccaacgttccgtaccgtaccggtcaacggtcacggtccgtacgggtacgtccgtagacgttcggttagttttacgaccggttaagtttttaccttcgtcgttacgacggtcgtaaccggttccggtacccgaccgtaccggtacccgtcgtcccgttaccgggttccgggggtaccgggggtaccgtacggggtacggagtaccggtagggacgtaacggacgttcggtaggtccgtacgaccgtacctagttccgttacgttccgttacgccctttacccgg

SEQ ID NO: 112062 - DNA, 572 bp, Homo sapiens
  misc_feature: GYAE6OF02F4OYU.45.36.D03.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggctcctcatccatgatgcatccaacagggtccctggccgtcccagacacggttccgnggcaggtgggtctgggacnggagttcactctcaccgtcacggcagccgtggacgccgtgatgtattttgctagtttacttctgtcagcacgtccgttccgccaccgcccgctccgaccggtttccggggaccgggggtacctaggggtcggacggtagtcggacggtaacggtaacggtggtacgggcgttcggaccgaccgtacgtccgttagtccttactacttccccg

SEQ ID NO: 112063 - DNA, 626 bp, Homo sapiens
  misc_feature: GYAE6OF02I5ZQS.45.36.D03.1.454.CMB.1.raw
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
  modified_base (592)..(592): a, c, t, g, unknown or other
  misc_feature (592)..(592): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctcaggcaccctgtctctgtctccaggggagacagcccacctctcctgcagggccagtaggagtgtcaagtaagtacttaggctggtaaccaanagaaacctggaccaggctccaggctcctcatccaatgatgcatccaaacgacgggtccctggcctaccagacgcgggttccgnggctaggttgggtctgggacagtacgttcactctccaccggtcacggccagcctagggacgtcccgtagtcgttagttagttttacggacttacggttttaccttacttggtaccagttcgaggtccgttcccggaccgacgcccgtcctacgtacccggtttcgggggaccgggggtaaccggtaggggtgggaggtacgtgacggtaacggaaacgttggtacggtccgtacggccgtaaccncgtttaccgtcggttacctttcgtactttcccgg

SEQ ID NO: 112064 - DNA, 780 bp, Homo sapiens
  misc_feature: GYAE6OF02JSKF9.45.36.D03.1.454.CMB.1.raw
  modified_base (202)..(202): a, c, t, g, unknown or other
  misc_feature (202)..(202): n is a, c, g, or t
  modified_base (413)..(413): a, c, t, g, unknown or other
  misc_feature (413)..(413): n is a, c, g, or t
tcagacgcgatcgacacgaccggtgctcgatttagctgcgtcacgatctctcttgggggaggaactgttcagttaggacccagagggaaccatggaagccccagctcagcttctcttcctcctgctactctgctcccagataccaccggaaaattgtgttgacacagtctccaggccaccctgtctctgtctccgagggganacacgcccaccctctcctgcgacgggccaggtacggagtcgtcaagttaacgtacgttagggcttacgggtaaccaaagtacgtaaaaccgtcggacctagggccttacccccgaggtcccttacccgtacactccaacgttaggactggacctaactaccgaacgtacgggtccccgtaggcccgtacccgaggacctacgggttccggnggaccgtaggttcggggtaccgtaggggaacccacgggtttacgttaccctaacggttccgtaccccgtacccgggtacgtacgggtacccacgggtacccggtttacggaccgtacccgtttggtacgttaccggttagttttaccggtaccgttacgttttaaccgtttcgttacgtcgtaccgttcgtacggtcccgttacccgtccggtaccgtccgttaaccgtccgtaccgggttaccggggccgggggtacctaggggtacggagtacgggtaccgaggtaccggtacggtacgtcgggtcctacgtcccgaacgtttcggacccgtttggttcccttacggtcccgttacccgtacccg

SEQ ID NO: 112065 - DNA, 769 bp, Homo sapiens
  misc_feature: GYAE6OF02GM04C.45.36.D03.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcagggccagtaggagtgtcagtaagtacttaggctggtaccaacagaaacctggaccaggcctccgaggcctcctcactccatgatgctanaccgaacgacgggtccctgggacccgtacccgaaggaccgtacgggttccggtggaccgtagggtcggggtacgtacggggaaccgtaggtaccggtttaccaacgttcccgttacccgaacccggttcgaacggacccgtacggtacccggttacggggaccgtacccggttaggtaacgttacggtttaagttttacggtaccgtttaacggtttttaaccgtttcggttacggtttaccgtaacgggaccttaacggtcccggtttaccccgggacccgtaacccggtccccgtaccgttacccgttaccggggtttcccgggggaccggggggttacccgggtaagggttcggggaacgtacggttagacgggaaccggtaacgttacggggtggtaccgtacgaccgtaaccgtacgttaccggttacgttaccgtttacgtacgttccccg

SEQ ID NO: 112066 - DNA, 704 bp, Homo sapiens
  misc_feature: GYAE6OF02GWTNV.45.36.D03.1.454.CMB.1.raw
  modified_base (201)..(201): a, c, t, g, unknown or other
  misc_feature (201)..(201): n is a, c, g, or t
  modified_base (351)..(351): a, c, t, g, unknown or other
  misc_feature (351)..(351): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccacctctcctgcagggccagtaggagtgtcagtaagtacgttaggctggtaccaacagaaacctggaccaggcctccaggctcctcactccatcgatcgcactcaacgacgggtccctggccgtacccagtaccgaggttaccgnggtcaggtgggtcgtgggtaactagtacgtccacttctacgaaccgtcgacggtcacgaccgttcggacgtcccgttaggtacgttaggttacgttttacggacgttaacggtttttacccttgttacggttcgtaagccgttacggtaccgtttaccccgcccgtaaccggtccgtaccgtttaccggttaccgggtttccgggggcccgggggggaaacgttacggggtacggtaacgggtacggttacggaacggttaccggtaaaccggttgggtaaccggtccgtaaccggtccggtaacccttgtttaccccgttagtttacccggtttactaaccggtttccccgg

SEQ ID NO: 112067 - DNA, 789 bp, Homo sapiens
  misc_feature: GYAE6OF02F0124.45.36.D03.1.454.CMB.1.raw
  modified_base (202)..(202): a, c, t, g, unknown or other
  misc_feature (202)..(202): n is a, c, g, or t
  modified_base (388)..(388): a, c, t, g, unknown or other
  misc_feature (388)..(388): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggganacagccaccctctcctgcacgggccaggtaggagtgtcgaagttaagtacttaggcctaggttaacccaaacgaacgtaaacctggacccgaacggcctaccccgaggccctcctaccactcccatggctgccataccaaacggtcgggtcccctggaccctcccgacgaccgtacgggttcccgnggccgtagggtcgggtcgtacggggacctaggtacggttccaacgttcctccgtacccggttaccacggaacgtaccggtccgtacgggacggtccgtacggtacggttacgttacggttttcggttaccggttaaccgttttaccgtttaccgttcggttaccgtacgtaccggtacgttcccggttcccggtcccggtaccccggtacccgtacccgttcccgttacccggggtttacccgggggtacccggggggtaaccggggtacggggtaacgggtacgggtacggtacgggtaacgggtaaccggtaacggttacgggttacgggtaccttaccgggggggtacctaccggtacgttccgttaccgttaccgtttccgttaccgtttaccccgg

SEQ ID NO: 112068 - DNA, 725 bp, Homo sapiens
  misc_feature: GYAE6OF02H7JPS.45.36.D03.1.454.CMB.1.raw
  modified_base (201)..(201): a, c, t, g, unknown or other
  misc_feature (201)..(201): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
tcagacgcgatcgacacgaccggtgctcgatttagctgcgtcacgatctctcttgggggaggaactgctcagttaggaccagagggaaccatggaagccccagctcagcttctcttcctcctgctactctggctcccagataccaaccggaaaaattgtgttgacacagtctccaggcaccctgtctctgtctcgaggganacagcccacctctcctgcgacggccagtaggagtgtacagtaagtacttaggcttaggtaccaaacaacgaaacctggaccgaggcctaccgaggactcctcactccatgatcgcactaccaacgtcggtccctggccncccagaccgtaggtccgtggacngggttggtcgtggacgagtcgttacacttctaccgaccgtacagtccagtcccgtagggtacgtccgtgtacgttagttagttttcgaaccgttttagttttaaccgttccgttcgtttacgacgtaccgtacggtacccggtttaccccggccgtaacccggtcccttaccgttaccggttaccccggggttttacccggggggaaccggggggtaacccgtaaggggggttacggtaacggtaacgggttaccgggtaacggtaacccgggttcgtagggttaccgggcccggttaaccgacccgtaaccgtacgttcccgttaccggtttacctttacccggtacccgtttacccccgg

SEQ ID NO: 112069 - DNA, 623 bp, Homo sapiens
  misc_feature: GYAE6OF02FS6JR.45.36.D03.1.454.CMB.1.raw
  modified_base (260)..(260): a, c, t, g, unknown or other
  misc_feature (260)..(260): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccacctctcctgcagggccagtaggatgtcagtaagtacttaggctggtaccaanagaaacctggaccaggctccccgaggcctcctcatccatgatcgcactaccaacgtacggggtcccctgggcccgttccccgagtaccgtacgggttccggtggccgagggttcggggtcgtggggaacaggtacgtttcacgttcctaccgaccgtccaacgcctacgccgtggacgccgtgagtgtacttttcgcttagtttacttcgttgtcagtcgacgtccgtccgccgtaccgccgtccttcgtaccggtttccggggacgggggtaccgtacggggtgggacgtacgtagacggacggtaacgtggtcggcgtacggaccgtaccgtagttccgtcgttcgttactacgttccccg

SEQ ID NO: 112070 - DNA, 672 bp, Homo sapiens
  misc_feature: GYAE6OF02H9FD8.45.36.D03.1.454.CMB.1.raw
  modified_base (201)..(201): a, c, t, g, unknown or other
  misc_feature (201)..(201): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccagtaggagtgtacagtaagtacgttaggctggtaccaacgagaaacctggccaggctcccgaggcctctcatccatgatgcactccgaacgacgggtccctaggccgtcccgaagacgtacggttccgnggctaggtgggtcgnggggacaggtagtcactcgtcaccgtcagcagcctaggcgccttggataggttctttgacttagttttaccttntacggtnacgtctaacggtccgtttacccgaccgacccggtccgtaccgttcgttaccgggttttaccggggggaccgggggggtaacccgtagggggttacgggaacgtacggttacgggaaaccggtaaccggtaaggttaccgggtacgggttcctacggggtaccctaacccggttaagtttccccggtaccggttttcctttacccgtaccgtttaccccccg

SEQ ID NO: 112071 - DNA, 636 bp, Homo sapiens
  misc_feature: GYAE6OF02F56IR.45.36.D03.1.454.CMB.1.raw
  modified_base (415)..(415): a, c, t, g, unknown or other
  misc_feature (415)..(415): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccagggggctccaggctcctcatccatgatgcatccaactacgggtccctggccgtcccagacgtacgggttccgtggctaggtcgggtcgtggggactaggtacgttcacgtctactacccgtcacgcgacgccgtggacnccgtgatgtattttgcttacgtttacttcgttgtcagtccgtacgtccgttcccgcccgtaccggcccgtccgttccgtaccggttttaccggggggccggggggtaaccgtagggggtacgggaggtaacggtggaacggtaccggtaaacggttcggtacgggtaccgtcggacccgtaccgtagttccgtacggttcctttaccgacgtttaccccgg

SEQ ID NO: 112072 - DNA, 828 bp, Homo sapiens
  misc_feature: GYAE6OF02I6R9L.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcaggccagtaggagtgtcagtagtacttaggctggtaccaagacgaaccgtggaccaggctcccgaggctcctcactccatgatgcactccaagtaccgggtcctcgggtccctacccgagaccgtacgggttccgtgggccgtagggtcgggttccgtggggacctaggtacggtttccacgttccgtaccgacccggttccgacgtcccacggtcccgtagggacgtcccgttaggtaactttggttaaacgtttttcggaaccgtttaacggtttttacccttcgtttacggttaccaacgggttcccgtacgggtttccccggttacccgtacccgtaccccggtcccgtttcccgttaccccggtttaaaccggggtttttcccgggggggaaccccggggggttaaccggtaccgggggttttaacggggaacggttaacccgggtttacggggaaacccgtttaaacccggggtaaccgtttacggggggtttacccggggtactttaacccggggtaacccccggttaaagtttaccggtttaccccggttttaccgggtttaccccgttttaacccgttcccgttttaacccccccggg

SEQ ID NO: 112073 - DNA, 650 bp, Homo sapiens
  misc_feature: GYAE6OF02HDYKH.45.36.D03.1.454.CMB.1.raw
  modified_base (202)..(202): a, c, t, g, unknown or other
  misc_feature (202)..(202): n is a, c, g, or t
  modified_base (351)..(351): a, c, t, g, unknown or other
  misc_feature (351)..(351): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtactaggctggtaccaacagaaacctggaccaggcctcccaggctcctcatccatgatgcactccaacgacgggtccctgggccgtacccagaccgagggttcccgnggctaggtcgggtctaggggactaggtacgttccacgtcgtacaccggtcacgtcacgccgtggacgcctagattgtacgttttgacttaggtttacttcgtgtacagtcacgtccgttaccgccgaccggtccgtctaccgtaccggtttccggggaccgggggtaccgtaggggtacggaacgtacggtacggaacggtaaccggtaacggttcgggttaccgggtccgttacggtacccgttaacccgtacggttacccgttaccgggtttccttaccggtacccgtttcccccgg

SEQ ID NO: 112074 - DNA, 794 bp, Homo sapiens
  misc_feature: GYAE6OF02JOZL9.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgcttcttttaagaggtgtcctagtgtcaggtgcaggtggtggaggtcggggggaggcgttgtccgaggccgttggggacggtccctggacgtacgtctcctggtcgcaggccctcgtggacttcctcccctactagttaacttttcggtttccctacgttcggggtcccgtccgtaacggtttcccgaggtccgaagggggtccgttggggaacggtggggtcggtacccttcgtacgtttaccgaagtagtggaagtgaaggacggcctagacagactcgaggaacggccgtactacaccattcctccaagacgtaacctaacttacaaacgtaactcgttccgttacgttttacgaacctaaacgttaacgtaacgttacgtacccgttaggaaccgttaggttaacggtaacgggtaaccgtaaccgggtttaccgttacggtttaccgttaagttttacccgttacgggttacccggtaccgggttaaccgggggggtaaaccctttaaacgggtttacttaacggttaaacggggttcgggtttacccggtttaacggggttttaccgggttttaaacggttacgggttttaaaaaccggttacccgttaaaaacccgg

SEQ ID NO: 112075 - DNA, 638 bp, Homo sapiens
  misc_feature: GYAE6OF02HFZ8D.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggaccaggctcccgaggcctcctcatccatgatgacatccaacgacgggtccctgggccgtacccaggaccgtacgggttccgtggactagggtcggggtctcgggggaactagggtacgtttccaccttctaccgtacccgtacacgcacggtccgtagggacgcctaggattggtattttcggcttagttttactcttgtctagctacgtccgttccgccaccgtcccgctccgtaccggtttccggggaccgggggtaccgtggggtagacggtagtcggaacggacggtaacggtcggtacgggtcctacggtaccgacccgttagttccggttcggtttacctttaccgtacgtttcccccg

SEQ ID NO: 112076 - DNA, 838 bp, Homo sapiens
  misc_feature: GYAE6OF02IP8B5.45.36.D03.1.454.CMB.1.raw
tcagacgcgatcgacacgaccggtgctcgatttagctgcgtcacgatctctcgttgggggaggaactgctcagttaggacccaggagggaaccatggaacgccccagctcagcttctcttcctcctgctactctggcctcccagactaccgaaccggtaaaattgtgttacgacactagtctccgaggcctaccctgtcctctgtctccgagggacacacgcccaccctctccgtgcgacggcctaggtaggagtcgtcgaagtaacgtacgttacggcttacggtaaccaaacgaacggaaaccgtcggaaccgacggtacccgtaccccgagggtccctacccgtacctacgtacccgtaagtcgtacgtcgaacctaacctacccgtaaacggtaccgggtcccgtacggcccgtaacccgacggtaccggttaccggggttccggtacggaccgtagggttacgggtccgtagggacgtaacggtacgttaccgtacgttccgaccggtaccggtacgacgggtacccggccggtacggaacgtcctaggtacgttacgttatttcgacgtttaaccgtttaccgttgtaaccggttacgtagtaccggttacccgtacccggttccgaccccggtacccgtccccgttcgttaaccgggtttcccggggtaaccgggggtacccggggtaacgttcggggtaacggtaacggtaaccggtcggaacccgggttaaccggtagggttaccgggtcgggtacccgaccgggtacccctaaggttccgttccggttacccgtttaccgttacccgtacccggttccccgttacccg

SEQ ID NO: 112077 - DNA, 618 bp, Homo sapiens
  misc_feature: GYAE6OF02FLFBA.45.36.D03.1.454.CMB.1.raw
  modified_base (203)..(203): a, c, t, g, unknown or other
  misc_feature (203)..(203): n is a, c, g, or t
  modified_base (357)..(357): a, c, t, g, unknown or other
  misc_feature (357)..(357): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccgagggganacagccaccctctcctgcagggccagtaggagtgtcagtaagtacttaggctggtaccaacagaaacctggaccaggcctacccgaggcctcctcactccatgatcgcactccaacgacgggtccctgggcctcccagaccgtacgggttccgnggaccgtgggtcgggtcgtagggactaggtacgttcacttcgtccaccgtcacgccgacgtccgtggacgcctagattgtagtttgacttacgtttacttcgttcgtcgagtcgtacgtccgttcccgccgtaccgtcccgcgttcgtaccggtttccggggcggggtaccgtggggtacggagtaggtggacgtacggtacgtggtacggcgtacgtcgtaccgtacttcgttcgttacgttcttaccgttccttccccg

SEQ ID NO: 112078 - DNA, 672 bp, Homo sapiens
  misc_feature: GYAE6OF02F7R23.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagcccaccctctcctgcagggccagtaggagtgtcagtaagtacttaggctggtaccaaacgagaaacctggaccaggcctcccgaggcctcctcactccatgatgcatccaacgagggtccctggccgtcccagaactcggttaccgtggctaggtgggtcgtgggacaggtacgttccactctccgaaccgttgaacgcacgccgtcgggaacgtcccgtagtacgttggttagttttacgtacgtttacggttttaacctttccgttagtcgtacggtaccgttacgtacccggtttacccgcccgtaacccgtcccggtaccgttaccgtaccggttttcccggggaccggggggtaaccgtagggggtcgaaggtacgtacgggaacgaaccggtaaacgttcggtacggccgttcggaaccgtacgtaacgttccgttgttcccgttacgttaccgttccccg

SEQ ID NO: 112079 - DNA, 733 bp, Homo sapiens
  misc_feature: GYAE6OF02ISBD2.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctcggccccagataccaccggaaaattgtgttgacacagtctccaggcaccctgtctctgtctcgagggganacagccaccctctcctgcacgggccaggtaggagtcgtacaggtaacgttacgttagggcttacggtaacccaaacacgaaaacccgtggaccgaggtcctacccgacggcccttcctactactccagtagacgtcgactactacccgaaacgtacggggttcccctgggtaccgtacccgaagtaccgtacgggttccgtcgggacgtagggttcgggtacggtcggggtaactaggtacggtttccacgttctaccgaccgtcacggtaccacgtccgtaggacgtccgtagtacttggttacgtttcgtacttacggttttaccttcgttacgttacgacggtctacggttccggtcccgcccgtaccggtcccgtaccgttaccggttaccgggtttccgggggaccggggggttaccgtacgggggttacggaggtacgtagggacggaacggttacggtcgggtacgtcgtacggaccgtaacgttacgttcgttaccgttacttccttaccgttccttaccccgg

SEQ ID NO: 112080 - DNA, 812 bp, Homo sapiens
  misc_feature: GYAE6OF02HVL2C.45.36.D03.1.454.CMB.1.raw
  modified_base (217)..(217): a, c, t, g, unknown or other
  misc_feature (217)..(217): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctccngcagggccagtaggagtgtcagtaagtactaggctggtaccaacagaaacctggccaggcctccgaggcctctacactccatagatcgacactaccgaacgtacgggtccctggaccgtacccgagaccgtagggttccgtggcgtacggtgggtcgtagggactaaggtacgttccgaaccttccgtaccctaaccggttcccgaagggtacccgtaacgggtccccggttagggtaaccggtcccccgtttaaggtaaccgttttagggtttaaaccgttttttcgggaacccgttttaaacggggttttttttacctttaccggttacgggttttaacccgtacgggtacccgttaaacgggttcccccgggtttaaccccgcccggttaaccccggtccccggttacccgttacccggttaacccggttttccgggggggacccggggggttaacccgtagggggttacggtaacggacggttacgggaacggtaaccggaaggtttcggtaccgggtccgttaccggacccgtaaacccggttacgttacccgttcggtttaacctttcccgtaaccgttttccccccgg

SEQ ID NO: 112081 - DNA, 760 bp, Homo sapiens
  misc_feature: GYAE6OF02HF78N.45.36.D03.1.454.CMB.1.raw
  modified_base (177)..(177): a, c, t, g, unknown or other
  misc_feature (177)..(177): n is a, c, g, or t
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (395)..(395): a, c, t, g, unknown or other
  misc_feature (395)..(395): n is a, c, g, or t
  modified_base (416)..(416): a, c, t, g, unknown or other
  misc_feature (416)..(416): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
tcagacgcgatcgacacgaccggtgctcgatttagctgcgtcacgatctctcttggggaggaactgctcagttaggacccaggagggaaccatggaacgccccagctcagcttctcttcctcctgctactctggctcccagactaaccaaccggtaaaaattgtgttgacacagtcnccaggcaccctgtctctgtcncgagggnacacgcctacctctcctgacgacgggccaggtaggagtcgtacaagtaacgtagttaggcgttaggaaccaaacgaagtaaaccgtggaccgacggacctaccccgaaggtccctccgacaactccagtagactcgactactaccgaaacgtccggtccgtggacctaccgaagacgttacgggttccgngggactacggggttgggtacncgggggaactaacgtacgtttcaaccgttcctagacccgtanaacgngaaccgtacgtcggaccgcgttacgacgtagtttacgttacgtacgttaacgtttacttacgtacgttacgtacgtacgtaacggttccgtacccgtacctaacccggtcccgttacgttacccgtaccgggttttaccggggaccggggggtaaacccgggtacggggtaacggtaaccgggtaaggttacgggaacggttaacggtaaacggtacggttacgggtaacccgtacgttaaccgaacccgtaacggtttcccgttacggtttacccgtttacgtaccgttaccccgg

SEQ ID NO: 112082 - DNA, 610 bp, Homo sapiens
  misc_feature: GYAE6OF02G4I31.45.36.D03.1.454.CMB.1.raw
  modified_base (344)..(344): a, c, t, g, unknown or other
  misc_feature (344)..(344): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcaggccagtaggagtgtcagtaagtacttaggctggtaccaacagaaacctggccaggcctcccagctctcatccatgatgcactccaacacgggtccctggccgtcccagacgtacggtttccgnggcagggtgggtctggggaacaggagttcactctcaccgtcagcagccgtggacgccgtgagttgtattttacgcttacgttttaccttcttgtaccgtagcgtagccgttcccgccacgcccgtcctcgtacccgtttccggggccgggggtaccgacggggtggaggtagtacggaacggtacgggtaaacgttgggttcggaccgttacggccgtaaccgttacgttaccgttccggtttcctttaccggtactttcccccgg

SEQ ID NO: 112083 - DNA, 566 bp, Homo sapiens
  misc_feature: GYAE6OF02ITRDG.45.36.D03.1.454.CMB.1.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
  modified_base (543)..(543): a, c, t, g, unknown or other
  misc_feature (543)..(543): n is a, c, g, or t
  modified_base (558)..(558): a, c, t, g, unknown or other
  misc_feature (558)..(558): n is a, c, g, or t
tcagacgcgatcgacacgaccggtgctcgatttagctgcgtcacgatctctcttgggggaggaactgctcagttaggacccagaggaaccatggaagccccagctcagcttctcttcctcctgctactctggctcccagataccaccggaaaattgtgttgacacagtctccagcaccctgtctctgtctccgagggagacagccaccctctcctgcagggccagtaggagtgtcgagtaagtcgttaggctaggtaaccaacgagtaaaccctggccaggctcccaggtcctcncatccgatgatgactacnccaacgcgggtccctggccgtacccaggaccgtcgggtttcccgaggcctagggtcgggtaccgtaggggacctaggtacggttcatccgtacgacctnacggcagtccgnggacncctggatgtcttttgcttagtttctcgtntcagtcngtctaccgcncgccntccgtacggttcgggaccgggtacgaggtcggagtagcgagtacggcgtggtggactcggacncgtatcgtagtcttncttacccg

SEQ ID NO: 112084 - DNA, 542 bp, Homo sapiens
  misc_feature: GYAE6OF02IN1ZS.45.36.D03.1.454.CMB.1.raw
  modified_base (292)..(292): a, c, t, g, unknown or other
  misc_feature (292)..(292): n is a, c, g, or t
  modified_base (343)..(343): a, c, t, g, unknown or other
  misc_feature (343)..(343): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccaggctccncatccatgatgcatccaacgcgggtccctggcgtcccagactaggttccgnggctaggtcgggtctggggacaggtagttcactctcaccgtcagcagctggacncctgntgtatttgctagtttcttcgtgtcagctagtccgtccgccacgccgctctaccggttcgggccggggaccgtgggtgagagtacgagtacggtaacgtggtcggcgtcgacctaccgtatcgtcgtcttcgtacttcccg

SEQ ID NO: 112085 - DNA, 666 bp, Homo sapiens
  misc_feature: GYAE6OF02GUMI4.45.36.D03.1.454.CMB.1.raw
  modified_base (339)..(339): a, c, t, g, unknown or other
  misc_feature (339)..(339): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaacggaaaattgtgttgacacagtctccaggccaccctgtctctcgtctaccgagggagacacgccaccctctcctgcgacgggccagtaggagtgtacagtaagtacttaggctaggtaaccaagacgaaccgtggccgagcctaccgaggcctcgtcactccagtgatcgctactccgaacgtcggtcccnggacctcccgagtaccgtaggttccggaggactagggtcgggtcgtacgggaacaggtactcgacgtctacgaccggtacagaccgacgtccgtaggaccgtccgtagtagtacgttacgttttcgacgttacggttttactcggttacgtacgtaacgcttacgggtcccgttaccggccccgtaccgcccgttcctaccggttaccgggttccgggggaccggggaaccgtaggggtacggagacgtcggaacggtaccggtaacggttcggtcggtccgtacggaccctaacggtcgtttcgtacgttccttactccgttcccg

SEQ ID NO: 112086 - DNA, 769 bp, Homo sapiens
  misc_feature: GYAE6OF02JK3F1.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacacgcccaccctctcctgccagggccaggtaggagtgtcagtaacgtacgttaggctaggtaccaacaacggggggggaaacctcggaccgacggcctcccgacggtcctcctcactccatagactgacactaccaaccgtacgggtcccgtcggtccgtacccgacggtacgtacggttccggtcggacgtacgggtcggggtacgtacggggacgtacggtacgttaccgtacctccgtaccgtaccggtacgacgacgtacggtccgtacggacggtccgtacggtacgttaggttaacgttttcggtaccgttacgttttaccgtttcgttcgtaccgtacgtaccgtacggtcccggttcccggtacccgacccggtacccggtccttacccggttaacccgggttcccgggggtacccggggggtaccgggtaacggggttacgggtaacggtacggtacggtaacggtaaccggtaaccggttacgggtacgggtaccgtaccggtacccgtaccgtaccgttccgttacggtttaccttaccgttacccgttaccccg

SEQ ID NO: 112087 - DNA, 1021 bp, Homo sapiens
  misc_feature: GYAE6OF02JJM2E.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaattgtgttgacacagtctccagcaccctgtctctgtctccgagggagacacgccaccctctccgtcgcgagggcctaggtaggagtgtaccaggtaacgttacgttacggcgtaggtacccaaacgtacggaaaacccgttggacccgaagggtaccctaccccgaacgggtcccttcccgtaccgaacttacccgtaagttacggaacttccggacctacgttaaccccgtaaaccggtacggggttccccctggggtaccccgtacccgtaacggtacccgttaccggggtttacccggtacgggtaccctaacggggtttcgggtaccggttacgggggtaaccgtaacgggttacggttttacccgaaccgtttcccgtaacccgttaaacccggttaccgaacggtcccgtaaacgggtccccggttaaggggtccgtaaaccccgtttagggtaagtttccgggtttaaacgtttttccggtaacgtttacggggttttttaaacccttccggtttaacggttaccgtaaacgggttccccgttaacgggttacccggttttaccccccggcccggttaaacccgggttccccgttacccgttttaaccggttaccccccggggggtttacggggggaaaccccgggggggtttcccgtttaaagggggggtaccggtaaaaccgttacgggggttttacccggaacggggggaaccccgttttaaacgggggttcggggttacccggttaaccggttaaccggggtaacctttaacccccgggtaaagtttttcccggttaaccccggttttttaacccgtaccgggtttaaccccgttcccccgggttttaaccccccgg

SEQ ID NO: 112088 - DNA, 832 bp, Homo sapiens
  misc_feature: GYAE6OF02ICW0N.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtagtactaggctggtaccaacagaaacctggccaggcctccgaggcctcctcactcatgatcgacactaccaacgtacgggtccctacggccgtacccgaggtaccgtacgggttccgtacggaccgtaggggttcgggtacgtaggggactaaggtacgttacctacgttccgtaccgtacccggtacgaacggtacccgtacggtcccgtaggggtacccgtacccgtttaggaacgtttacggttttaacgttttcgggaaccgttttaacggttttttacccttcggttacgggttacgacggttacccgtaacgggttccccggtttaccccgaccccgtaacccgggtccccggttaccgttacccgggttacccgggttttacccgggggggggaacccgggggggttaacccgtaacggggggggtttacggaaacgggttacgggttacggggtaaaacgggttaaacccgggtaaccggtttacggggttaccgggtccggtttaccgaaccccggttaaccgttaccggttacccggttttacggttacccgttttacccgaaccgttttcccccccgg

SEQ ID NO: 112089 - DNA, 734 bp, Homo sapiens
  misc_feature: GYAE6OF02HVIB9.45.36.D03.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (685)..(685): a, c, t, g, unknown or other
  misc_feature (685)..(685): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctggcactctggctcccagatacccaccggagaaattgtgttaacacagtctccagccacctgtctttgttccaggggaangcccacctctcctgcgagggccagtcagggtnttaacagctacttagcctaggtaaccaaacaaaaactggaccaggcctaccgaggcctcctcatccatcgatcgcataccaacgacgggtcccctggccgtcccaaggaccgtacgggttccggtagggcctaagggttcgggtccgtagggtaaccgaggtacgttccgaacttcccgtaccgtaaccgtcgaacgactacggtcccgtagggtaacgtcccgttaggtacgtttacgtttacgttttcggtacctttacggtttttaaccttcggttcgtacgtaccgtaacgtccgttcccggttacccgaccctaccgggtccctacccgtttaccgttaacccgggtttccgggggacccggggggtaccctagggggtacgtaacggtagttacgggaaacggtaacggtaacgttgggtaccggaccgtcgaccgtaaaccgtntccggttcgttacctccggttaacttccccgtccggtcctaacgttccg

SEQ ID NO: 112090 - DNA, 687 bp, Homo sapiens
  misc_feature: GYAE6OF02FV8A0.45.36.D03.1.454.CMB.1.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagactaccaaccggaaaattgtgttgacacagtctccaggcaccctgtctctgtctccgaggganacagccaccctctcctgacagggccagtaggagtgtcaagtaagtacgttaggctggtaaccaanacgaaacctggaccaggcctccgaggcctcctcatccatcgatcgactactaccaacgtacgggtccctggccgtaccccaggaccgtagggtttcccgcggaccgtaggggttcggggtcgtaggggaacctaggtacggttcaccgttccgtccgtaacccggtgaacgcgacgtccgtaggcgtaccgtgtacgttggtaacgttttcgaccgttagttttaccttcgttcgtcgtacgtccgtacggttccgtacccgccgtaccggccgtcccgttcggtaccgggtttcccgggggaccgggggtaaccgtggggtaacggtagtacggtaggaaccggtaacgtaacggttcggacggttaccgtacggacctaccgtacgttaccgttcgtcctttactcccgttaccccgg

SEQ ID NO: 112091 - DNA, 728 bp, Homo sapiens
  misc_feature: GYAE6OF02IZ2AH.45.36.D03.1.454.CMB.1.raw
  modified_base (203)..(203): a, c, t, g, unknown or other
  misc_feature (203)..(203): n is a, c, g, or t
  modified_base (493)..(493): a, c, t, g, unknown or other
  misc_feature (493)..(493): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccaggcaccctgtctctgtctccgaggggancacgccacctctcctgcacgggccagtaggagtgtctaagtaagttacgttaggctacggtaaccaacgacgaaacctggccagctccgaggcctcactatccatcgatcgacagtacccgaacgacggttcccgaggccgtacccgagacgtacggttccgcggacgagggttcgggtacgtcgggaagtcggtacgttccgaacgtccgtaccgtaaccggtcaacggctaccggtcgtacgggacaccgtggtaactcgtttaagttcgtacgttaacttttcccgngtttaccggctacggttcgaccgttccggttacccggacctaccgggtccccgttgtaacccgtttcggttaccccggggggggacgggtaacccggtacggggtttaggaacgtttaccggagggtaaccggttaaaccgggtcggttacggtaccgttacccgggtaacggtaccctaaccggggtttctaccgtttacgggttaccccgttaagtccccctttaaccccggg

SEQ ID NO: 112092 - DNA, 720 bp, Homo sapiens
  misc_feature: GYAE6OF02FQJHK.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccagcacctgtctctgtctccagggacgacagccaccctctcctgcgacggccagtaggagtgtacagtaagtacttaggctaggtaccaacacgaaacctggccaggcctcccgagcctacctcacgtccaagtacgatcgcctagtaccgaacgtacggtcccgtaggccgtacccaagtaccgacggttaccggtggcgtagggtcgggtcgtagggaaccgtagtacggttacctaccgtaccgtaccgtaacccgtcgaacggaccgacgtcccggtaggaccgtccgttaggtacgttcgtaagtttttcggacgtttacgtttttaccttacgttcgtacgtacgtaccgtacgggtacccgtttcccgacccgtaccggtcccgttaccgtaccgtttaacccgggttccgggggacccgggggtacgtaagggggtacggtaagtacgttcgggaaacgtaccggtaacggtcggtacggtacgttccgaccgtaaccggtacgttaccgttacggtcctttaccgtacgtttcccccg

SEQ ID NO: 112093 - DNA, 798 bp, Homo sapiens
  misc_feature: GYAE6OF02GQ7U6.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagcccaccctctcctgccgagggccaggtacggtagttcgtcgtaagttaagtacgttaggcttagggtaacccaacgaacgaaaccgtggaccagggacctacccgaggtccctccgtacacgtacccagtaggactcgaccacgtaccaacggtacggtccccgtgggaccccgttaccgaacggtaccgtacgggttacgacggttacgggaccgtaacgggggttcggggttaccggttacggggaaccgtacggtttaaccgttaccgtacccgttaccttaacccgaaacctcctacgtaccggaccgtaccggtacccggtccgggtaaccccgtaggtacggtttacgtttttacgacccttttaaacgttttacctaccgttacgtcctacggacgtaacggtccgggtacgggcccgtaacccgggcgtacccgtacctttaccggtaccggtttccggggaacccgggtacgggaaaccggtacggggtacggaacggtaacgtaaaccggtaacggtaacgttacgggtcccgtagtaccgacgttacccgtaattcccgtacgtttacgtacctttacccgg

SEQ ID NO: 112094 - DNA, 596 bp, Homo sapiens
  misc_feature: GYAE6OF02HCWGH.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacggaaaaattgtgttgacacagtctccaggcaccctgtctctgtctccgagggganacagccaccctctcctgcagggccagtaggagtgtcagtaagtacttaggctggtaaccaacagaaacctggccaggctccgaggctctcatccatgatgcatccaacgacgggtccctggccgtacccagacgtacggttccgtggactaggtcgggtctagggactaggacgttcacgtcctacgaccgtcacgtcacgtccgtggacgcgtgtagtgtatttgtacttagttttacttcttcgtcgagctagtccgttccgccgtacgcctcgtccgtacggtttccgggacgggggtaccgagggtacggagtagtcggacgtacggaacggttcggtcggtacgtcggtacgaccgtacgtccgttgttacccttactaccgttccccg

SEQ ID NO: 112095 - DNA, 815 bp, Homo sapiens
  misc_feature: GYAE6OF02JC5M0.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgtgacacagtctccaggcaccctgtctctgtctccgaggggagacagcccaccctcctcctgcgacgggccaggtaggagtgtcgagtaagtactaggctaggtaccaacagaaacctggaccaggcctacccgaggtcctcctacactcctagcgatcgactactaccaacgtaccgggtccctggcccgttacccgaggaccgtacgggttccggtggaccgtagggttcggggtccgtaggggtaactagggtacgtttccgaccttccgtaacccgtaccggtacgacggtaccgtaacggtcccggttacgggaaccggtccgttaggtaacgtttaccggttaagtttttccgggaaccgttttaaaccggttttttccgttaccgttaccggttaccaccgggttaccggttaaccggtccccggttttaacccggccccgtaacccgggtcccccttccggtacccgtttacccgggggttacccggggggacccgggggggtaacccggttcgggggtaacgggtaacgggtaccggttacggtaacgggggtaaccctaaacggggttcggttaccgggacggtccgtaacccgttaacccggtacgttcccgttcggtttacctttacccgtacccggttcccccgg

SEQ ID NO: 112096 - DNA, 783 bp, Homo sapiens
  misc_feature: GYAE6OF02HCO0R.45.36.D03.1.454.CMB.1.raw
  modified_base (414)..(414): a, c, t, g, unknown or other
  misc_feature (414)..(414): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggacacacgcccacccctctccctaggccacggggtcccaaggtacggagttgtaccgtaaggtaacgttacgttaggcttacgggtaacctaacgaagtaaaccgtggacccagggccctaccccgaggtccctaccgtcactcccatcgatcgacactaccgaaccggtccgggtcccgtcggtccgtacccgaagaccgtacgggttccggnggtaccgtacggtacgggggtcaggggtaacgtacgtaccgttcaccttaccgtccgtaaccgtactccgggacctaacgggtcccgtagggacgcccgttagtacggttacgttattttcggtacctttagttttaccttgtccgttacgacggtccgtacggtcccgtttacccggacccgtaccgggtacccgtacccgtttacggttcccggggttttaacccggggggcccggggggtaacgggtacggggttaacggggtacgtaagggttacgggaccggtaaacgggtccggtttacgggttcccggcgttaccgacgttaaccacgtttcgttccggttaacttcggaacctttccccgg

SEQ ID NO: 112097 - DNA, 896 bp, Homo sapiens
  misc_feature: GYAE6OF02INCJW.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcgaggtggtggaggtcggggggagcgttgtccaggccgtggggaggtccctggagcctctcctgtgcagcctcgtggtattcctcccctcgagttaaaccttttcggtttcccacgttcggggtcccctaccgtacgggtttcccgagggccgtaaacgggggtccgtggggtaacggttcggggtcgggtccccgttacgtaacgttttaccgggaaaagtaggttacgggtaaaggttaggaaaggtaaccgggtaccttaaccgtacgaaacggtaaccgttcccgggtacggggaaacggggtccccgtaccgttttacccgaacccgtaacgttcccgtaacccgtaacgggtaaacggtaaaccctaaaccgtttaaccccgaaaaaggttaaaccgtttccgggtttaccccgttttaccgtttttttaacggaacccgttaaaacgtttaacggtaaacgtttaaaccggacccgtttaacggtaaacgggtaacgggttttaacgggaaacggggttaaacccgtaccgggtttacgtttacggtttaccgtttaacgttttaccgttacgggttaccgggttaccggtaacgggggggtaaccttacgttaccgttaagttacggtacggttcggtttacgggtttaccggttaaggtttacggtttaacgttacccgttaaaccg

SEQ ID NO: 112098 - DNA, 774 bp, Homo sapiens
  misc_feature: GYAE6OF02HC26U.45.36.D03.1.454.CMB.1.raw
  modified_base (163)..(163): a, c, t, g, unknown or other
  misc_feature (163)..(163): n is a, c, g, or t
  modified_base (213)..(213): a, c, t, g, unknown or other
  misc_feature (213)..(213): n is a, c, g, or t
  modified_base (385)..(385): a, c, t, g, unknown or other
  misc_feature (385)..(385): n is a, c, g, or t
  modified_base (493)..(493): a, c, t, g, unknown or other
  misc_feature (493)..(493): n is a, c, g, or t
tcagacgcgatcgacacgaccggtgctcgatttagctgcgtcacgatcgtcgtcttgggggaggaactgctcagttaggacccagagggaaccatggaagccccagctcagtcttctcttcctcctgctactctggctcccagactaccaccggagaaattgngttagacacagtctccaggctaccctgtctcgtgtctccgaggggacacncgcccacctcgcctcgacgacgggcaaggtaaggtagtgtactaggtaacgtacgttacggactacggtaaccaaacgacggtaaacctcggaccaacggtcctaccccggaaggtccttcctacactacccgattacgacgttcgactaacgtaccgaacgtcgggtcccnggtaccgtaccgaaggtaccggtacgggttccgtacggacgtacggggtttcggtaccggtaggaaccgtaggtacgttcctaaacgttcctacccggtaacccggtntaaccggacgtacggtaccggttacgggtaactaccggttaacggtacttacggttacgttacgtaacgttacgttaaccgtttacgtaccgttacggtacgtaccgtaccggttacccggttcccgacccggtaccggtaccggtacggtaccgttacgggttaccgggtacgggggtaccgtaggggtaacggtacgtacgtaggtaaccggtacggttaaccgtggtacgtaccgtacgtaccgtaccgtacgttcgttacgttaccgttacgtaccg

SEQ ID NO: 112099 - DNA, 729 bp, Homo sapiens
  misc_feature: GYAE6OF02GKG7I.45.36.D03.1.454.CMB.1.raw
  modified_base (419)..(419): a, c, t, g, unknown or other
  misc_feature (419)..(419): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccaggtaggagtgtcgaagttaagtacgttaggccttcgggtaacccaaacaacggaaaacccgttgggacccaagggcccttacccccgaggtccctcccgttcaacgtcccagtcggacttggaccaactcccgaaaacgtccggggtcccctgggacccgtaccccgaagtaccgtacgggtttcccggnggtacctaaggggttcggggtaccgtgggggaacctaggtaacgtttccaaccgttccctcgaacccggttcaacgggcccgtaacggtcccgtacggggaccgtacccgttaggtacgttacggttaacgttttcgtacgtttacgttttacttcgttacgtccgagtcgtacgtccgttccgaccgtaccgccgtcctccgtaccggtttccggggccggggtaacggtacgggtcggacgtgtacggacgtacggtaacgtggcggtacgtgaccgtacgtcgttccgtcgttacttactgttcccg

SEQ ID NO: 112100 - DNA, 859 bp, Homo sapiens
  misc_feature: GYAE6OF02FNND5.45.36.D03.1.454.CMB.1.raw
  modified_base (205)..(205): a, c, t, g, unknown or other
  misc_feature (205)..(205): n is a, c, g, or t
  modified_base (320)..(320): a, c, t, g, unknown or other
  misc_feature (320)..(320): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccacggaaaattgtgttagacacagtctccaggccaccctgtctctgtctccgagggganacacgcccaccctcctccgtgccgacgggccaaggtaggacgtcgtactaaggtaacgtacgttaggctacggtaaccaacgaacgtaaacctcggaccgaggtccctaccccgnggtccctccgtacgaactccgactgtactcgtacctactacccgtaacggtacggggtcccctcgggtacccgtaccccgaaggtaccggtacgggtttcccggtagggaccgtaacggggttcggggttacggtaccggggaacgtacggttaacggtttaccctaccgttccgttacccgtaccggtaccgacgggtaccgtacgggtcccggttacggggaccgttcccgtaggttaacggttacggttaacgtttttaccggtacggtttaacggttttaccgttttacgttaccggttacgtaacggttccgtaaccggttcccggtttacccggccgttaacccggcccgttccgtttccggtaaccggggttttccgggggacccgggggtacggtacggggttacgtaacgggtaccggtaggtaacgggaacccggtaaacggttccgggtacgggtacccgtacggtaacccgtaaccgttaccggtttccgttaaccggtttccgtttacccgcgttttaacccccgg

SEQ ID NO: 112101 - DNA, 531 bp, Homo sapiens
  misc_feature: GYAE6OF02GIOA9.45.36.D03.1.454.CMB.1.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggctcctcatccatgatgcatccaacngggtccctggcctcccagacaggttccgnggcaggtcgggtctgggacagagttcactctcaccgtnagcagcctggacgcctgatgtattttgctacgtttacttctgtcagctagtcgttccgccacgccgtctcgtacgtttcgggcgggggaccagggtggagagtgacgacggtaacgtggtggctcgacaccgatcgtcgtcttcacttcccg

SEQ ID NO: 112102 - DNA, 932 bp, Homo sapiens
  misc_feature: GYAE6OF02JRH5K.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcacctgtctcgtgtctccgagggtagacaggccaccctctcctgactacgggccaaggtggagtcgtacgagttaacgtacgttagggccttaggaaccctaagaacgtaaaccgtgggacccgagggtccctacccggaggtcccttccactacgtcccagttcgagtcgaccacgtcccaaaggtaccgggttccctacgggcccgttacccaaggaccgttacggggttcccgaggggaccttacgggttcggggttaccgtaacggggtacctaacgggtaccgttttaccacgttcccgtacggtaacccgtacggtaccgtccgtaaaccggtcccggtttaaggggacccgttacccgttagggtaaccgtttacggttaacggtttttaccggggaccgttttaaacggtttttaccgttaccgtttacgggtttaccggtaaccggtaccggttaccgggttaacccggtttacccccggtaaccggttaaccccgggtccccggtttaccccgtttaacccggggttttaaacccggggtttccccggggggggggtaaccccgggggttaaacccgggttacgggggttaaccggggtaacgttaacccggggtttacgggaaccgggttaaacccgggttaacccgggttgggtttaaaccggggtcccctttaaccggggacccgttacggtaccggtttaccggttaccggtttccgttacccgttacccggtttacccccgg

SEQ ID NO: 112103 - DNA, 904 bp, Homo sapiens
  misc_feature: GYAE6OF02GDCM7.45.36.D03.1.454.CMB.1.raw
tcagacgcgatcgacacgaccggtgctcgattttagctgcgtcacgaagtacggtctcttgggggacggaacttgcgtcagttaggacccagagggaaccatggaaggcccccagctcagccttcgtcttcctctgctactctggctcccagataccacgtaaattgtgttgacacgagtctccaggtcctacccttcgtccttcgttcgttcgtccgaggggtacgacgtacggaccaaccctcgttccgtcgaccgaacgggtccctaacggtttacgggaccgggttcgtacgtaacggttaaacggttaacgtttaggccgttaggtaacccgtaacggtacggtaaaacccgttgggacccgtaacggtcccgttaccccgaagggtaaccccttacccggtaaccctaacccgttccgtaaacgttcgttaagtccggtaactaacggtccctaaacgttacgggtttacccgtacgggtccggtaccccaaggtaaccgttacgggttccgtaggccgtagggttcgggtcggtagggtacgtaggtacggttaccgacgttaccgttcccgaaccgttaccgaaccgtaccgtaccggtacccgtacgggtacgtacccgtggtacttaggttacgttttcgtacgtttacggtttccttacgtttcgtaccgtacgtaccgttaacgttcccgttaccgtccgtaaccggttccccgttaccgtttcccggtttaccgggtttacccgggggaccggggtaacccggttaggggttaacggtaacgggttacgttacgggaaccggttaaccggtacggtttacgggccgttaccggtaccgtaaccgtacccgttacgttccgttcggtttccttaccgttacccgtttccccg

SEQ ID NO: 112104 - DNA, 682 bp, Homo sapiens
  misc_feature: GYAE6OF02JN8ST.45.36.D03.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (440)..(440): a, c, t, g, unknown or other
  misc_feature (440)..(440): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggccaccctgtctctgtctccgagggganacagcccacctctcctgcagggccagtaggacgtgtcagtacgtactaggctacggtaaccaacgacgaaccgtgaccgaggcctccgaggcctcctnactccagtgactcgacactacccgaacgccgggtccctcggaccgtaccacgtacgtacggttccgtacggcgtaggtcgggtcgtacgggacgtaggacgttcacgtccgtaccgacgtcacgctacggctaggacncgtacgatacgtgtttacgacgttacgtttacgttcgtacgtacgtcggtaccgtaacggttcccgttacccggaccgtacccggtcccgtacccgttacggttaacccgggttccgggggaccgggggttaacccggaggggttccgggacgtacggtaccggtaacgggtaccgtcgggtaacggttcgccggtacgaccgtaccctaggttcctagttccgtaccgttacgttccccgg

SEQ ID NO: 112105 - DNA, 588 bp, Homo sapiens
  misc_feature: GYAE6OF02HRECF.45.36.D03.1.454.CMB.1.raw
  modified_base (415)..(415): a, c, t, g, unknown or other
  misc_feature (415)..(415): n is a, c, g, or t
  modified_base (500)..(500): a, c, t, g, unknown or other
  misc_feature (500)..(500): n is a, c, g, or t
  modified_base (555)..(555): a, c, t, g, unknown or other
  misc_feature (555)..(555): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtagttgacacagtctccaggcaccctgtctctgtctccaggggagacagccaccctctcctgcaggccagtaggagtgtcagtaagtacttaggctggtaccaacagaaacctggccaggcctccaggctcctcactccatgatgcactccaactcgggtccctggccgtccagacgtaggttccgtggcgaggtcgggtcgtgggacaggtagttcactctcaccgtcacgcacgtcctggacgtcctagactgtntttgctagttttctcttgtcctagctacggtccgttacccgccgtacgcccgtacttccgtacggtttccggggcgggggtaccngggggtgaacggtacgtaggacgtacggtaacggtggtccggcgtcgaccacgtntaccgttgtaccgtttcacgttcccgtaccccg

SEQ ID NO: 112106 - DNA, 592 bp, Homo sapiens
  misc_feature: GYAE6OF02FGRAS.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacacgaaacctggaccaggcctccccgaggcctcctcactccatgatgcatacccaagacgggtcccctgggcctaccccagacctagggttccgtggcctaggtcgggtctggggacaggtacgttcacttcgtcacccgtcagcagtccgtggcgccgtgattgtattttcgctacgtttacttctcgtcgtagcgacgtccgttcccgcctaccgccgtcctcgtaccggtttcgggcgggggaccgtagggtggagtagtggaacgtaccggtaacgtggtcggtcgtcgaccgaccgtacttccgttgttccgttctacgttccccg

SEQ ID NO: 112107 - DNA, 771 bp, Homo sapiens
  misc_feature: GYAE6OF02HZ4RW.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcgacgggccaggtacggaggtgtacgaaggttaacgtacgttacggcgtacgggtaaccaaacgaacgaaaaccgtcggaccgacggcctacccgacgggtcctcctcactaccatgatcgacacgtaccgaacgtacgggtcccgtcgggaccgtacccgaacggaccgtacgggttccggtcgggacgacgggttcgggtcgtacggggactaggtacgttccacgtcctaccgacccgtcgacgccgacggtccgtacgggacgtccgttaggtactttcggtagttttttacggaccgtttacgtttttaccttcggtttacgtacctacggtaccgtaaccgggttcccggtttaccccggacccgttcccggacccggttaccgttacccggtaccgggtttccggggggacccgggggtaacccggtaggggttaccgggaagtacggttacgggacggtaacggtaacggttcgggtaccgggtccgtacggacccgtacggtacgttaccgtttacggttccctttacgtaccgttccccg

SEQ ID NO: 112108 - DNA, 637 bp, Homo sapiens
  misc_feature: GYAE6OF02IL8VS.45.36.D03.1.454.CMB.1.raw
  modified_base (202)..(202): a, c, t, g, unknown or other
  misc_feature (202)..(202): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggganacagccaccctctcctgccgagggccagtaggagtgtcagtaagtactaggctaggtaccaacagaaacctggccagcctccgaggtcctctcactccatgatcgcataccaacgtcgggtccctggcccgtccagacgtggttccgagcgaggtggtcgcggacngtacgtcactctccncgtcacgcacgccgtggacgtccgtgtagtcgttagtttcgacttacgttttactcgtttacgtacgtacgcgtcgttcccggtacccgccctacggtcccgtccgttccgttaccgggtttccggggacccgggggggtaaccgtacgggggtacgtaagggtacgttacgggaacgggtaacggtacggttacgggtacggtccggttaccgacgtacctacgttccgttcttacgttccgtacgttccccg

SEQ ID NO: 112109 - DNA, 801 bp, Homo sapiens
  misc_feature: GYAE6OF02GB3I7.45.36.D03.1.454.CMB.1.raw
  modified_base (183)..(183): a, c, t, g, unknown or other
  misc_feature (183)..(183): n is a, c, g, or t
tcagacgcgatcgacacgaccggtgctcgatttagctgcgtcacgatctctcttgggagctctgggagacgagcccagcactggaagtcgccggtgtttcctttcggtgatcatcactgaacacagaggactcaccatggactttgggctgacctggttttcctcgttgctctttaagaggtntccagtgtcgaggtgcaggtggtggagtcgggggagccgttagtccgagccgtgggacggtcccgtagagactccgtcctggtcgcacggcctcgtggagttctccgtcagtaacgtttggtttccacgtcggtacccgcgtacggttccgaacggcgaaacggggctgggtagtcggggtcggtcccgttcgagtttacccggaagtacgttaggacggttaggaaggtaaacggtacccgtacgtaccgtaaggtaccgtccggtaggaaacggggtcccggtaccgttaccgacccgtaccgtactacccgaacggtaacgggaaaccttaacgttaacccgaaaaggttaaccgttacgttacccgtttaccgtttttacggtaacctaaaacgtttacggaaaacgttaacggtaccgttacggtaacgttaacgggtttacgaaacgggtaaccgtaaccggttacgttccggttaactttaacgttttaccgttacggtttcggaaccgggtaacggggttaacgtaaccgttacgtaaccgttagggtactttaccgggtacggttttaccgggttaacgtttcggttaaacgtacgtttaaaaccccgg

SEQ ID NO: 112110 - DNA, 778 bp, Homo sapiens
  misc_feature: GYAE6OF02HACR4.45.36.D03.1.454.CMB.1.raw
  modified_base (201)..(201): a, c, t, g, unknown or other
  misc_feature (201)..(201): n is a, c, g, or t
  modified_base (364)..(364): a, c, t, g, unknown or other
  misc_feature (364)..(364): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctcgagggganacagccaccctctcctgcagggccagtaggagtgcagtaagtacgttaggctcggtaaccaacgagaaacctggaccaggcctcccgaggcctcctcactccagtgatcgacactaccaacgtcgggtccctaggcccgtaccgagtaccgtacgggttccgnggaccgtagggtcggggtcggtaggggacctaaggtcgtttaccaccgtttccgtacccgtacccgggttaccacggacccgtacggtacccggtacggggtacctccccggttaaggtacgtttacggtttaagtttttcgggaaccgttttaacggttttttaacccgtttcgttcgggttacctaagggtcccgttaacgggttccccggtttaccccggccgtacccggttacccggtacctttacccggttaacccgggttttccggggggaacccggggggtttaacccgtagggggttcggtaacggtagttacgggaaccgggtaacggttaacgtcgggtaccgggtccgtacggaacccgtacgttaccgttccgtttagttcccgttaccttacgttcccccg

SEQ ID NO: 112111 - DNA, 687 bp, Homo sapiens
  misc_feature: GYAE6OF02GC4KJ.45.36.D03.1.454.CMB.1.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (383)..(383): a, c, t, g, unknown or other
  misc_feature (383)..(383): n is a, c, g, or t
  modified_base (452)..(452): a, c, t, g, unknown or other
  misc_feature (452)..(452): n is a, c, g, or t
tcagacgcgatcgacacgaccggtgctcgatttagctgcgtcacgatctctcttgggggaggaactgctcagttaggacccagagggaaccatggaagcccagctcagcttctcttcctcctgctactctggctcccagataccaaccggaaaaattgtgttgacacagtctccaggcaccctgtctctgtctccgagggganacacgcctacctctccngcgacgggccagtacggagtgtactaagtaagtacgttaggctacggtaaccaacgaacgaaaccgtgaccaggtacctaccgacggcctcctacactaccataggtatcgacactccaaacgacggttccgtcggtaccgtacccgagaccgtcggttccgnggtaccgagggtcgggtcgtacggacgtagcgtttccacgttcacgaccgtgacgcgtacgcgtacggntaccgtgtaattacgttagttttcgactttaacggttttacttcgttacgacgtacgtacgaccggttccgtacccggtccaacccgggtccgtacccgttaccgttaccgggttaccgggggaaccggggggtacctaggggttaacgacgttacgtagggaacgtacggtaacggttacggacgtcgaacgtaaccgtacgtacgttccgtagttccgttactaccgttcccg

SEQ ID NO: 112112 - DNA, 707 bp, Homo sapiens
  misc_feature: GYAE6OF02GB6TN.45.36.D03.1.454.CMB.1.raw
  modified_base (352)..(352): a, c, t, g, unknown or other
  misc_feature (352)..(352): n is a, c, g, or t
  modified_base (447)..(447): a, c, t, g, unknown or other
  misc_feature (447)..(447): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggagaaatagtggtgacgcagtctccaggcaccctgtctgtgtctccgaggggagtagagtccaccctctcctgcgacggccagtacaaagtcgttccgcgtaaccggtatacgttacggcccttggtaaccaggacctaggaacgtaccgtggacccaacggtccctcccgagggtcctcccgtactactctacgtcgggtcnccgtaactcccgtccgacgggtcccttcgtcgggtctccccgctaggttcaggtcggctaggtcggtctgggacagtacgtccacttcacctacntacgcgtacacggtactgggactcgtaagtacgttatttccggaattacggttagtttaccttacgtacggttacaaacgttcggtaacttccggtacccttaccgtttaccgtttcggtaccgttttacccgggaccccgttaagggggaacccttaaggggtacccgtaaccgttaaagtaaaccccgggtaaaaacgttcggttcggtaccggtccgttaccggaaccctaccgtacgtttacgtccgtttaacccg

SEQ ID NO: 112113 - DNA, 948 bp, Homo sapiens
  misc_feature: GYAE6OF02H6RQM.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggaccagagggaaccatggaagcccagctcagcttctcttcctcctgctactctggcctcccagataccaaccggtaaaaattgtgttgacacagtctccaggccacctgtctctgtctccgaggganacagcccacctctcctgcgagggcctaggtaggagttcgtacaagttaacgtacgttagggcttacggtaaccaacgtaacggaaaccgttggacccgaacggccctacccagggtccctcccgtacaacttccaatcggtaactggaccaacttacccgaaacgtacccggggttccctacggggtccccgttaacccgaacgggtaacccggtaacggggttttccccgggacgggggtaccgttaaccggggggttcgggggtttaccggttaacgggggggaaaccgttaacggttaaaccggtttccctaaccccggttttaccttaccccggttaaccccggttaccgaacgggtaccctacgggtcccggttacggacccggtacccggttaggtaacgtttaccgggtttagtttttacccggtaccttttaaagggttttttacccgttaccgtttcggtaacccgttaacgggttaaccgttaacccgggtttcccgggttacccccgtaaccgggtaccccgttaccccggttccgttttacccgggttaacccggggggtttttacccgggggggacccggggtaaacccggggttagggggtaaaccgggtaggggttaaccgttaccgggtaaaccggtacgggttaaaccggttcggggtaccggtcgtttaccggacccgttaacgtcggtttaccttccgtttaccgtttaccgaccgttttcccccg

SEQ ID NO: 112114 - DNA, 732 bp, Homo sapiens
  misc_feature: GYAE6OF02HYLHD.45.36.D03.1.454.CMB.1.raw
  modified_base (136)..(136): a, c, t, g, unknown or other
  misc_feature (136)..(136): n is a, c, g, or t
  modified_base (310)..(310): a, c, t, g, unknown or other
  misc_feature (310)..(310): n is a, c, g, or t
tcagacgcgatcgacacgaccggtgctcgatttagctgcgtcacgatctctcttgggggaggaactgctcagttaggaccagagggaaccatggaagcccagctcagcttctcttcctcctgctactctggctccngataccaacggaaaattgtgttgacacagtctccgagcaccctgtctctgtctccgagggagacacgccacccgtctccgtgcgacgggaccaggtaggagtgtacgagtaacgtacttaggctaggtaaccaacgaagaaacctggaccgaggcctaccgaggtcctccgtanactaccatcgtatacgactaactaccaacggtacgggtccctgggtaccgtacccgaaggtaaccgtacgggttccggtacggtaccgtggggttcggttacgggagggtacgaacggttacgtttaccgaaccgttcctaacggaacccggtcgacgaccgtacggtaccggtacggaacgttccgtaggtacgttgttaacgttttcggaacctttacgtttttaactcttacggtcgaacggtctacgggtccctaccggacgtacccgtaccgtcttcccgttaccggttcggggaccgggggtaacgagggttcggaacgtagtacgggaacgtacgggaaacgttcggggtacgtacgtaccggtaacctcggttacgttccgttacggtacccgttacgtacccgttaaccccgg

SEQ ID NO: 112115 - DNA, 724 bp, Homo sapiens
  misc_feature: GYAE6OF02GVKFC.45.36.D03.1.454.CMB.1.raw
  modified_base (290)..(290): a, c, t, g, unknown or other
  misc_feature (290)..(290): n is a, c, g, or t
  modified_base (371)..(371): a, c, t, g, unknown or other
  misc_feature (371)..(371): n is a, c, g, or t
tcagacgcgatcgacacgaccggtgctcgatttagctgcgtcacgatctctcttggggagctctgggagacgagcccagcactggaagtcgccggtgttccttcggtgatcatcactgaacacagaggactcaccatggactttgggctgacctgggtttcctcgttgctcttttaagaggtgtccagtgtcaggtgctagggtgggtggaggtcgggggggaggtcggttgtccgagccgtggggacggtccctgacgactctcctgtgcagcctctggatcctccctnagtaactttggttccacgtcgggtccgcctaggttccaggcgaaggggctggaggtgggtcggccctcgtagttccgaagngtaggaagtgagaacggcctactacgacgtactccgtaggaacgggccgtcttacccgacctactcccgtaccgaacggacgaaaccgtaaacttaacccgaaacgtaaacgttccgttacccttaccgttttttacgaccgttaaaacgttacgtaaacgtacgtcccgttagggacgttaagggtttacggaacggtaaccgttacggtccttacggtttaccgtttattttaccggttggttccggtaccggtaaccggggggttaactaaacgttcccgttaaggttcggttaagggttccgttttgggtttaaccggtttaggtacggttaattacccgttaaaaccc

SEQ ID NO: 112116 - DNA, 758 bp, Homo sapiens
  misc_feature: GYAE6OF02JPS0U.45.36.D03.1.454.CMB.1.raw
  modified_base (234)..(234): a, c, t, g, unknown or other
  misc_feature (234)..(234): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctagcctgggtttcctcgttgctcttttaagaggtgtccagtgtcaggtgcagggtggtggacggtggggggaggcgtttgccgngaccgttggggaacggtccctggaacgccgttactccgtagtcggaccgaggccccttcgtcgggaattttcctccccctagtacgtttaaaccgtttttggtttccccgaacgtttcggggtccccgtccgtacggggtttacccgacggtcggtaaacgggggtctacgggggagtttcggggggtccggccccttacgttaagttcccggtaaggtacgtagggtaacggtggtaaaggaaccggtcctaacgtcgacgaacgttccgtggaacgggtccgtctaacgtcactaccgtcaacgaggtaacacgtaccgaacgtaacgtcgttcttaccgtttacggtactaaacgtaagtaagttacgtacgttacgaaggttacgtaggtacgtaaccgtaacgtcgttacgttcggttaactttcgttaccggttgtaccgtacgggggactttaactcggtaacgttagtaacggttcttacgggtttacgtaagggtctttaaagtccgttaaaccg

SEQ ID NO: 112117 - DNA, 866 bp, Homo sapiens
  misc_feature: GYAE6OF02H0EMA.45.36.D03.1.454.CMB.1.raw
tcagacgcgatcgacacgaccggtgctcgatttagctgcgtcacgatctctcttggggaggaactgctcagttaggaccagagggaaccatggaagcccagctcagcttctcttcctcctgctactctggctcccagactaccaaccggaaaattgtgttgacacagtctccaggcacctgtctctgtctccgagggagacacgccaccctctccgtgccgacgggcctaggtacggtagtcgtacgtaggttaacgttacgttacggacgttacggtaaccaaacgacggaaaccgttcggacccgagggtacccctaccccggacgtacccgttccttaccaaccgtttaccgaacgtttacgggtaacttaccgggaacctaaccgttaacccgaaccgggtaaccgggtttccccgtacgggccccgtttaccccgaacggtaaccggttaccggggttcccgggtaggaccggttacgggggttacggggtccggtaagggaacgtacgggttaccgttccgttaaccgtccgttaccgacgttccgacgtcgacggtccgtagggaccgtccgttacggtacgttcgtttacgtttcgtacgtttacggtttttaaccttcgttacggttacgtacgtaccgttaccggttcccgtttacccgtacccgtcccggttaccgtacccgtttacccggttaccggggtttaccgggggaccgggggtttacccgggtagggggttaacgacggttaacggttacggacggtaaccggtaacggtttcgggacggttaccgtacggtaccgtacccgttacgtttccgttaaccgtttccgtttaccgtcccgttttaccccg

SEQ ID NO: 112118 - DNA, 775 bp, Homo sapiens
  misc_feature: GYAE6OF02G2X5A.45.36.D03.1.454.CMB.1.raw
  modified_base (285)..(285): a, c, t, g, unknown or other
  misc_feature (285)..(285): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggaggtcggggggaggcgttgtccagcctgggaggtccctgacgactctcctgtgcagcctctggattccgtccctnagttaactttcggtttccacgttcgggttccgcctaggttccaggcgaagggggctgggaggtcggggtcggccccttcgtagttttcccggaaaggtacgttacgggaaaggtggaaagggtaaacgggtaccctaacttccgaaaggtaccgttacccggtacggaaaagggggtccccggtaccttttcccgaaccctaacgttccctacccggtaacggaacggaaaccgtaaaccgtttaacccgaaaagtaaacgttaccgtttaccccgtttacctttttttacggaaccttaaaagttgtaaacgtacgtacccgttaggtaacggtagggtttacggaagggtaaccgtaaccggttacgttcggttacctttaagtttttcttaggttccgggaccggtacggggggtaacctacgttaccttaagtggtacgttacggttgggtttaccggttaggttagttaacgtacgttaaacccg

SEQ ID NO: 112119 - DNA, 723 bp, Homo sapiens
  misc_feature: GYAE6OF02H6O1Z.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtcctccgaggggagacagccaccctctccgtgcacgggccagtaggagttgtacgaagttaacgttacgttaggcttaggtaccaaacgtacggaaaacccgtcggacccaacgggtcctccccgagggtaccttcccctcaacttcccaagttcgaatcggaccaacttaccccgaaacgtaccggggttaccccctgggaccccgtccccgaacggtaccggtacgggtttccgtcggggccgtagggttcggggtcgtaggggactaggtacggttccacgtttcctccaccggttacgacggaccgtacgtaccgtagggacgtccgttgtagttagtttacgtttgaccgttagttttacgttcttgttacacgtcctacggtcccgtaccgccgtaccgcccgtcttcgtaccggttcggggaccggggtaccgtagggtgacgtacgtacggaggtaaccgtaaggttccggtaggtaccgtacgcccgtaacgtccttcgtacgtttaccgttacctcttccccgg

SEQ ID NO: 112120 - DNA, 715 bp, Homo sapiens
  misc_feature: GYAE6OF02HEJCE.45.36.D03.1.454.CMB.1.raw
  modified_base (707)..(707): a, c, t, g, unknown or other
  misc_feature (707)..(707): n is a, c, g, or t
tcagacgcgatcgacacgaccggtgctcgatttagctgcgtcacgatctctcttggggaggaactgctcagttaggacccagagggaaccatggaagcccagctcagcttctcttcctcctgctactctggctcccagtataccaccggaaaaattgtgttagacacagtctccaggcacctgtctctgtctccgagggacacagccaccctctccgtcgcacgggccaggtaggacgtgtacagttaagtacgttaggctggtaccaacgtagaaaccgtggaccaggcctcccgaaggtctcctcatccatgactgacactaccgaacgtcggtccctggccgtacccaggtacgtacgggttccgcgggcctagggtcgggtccgtaggggaactaacggtacgttaccaacgttccgtccgtaaccggttacgacggtaccgtaacggtcccgtagggaacctccggttacggtaacgtttcggttactttttccggacgtttaacgttttcccgttacgttacgttaccgacgtacgtacggtacccgtttacccggacccgtaaccggtcccgtccgtttaccgtaccggttttacccgggggacccggggttaaccgtaggggttcggaacgtcgttacggaacggtaccgtaacggttggtccggagttaccgacctacgacgttccttcggtcttacncgttcccg

SEQ ID NO: 112121 - DNA, 837 bp, Homo sapiens
  misc_feature: GYAE6OF02FTUHL.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgcccaccctctcctcggcgacgggccaaggtacggagttcggtacaaggttaacggtacttagggcctcgggtaacccaacgaacgtaaaccgtcggaccaacggtcctaccccgaggtccttacccgacctacgtaccctaagtcggaacgttcggacctaccgttacccgaaaccggtaccggggttccccgtaccgggtacccggttacccgaacggttaacccggtaccggggtttccggtcgggaccgttaaggggttcggggtacggtacggggggtaccgtaagggtaccgttttccgaaccgttttccgtacccgtaccccggttcgaaccgggtcctaccgggtcccgtaaggggaccgttacccgtaggtaacgtttggtttacgttttaccgggttacgtttaaccgttttaccgtttgttaccggttaccgaggttacccgtaccggtccggtttaccccggaccctacccgggtcccgtacgtcccggttaccgggttccgggggaccggggggtaccgtaggggtcgtacgagggttaggaaccggacggttacgtagggtcggcgtaccggccgaacgttgttaccgttacgttacctttccgtaccgttccccg

SEQ ID NO: 112122 - DNA, 674 bp, Homo sapiens
  misc_feature: GYAE6OF02J0ZV1.45.36.D03.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaattgtgttgacacagtctcaggcaccctgtctctgtctccgagggganacacgccaccctctcctagcagggccagttacggagtgtcagtaagtacttaggctaggtaaccaacgagaaccgtggccaggtcctcccgaggcctccanacctcatnatcgcagtacccgaacgtacgggtcccctgggacccgtcccaaggtaccggtacggttccgggtcggacgtacgggtcggggttaccgtaggggactaaggttacgttcctaaccgtccttaccggtccccgtagaccgtccgtacgccgttggccggtcctacggtactgttacctttaggtaccttacgttttcgtacgttcggtcctagtacgtccgtcgttcccgaccgtacccgtccgtcttaccgggtacggtttcccgggggtaggggtacccgtaggggtccgtaagtacgtacggacggtacgtacgtggtcgcgttcgacctctacgtccgttcgtctttaccgccttccgg

SEQ ID NO: 112123 - DNA, 621 bp, Homo sapiens
  misc_feature: GYAE6OF02FTI6X.45.36.D03.1.454.CMB.1.raw
  modified_base (483)..(483): a, c, t, g, unknown or other
  misc_feature (483)..(483): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaaattgtgttgacacagtctccaggcaccctgtctctgtctccaggggagacagcccaccctctcctgccgagggccaggtaggagtgtcagtaagtacttaggctcggtaccaacacgaaacctggaccaggctcccgaggcctcctcactccatgatgcactaccaacgtacgggtccctcggccgtaccgagacgtacggttccggtaggcgtaggtcgggtacgtagggacagtacgttcactctccgaccgtcacgcgacgtccgtaggacgcctagactgttatttcgacttagtttacttcgttgtcagccgtcgtccgttccnccgtacgcccgtatccgtacgtttccggggaccggggtacgtaggggtagaggagtacggacgaccggtacgtcggtggtaccgtcgacccgtactacgttcttacggttcccgtttacgaccgttccccttacccgg

SEQ ID NO: 112124 - DNA, 244 bp, Homo sapiens
  misc_feature: GYAE6OF02FHBVM.45.36.D03.1.454.CMB.1.raw
  modified_base (229)..(244): a, c, t, g, unknown or other
  misc_feature (229)..(244): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggagtgtgtcacaagtatttgggctctgggcacagcggccctgggctgcctggtcaaggacttacttcctcgatcgcgtctgagcgggctggcaaggcacatagnnnnnnnnnnnnnnnn

SEQ ID NO: 112125 - DNA, 825 bp, Homo sapiens
  misc_feature: GYAE6OF02FUQOR.45.36.D03.1.454.CMB.1.raw
tcagacgcgatcgacacgaccggtgctcgatttagctgcgtcacgatctctcttggggagctctgggagacgagcccagcactggaagtcgccggtgttccttcggtgatcatcactgaacacagaggactcaccatggactttgggctgacctgggtttcctcgttgctcttttaagaggtgtccagtgtcaggtgcaggtggtgggaggtcggggggaggtcgttgtccgaggtccgtggggacggtccctgacgactcctcctggtgcacgcctcgtggtacttcctccctactacgttaacttttcgggtttcccacgttcggggtcccgccgtacgggttcccgagggcgaacgggggcgttacggggagttgggggtccggcccgttacgtacgtttcccggaagtacgtagggtaaaggttcggaaacgggtaaccggtacccttaacgtcgtaacggtacccggttaccggtacggggaaaccggggtcccggttacctttacccggaacctaccgttaccgtaacccgaacggtaacgtaaccgttaaacgttaccgaaaacggttaacgtttccgttacccgttttacgtttttacgaaccttaaaagttacgtaaacgttacggtaaccgttacggtaggtaacggtttcgggaaacgggtaccgtaaccgtttccgtttaaggttccttttaacgttttccgttaggttaccgggtaccgggtaacgggggttaacctacgtttacgttaggttacgtacggtttacggtttcgggttaaggttaacggtacgttaacttaccgttaaacccg

SEQ ID NO: 112126 - DNA, 655 bp, Homo sapiens
  misc_feature: GYAE6OF02F2U93.45.36.D03.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (567)..(567): a, c, t, g, unknown or other
  misc_feature (567)..(567): n is a, c, g, or t
  modified_base (623)..(623): a, c, t, g, unknown or other
  misc_feature (623)..(623): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggganacagccaccctctcctgcaggccagtaggagtgtcagtaagtacttaggctggtaccaanagaaacctggccaggctcccgaggcctcctcatccatgatgactatccaacgagggtccctggccgttacccaggtacctacggttccgtggaccaggttcggtacgtagggaccaaggtacgtttccaaccttctaccgaccgttacacggtcctacggccgttgggacgtcccgtagtacgttagtactttttcgaccgtttaacgttttaccttggtctcgaacgtccgtaacgtcccgtttacccgacgtacccggtcccgttcgttaccgttaccggtttaccgggggaccggggtaaccnggggttcgaacgtacgtgaaccggtacgtaacgtggttcggacttacggcctaacncggttcctacggttccttagcctttaccccgg

SEQ ID NO: 112127 - DNA, 748 bp, Homo sapiens
  misc_feature: GYAE6OF02JCTSW.45.36.D03.1.454.CMB.1.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggccaccctgtctctgtctccgaggggagacagccaccctctcctgcaggccagtacggagtcgtcagtaagtacgttaggctggtaaccaagaacgaaaccgtggaccagggtcctacccgagggtccttacctacgaccgtccagtgactcgactactacccgaacggacgggtccctcgggccgtacccgagaccgtacgggttaccgtcggactaggggtcggttcgtcggggaacgtacggttacgtttacgaccttccgtaccgtaaccggttccgaacgccgtacggtcccgtagggaccgtccgtagtacgttgtttaacgttttcgccgtttaaacgttttccgtttacgttcgtactaccggtactaccggttcccggttcccgccgtaaccggccccgtacttaccgggttaccgtttccggggggaccgggggtacgtccgggggtacgaaggtaccttacccgggaaacgtacgggtttcggaccgttacgggtaacgtccccgtaacgttacggttccgttacggttacctttacccggttaccttccccgttaaccccgg

SEQ ID NO: 112128 - DNA, 786 bp, Homo sapiens
  misc_feature: GYAE6OF02HO0B3.45.36.D03.1.454.CMB.1.raw
tcagacgcgatcgacacgaccggtgctcgatttagctgcgtcacgaatctctacggttgggtttagggggaagaggaagacttgaccggtcctcccgaaggagttcgaggtcgcgtggccaccgttgggtcacggggtacgcgttgtcctagcctgggacgtccctgagacttctccgtggtagactagcctcgtggacttctcccgtctacgttaacgtttcgttcctagtcggtccgccgtcggttaccgaggacgaacgggcctacggtacgtgggtcggtccctcgtacgttccgaagagtggtagtgagacggcctacgtacgacgtaccgtaccggtacggaaccggtaccgtccgtaccgaccgtacctccgtaccgtaacgaccgtaactaacgttaaccgtaaagtacgttcgttcctttacgtttacgaacgtaacgtacgtaacgtacgtacgtacgtacgtacgtaggtacgtacgtacgtcgtacgttacgttacgttcgtacggtacgtacgggtacggtaactacgttacgtacgtacgtacggttcgttcggtttacgtaggttacgtaacgtaacgttaaccgttaccgttaaccgttacgtttacgttacgttacggttacgtacggtacgggtaacgtaacgggtacgttaccgtacgtaccgtacgtaccgtacgtaccgttccgtaccgaccggtaccgtaccgtaccgtccggttcccgtcccgcggtccctccgtacgccgtaccgacgtcgtccgtcgtcgg

SEQ ID NO: 112129 - DNA, 689 bp, Homo sapiens
  misc_feature: GYAE6OF02GL9T8.45.36.D03.1.454.CMB.1.raw
  modified_base (356)..(356): a, c, t, g, unknown or other
  misc_feature (356)..(356): n is a, c, g, or t
  modified_base (442)..(442): a, c, t, g, unknown or other
  misc_feature (442)..(442): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctacccagataccaccggaaaaattgtgttgacacagtctccaggcaccctgtctctgtactccgaggggagacagcccaaccccttcgtcctcgctacgggccaggtaggtagtgtcaagttaacgtacttaggcgtacggtaccaaacaagaacctggccaggtcctcccgaggtctcctcactccgatagatgacactacccgaacgtacgggttccccngggtacccgtacccaaggtacctaacgggtttccggcgcgtagggtcgggtgtggactacggtattccacttctaccgacccggtnaacgtccgacgtcgtgggacctccgtgacgttgttaacgttttcggtacctttacgttttaccttacgttcggtactacggccgtacgttcccgtcccgaccgtacccgggtcccgtccttccgtaccgggtttccggggacccggggggtacgtacggggtaggtacgtaggtacgtacggtaacgtacggtaggttcggacgtcgtaccacgtacgttcgtacgtttccttcgtacccgttcccg

SEQ ID NO: 112130 - DNA, 749 bp, Homo sapiens
  misc_feature: GYAE6OF02JC9SL.45.36.D03.1.454.CMB.1.raw
  modified_base (223)..(223): a, c, t, g, unknown or other
  misc_feature (223)..(223): n is a, c, g, or t
  modified_base (513)..(513): a, c, t, g, unknown or other
  misc_feature (513)..(513): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaacggaaaattgtgttgacacagtctccaggccaccctgtctctagtctcgaggggacacacgcccaccctctcgngcgacggccagtaggacgtgtactaagtaacgtacgttaggctacggtaaccaacaacggtaaaccgtggaaccacgggtacctacccgaacggtccttacccgaactacttacccgtaagtcgacgtacggtacctaaaccgtaaccggtaaccgggtccggtacccgttacgggacccctaccgtaacggtaaccggttacccggtttacggaacggttcggtaacgggttcggttacggaacgggtaacgaccggttaacgtccgtacgtaccgtccgtaccggtanaccgtaccgaggtccggtacgggtctacggtagtaggttatttacgggttactacggtttaacttcgtttacgacgtcgtaaccgcggttacgtcccgtccggaacctaccggtccgtaccgttgggtaacccgggtggggaacccgggtgacgggttacgagtaccggtagtaacgaccggtagtcgggactcgacccgtataccctgttcggtacctcggtaccttacgtcccg

SEQ ID NO: 112131 - DNA, 710 bp, Homo sapiens
  misc_feature: GYAE6OF02GUBJE.45.36.D03.1.454.CMB.1.raw
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaaccggaaaaattgtgttgacacagtctccaggcaccctgtctctgtctcgaggggagacacgcccaccctctcctgcgagggccaggtaggagtcgtacgagtaagtacttaggctacggtaaccaagaacgaaacctgggtacacggcctcccgaggtcctcctcactcccatgactcggaccacgtacccgaacggtaccgggttccctcgggtcccgtacccgacggtaacggttacggtttcccggtcgggacgtacgggttcggggtaccgtaggggactaggtacgttccacgttccctcgacccgtcacggccacggtcccgtagggtacctccgtgattcgttagttttcgactttacggtttacttcgtacgtacgacgtcgtaccggttcccgttacccgacccgtaccggtccgtaccgttccgttaccgggttccggggggacccgggggtacgtacgggggtcgtaggtcgtacgggaaacggtacccgttaacggtgggtacgtcgtacggaccaccgttagtccgttacgttctttacccg

SEQ ID NO: 112132 - DNA, 852 bp, Homo sapiens
  misc_feature: GYAE6OF02I1QC6.45.36.D03.1.454.CMB.1.raw
  modified_base (179)..(179): a, c, t, g, unknown or other
  misc_feature (179)..(179): n is a, c, g, or t
tcagacgcgatcgacacgaccggtgctcgatttagctgcgtcacgagtctctcttgggagctctgggagacgagcccagcactggaagtcgccggtgtttccttcggtgatcatcactgaacacagaggactcaccatggactttggctgacctggtttcctcgttgcttcgtttaagnggtcgtccagtgtcgaggtgcgaggtggtggaggtcgggggagcgttgtccgagcctgggacggtccctgacggtacttcgtcctggtacgctacgtcccgtcgtggtaacgtttcctccccttacgtaacgtttaaccggtttcggtttacccgaacggttcgggttcccggtccgtaaccgggtttcccgaaggtccggtaaacgggggtccttacggggtacggttcggggtccggtaccccgttacgtaacgttttccccggaaaggtacgttaagggtaacggttcgtaacggtaaccggtccgttaaccgtacggaacgtaaccggttccggtacgggtaaacgggtcccgttaccgtttaccgaaccgttaccgtccgtacccggtaacggacgtaaccgtaaacgttacccgaaagtacgttacgtaccgtttacgttttacgacctaaacgttagtaacgtaacgtccgtacgtaaggtaccggtttacggaaccggttaaccgtaccggttaacttcggttaccgttaaccgttttacgtacgtttaccgggaacccgggtttaggggaacccgtaagtttaccggtaacggttcggttaacgggtttacgtttacgggtttaccggttaaccggttacgtttaacgtacccggttaaacccg

SEQ ID NO: 112133 - DNA, 1120 bp, Homo sapiens
  misc_feature: GYAE6OF02GD5OZ.45.36.D03.1.454.CMB.1.raw
  modified_base (208)..(208): a, c, t, g, unknown or other
  misc_feature (208)..(208): n is a, c, g, or t
tcagacgcgatcgacacgaccggtgctcgatttagctgcgtcacgatctctctggggaggaactgctcacgttaggacccagagggaaccatggaagccccaagctcagcttctcttcctcctgcactctggctcccagattaccaccggagtaaattgtcgttgacacagtctccagcctacctgtcctttggttccaaggggaaanacgccgacccttctcctggccgacggggtccaaggttccaagggggttcgtttaaaaccgaggtaccttaaccgtttaggtacccgtttacgggtaaaacccctaaaacgtaaaaaaaccccgttgggaccccgtaagggtcccgttaccccgaggggtacccttaccgaacgttaccaaacggttacccttaacgttaccggaacccggtccggtaaacgtttacccggaaaaaccggaaccgggggtacccccgtaaaccggtttacgggggaccctaaaccgtttacccccggaaacggtaccccggtaaaacggggttttacccgaaaacggggtttccggggtacccgggtaaacggggtttcgggggttaccccggtttaacggggggggaaacctaacggggttaaccccgttttaccgggttaaccccttaacccgttcccgtaaaccccgtaaacggtttaacccggaaccggtaaccgtaaccgggtacccccgggtttacggtaaaccccccggttttggggtaaaccgggtttaaccggttttttacgggtaaacccccgtttaacggtttttaaccccgttaaaaccggttttcgggttacccggtaacggttacccggtaacgggtaccggggttaccggggtaacccggtaaccccggggtacgggtacccgggtacccgtttaacccggtaacccggtttttaaccgggggacccggggttaaaccggggggtaaacccgttaaacgggggtaaccgggttaaccgggtaacccgttaaccggttaaaaccccgggaaggtttaccgggtaacgggttaaccccgttcggacccgtaacccgttaacgtttcccggttaaccggtttaccctttaccggtaaccgttttcccccgg

SEQ ID NO: 112134 - DNA, 736 bp, Homo sapiens
  misc_feature: GYAE6OF02HYLIT.45.36.D03.1.454.CMB.1.raw
  modified_base (236)..(236): a, c, t, g, unknown or other
  misc_feature (236)..(236): n is a, c, g, or t
tcagacgcgatcgacacgaccggtgctcgatttagctgcgtcacgatctctcttggggagaactgctcagttaggacccagagggaaccatggaagccccagctcagcttctcttcctcctgctactctggctcccagactaccaccggaaaaattgtgttgacacagtctccaggccacctgtctctgtctccgagggagacagcccaccctctcctgcgacgggccaggtaggngttgtcgagtaagtacgtacggcttacggtaccaaacaacgtaaaccgtggaccctaggccttaccccgaggccctcctacgactccgatacgatacgctaactacccaacggaccggttcccgcggtacccgtaccgaaggtaccggtacgggttccggaggtacgtacgggtcggggttacgtcgggggtaacacggttacgttacgtacccgttccgtaccgcccgttaggaaccgggtcaaccgggtaccgtacgggacgtcctaggtacggttagttaacgtttcggaccgttttagttttaaccttcgttcgtacgtacgtacgtacggttccggtacccaccgtcccgtaccgtcccgttaccggttacccgggtttcggggccgggggtaaccggtgggagggtaccgaggtacgaacgggtaaccggttaacggtggttacggtcgtacggtacctactcgtccgtacgtttccttccgtaccgtttcccg

SEQ ID NO: 112135 - DNA, 802 bp, Homo sapiens
  misc_feature: GYAE6OF02F1ONF.45.36.D03.1.454.CMB.1.raw
  modified_base (206)..(206): a, c, t, g, unknown or other
  misc_feature (206)..(206): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcctcccagataccaaccggaaaaattgtgttgacacagtctccaggccaccctgtctctgtctccgagggganacacgcccaccctctcctcgcgacgggccaggtaggagtgtcgaaggttaagtacgttaggcgttacggtaacccaaacgaacggaaaaccgtcggaccgacggtccctacccgaggtcctcctacactccagtgatcgactactacccgaaacggtccgggtccctacgggtcccgtacccgaacggtaaccggttaccgggttcccgggtacgggtacggtacggggttcgggggttaccggttacgggggtaaccgtaacgggttaccgtttacccgtaaccgtttcccgtaacccgtacccggtacgacgaccgtaccggtccgggtacgggtaccgtccgtaggtaacgttgttacgttttcgacgttttacgttttacttcgttacgtcgacgtacgtacgttcccgtcccgaccgtcccggtccgtccgttaccggttaccgggtttccgggggggaccgggggtaaccgtagggggtacggaacgggtaggtacggaaccgggtaacggttaacgggttacggtcggtaccgtacggtacccgtacgtacgtttccgttcggtttacccttaccgttacgttaccccg

SEQ ID NO: 112136 - DNA, 830 bp, Homo sapiens
  misc_feature: GYAE6OF02FMUW9.45.36.D03.1.454.CMB.1.raw
  modified_base (210)..(210): a, c, t, g, unknown or other
  misc_feature (210)..(210): n is a, c, g, or t
tcagacgcgatcgacacgaccggtgctcgatttagctgcgtcacgatctctcttggggccctggggaggaactgctcagttaggacccagagggaaccatggaagccccagctcagcttctcttcctcctgctactctggctcccagataccaacggaaaattgtgttgacacagtctccaggcaccctgtctctcgtctccgagggganacacgcccaccctctcctcgcgacgggccaggtaggacgttgtacaaggtaagtacgttaggctacggtaacctaacgaacgtaaaccgtggaccgtacggcctacccgacggtcctcctacgtactccaagtcgactcggacctacgttaacccgaacggtaccgggttccccgtagggaccccgttaccccgaaggtaccggtaacggggtttcccggacggggtaccgtacggggttcggggttccggtaggggaaaccgtaggtaacggtttcccgaaccgtttaccgtacccggtacccggtacaacggtcccgttacgggacccgttaggggaccgtacccgtttaaggtcttacgggtttacgttttcgaccgtttttaacgggtttaacctttcgttagtaccgtacgttaccgacgggttccccggtacccacccggacccgttcccgggtaccttccggttaacccggggtttaccgggggggacgggggttaccgagggggttacggaaggtacggtacggaaaccggggtaccggtaacgggttgggttacccggacgttacccggtacctaacccttagggttaccgtttccggttacgttccccgg

SEQ ID NO: 112137 - DNA, 748 bp, Homo sapiens
  misc_feature: GYAE6OF02GBFGU.45.36.D03.1.454.CMB.1.raw
  modified_base (164)..(164): a, c, t, g, unknown or other
  misc_feature (164)..(164): n is a, c, g, or t
tcagacgcgatcgacacgaccggtgctcgatttagctgcgtcacgatctctcttggggagctctgggagacgagcccagcactggaagtcgccggtgttccttcggtgatcatcactgaacacagaggactcaccatggactttgggctgacctgggttttccncgttgcttctttaagaggtgtccagtgtcaggtgcagggtggtcggaggtcggggggagcgttgtccagccgtgggacggtccctggacgtactctcctgtcgcagcctcgtggtacttcctccctcacgttaacgtttcggtttccacgtcggggttacccgccgtaagggttccagggtcgaaacgggggcttagggacgttgggggtccggtcccttacgtaacttttaccgggaaagtacggttcgggaaagtcggaacggaaacgggtcccttaacgtcggaaacggtaccgttccgggtaacgggaaaccggggtcccgtactttaaccgaacccgtacgtaccctaccgaaggtacgtaaccgtaacgttaaccgaaaacgtaacgttacgttaccctttacgttttacgacttaaattacgaataaccggtcctaggaggtacgttacggacggtacgtaacgttacgttcgtactttacgtttaccgtcggtacggacggtaacggggtactaacgttcgttacgtggtacgttcggttacggttaccggttagtagttaaccgtacttaaaccg

SEQ ID NO: 112138 - DNA, 853 bp, Homo sapiens
  misc_feature: GYAE6OF02I9FMD.45.36.D03.1.454.CMB.1.raw
tcagacgcgatcgacacgaccggtgctcgatttagctgcgtcacgatctctcttgggggggaggaactgctcagttaggacccagagggaaccatggaagccccagctcagcttctcttcctcctgctactctggcctcccagataccaaccggaaaaattgtgttgacacgagtcctccaggcaccctgtctctgtctccgagggagacacgcccacctctcctgcgtacgggccaggtaggacgtgtctaacggtaagttacgttaggccgtacgggtaacccaaacgacggtaaaccgtcgggacccgtaacggtccaccccggaggtcccttcccgtactacgttccgaacgttcggaacgttgaccctaacgttaccccgaaacggccggggttacccctcgggtaccccgtaccccgaagtacccggttacgggttcccggtacggaccgtagggttcggggtacgacggggacctaggtaccttcgaccgttcctacccggtaccgtcgtaagcccgacgggtacccgtgggtaccgtcctaggtacgttcgttagtttacggaccgtttaagtttaccgttccggttcgtacggaacgtcccgttaacgggttcccgttaaccccgggtccacccgggttacccgtaccgtttaacccgggttccgggttttaacccggggggggacccccggggggtttaaacccgggtaggggttaacccggggtaacggtacgttacgggggtaacccgtaacgggtttaccggttacggggtcgttaaccggttcggaacccttaccggttacctacgttacggttacgttcccgttaacggtccccccgg

SEQ ID NO: 112139 - DNA, 783 bp, Homo sapiens
  misc_feature: GYAE6OF02I5PMP.45.36.D03.1.454.CMB.1.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactcgtcggcccccagataccaccggaaaaattgtgttgacacagtctcagcaccctgtctntgtctccgaggganacagcccacccgtctcctgccgacgggccaggtaggcgtagtaccgtaagttaacgttacgttacgggacttaccggtaaccaaacgaacggtaaacccgtcggaccgtaggaccccttccgaacggtcctcctactactcctagtgactcgacgtaactaccgaaacgtcgggtaccgtcggacctaccgacgtaccggtaggttcccggtaggccgttgggtacggggttacgcgggtaaccgtaggtaacccgttcgaccgttacccgtaccgtacccggtacggacctccggaaccgaccggttaggcccgacgttaagcgttaagtttcgtttacgtaccgttaacggtttcttacgttcggttagacgtacttcggttacccttacccggtaccgacccgtcgtacccgtaccgtttccggggtaacccggggggtcgggtaccgaagggggtccgttaagacccgggtttagaacccggtccgtacggtcgggttaccgttcgaaccggttccgggaacctttccgcgtttttaaccggttcctttaaccccgggattttcccccggtaacccg

SEQ ID NO: 112140 - DNA, 187 bp, Homo sapiens
  misc_feature: GYAE6OF02G5RU4.45.36.D03.1.454.CMB.1.raw
  modified_base (182)..(187): a, c, t, g, unknown or other
  misc_feature (182)..(187): n is a, c, g, or t
tcagacgcgatcgacacgaccggtgctcgatttagctgcgtcacgatctctcttgggttttgggggaagaggaagactgacggtcctcccaggagttcaggtgctgggcacagcggccctgggctgcctggtcaaggactacttcctcgatcgcgtctgagcgggctggcaaggcgcatagnnnnnn

SEQ ID NO: 112141 - DNA, 764 bp, Homo sapiens
  misc_feature: GYAE6OF02G631R.45.36.D03.1.454.CMB.1.raw
  modified_base (284)..(284): a, c, t, g, unknown or other
  misc_feature (284)..(284): n is a, c, g, or t
tcagacgcgatcgacacgaccggtgctcgatttagctgcgtcacgatctctcttggggagctctgggagacgagccccagcactggaagtcgccggtgtttcctttcggtgatcatcactgaacacagaggactcaccatggactttgggctgaccttgggttttcctcgttgcttcttttaagaggtgtccagtgtcaggtgcagggtggtgggagggtcgggggggaggtcggttcgtccgaggtccgtggggacggtccctgacgtacctcctcctggtcncacgtcctacgtggtactttcctcccgtactagttaactttcggttacctacggttcgggtcccgccgtggttcccgagggcggaaggggcgtagggtacggtgggtcggtcccttcgtacgtttaccgaaggtagtacggaaggtagacggaacggtacccgtactaccgaacgtaccgttaaccgggtacgggtacgggacccgtccttaccaccgtactaccgtaccgtaacgacgtaacctaacgttaccaaacgtacttcgttacctttacgttttcgaacttaaacgttagaacgttaccgtacgttagtaacggttaaggttacggaaaccggtacgtaacgtttcgttacgttacttagtttcgtagtaccggtcgggtaacggggtactaccggtttacgtacgttagggttaccgtttacggtttagggttacccggtttagggtttaacgtaccgttacttaaacccgg

SEQ ID NO: 112142 - DNA, 770 bp, Homo sapiens
  misc_feature: GYAE6OF02GR5L7.45.36.D03.1.454.CMB.1.raw
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
tcagacgcgatcgacacgaccggtgctcgatttagctgcgtcacgatctctcttggggagctctgggagacgagcccagcactggaagtcgccggtgttcctttcggtgatcatcactgaacacagaggactcaccatggactttgggctgacctgggttttcctcgttgcttctttaagaggtgtccagtgtcaggtgcgagggtgggtggaggtcggggggagtcgttgtccaggccgtgggacgtccctgacgacctctccgtgtgcacgtccctctggattcctccctntacgttaacttttcggttcctacgtcgggtcccncgtacggttccgagggtcgaaggggtcgtgggaggtcgggtacggtcccttacgtacgtttacccggaagtacgttgggaacgtcggaacggtaaccgggacccttaaccgtacgaaccggtaccgttccccggggtaaggaaaccgggggtccccttacgtttacccgaaccccgtacttacccgtacccgaagggtaacggtaacccttaaacgttaacccgaaaaggttaaacttcccggttacccgttttcgtttttacggaacttaaagttaccggtaaagtaccggtccgtaaggtacggtacggttggaaaccgggtaacgtacgtttaccgttggttacctttacgtttcgtacgttcggaccgggtaacggggtacttacgttacttaggttgtaagttcggttggtttaccgtaagttcgttatacgttaacc

SEQ ID NO: 112143 - DNA, 782 bp, Homo sapiens
  misc_feature: GYAE6OF02JS802.45.36.D03.1.454.CMB.1.raw
tcagacgcgatcgacacgaccggtgctcgatttagctgcgtcacgatctctcttgggaggaactgctcagttaggacccagagggaaccatggaagcccagctcagcttctcttcctcctgctactctggctcccagactaccaccggaaaattgtgttgacacagtcctccaggccaccctgtcctctgtcctcgaggggacacgacgcctaccctctcctgaccacgggccagtacggagtcgtactagtaacgtacgttaggtcctacgggtaacccaacgtaacggaaaccttggacccgtacggtccctaccccgaaggtccctcccgtactaactcccgaagtcgactacgaccaacgttacccaacgtccgggttcccctacgggtcccgtaccgacggtacgtaccgggttccggcggtaccgtagggtcgggtacgtacggggaactacggtacgtcctaccgtcctaccgaaccggttcgacgtccgaccgtccgtacggaccgtaccgtggtaacttcgtacgttttacgaccgtttaagttttcctacgggttacgtactaccgggttaccgtacgggttacccgtttcccggaacccgtcccggttaccgtaccgtttcccggttaaccgggttcgggggaacccggggttaccgtaggggttacggaccgtaggtaccgggacgtaacggtaaccgggttcggtacggacccgttacgacccggtactaccggttccgttacgtacccggttactacccgttacccgg

SEQ ID NO: 112144 - DNA, 743 bp, Homo sapiens
  misc_feature: GYAE6OF02IG7AU.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggtttttcctcgttgcttcttttaagaggttgtccagtgtcaggtgcagggtggtgggaggtcggggggaggtcgttgtccgaggccgtggggacggtccctggacgacctctcctgtcgcacggtcctcgtggactttccgccccttctaacgtttaacttttcggtttccacgttcgggtcccgccgtaggttcccgagggccgaaggggctagggaggttcggggtcggccccttctacgtttccggaaaggtactacgggaagtaggaggtaaacggtcccgtacgtacggtaacgtaccgtccgggtaggaaccggggtcccctacgtttcccgaacctaccttccgtaccgacggaacgtaaccgtaaattaccgaaagtaacgttcgttacctttacgtttttacgaaccgtaaacgttacgtaaacgtacgtaccgtagaacggtaaggttacggacggtaacgtaccgttcgttacggttacttacgtttcgtacggtccgaccggtaggggaaccttagtccgtagttcgtagttcggttacggttcgttaagttacggttacctacgtaaaccc

SEQ ID NO: 112145 - DNA, 768 bp, Homo sapiens
  misc_feature: GYAE6OF02JR2M6.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaaccggtaaaattgtgttgacacagtctccaggcacctgtctctgtctccgagggacgacgacgcccaccctctccgtgcgacgggcctaggtaggagtcgtacaaggtaacgtacgtacggtcgtacggtaaccaacgtaacggaaccgtcggaccgtaacggcctaccccgacggtcctacccgtactacttacccagttacggactacgtacccgaacttacccgaaaccggccgggttcccggtacgggccccgtaacccgtaacggtaaccgtaccgggttccggtacggtacgtacgggttcggggttcgtacggggtaaccgtaaggtaccgttacctacgtccgtaaccgtacccgtacgacggtaccgacgtccgtacgggaacctccgttaggtacgttacgttaacgttttcggaactttaacgttttccgtaccttggtacctacggaccttacgggtcccgtttaccgacccgtaccgtacccgtccttacccggtaccgggttccgggggaaccgggtaccgtaggggtagaccgttaggacggtaacgtacggtacggtggtagtccgtacgacctcgtactcggttccgctttacgacccgttccg

SEQ ID NO: 112146 - DNA, 741 bp, Homo sapiens
  misc_feature: GYAE6OF02FHE1R.45.36.D03.1.454.CMB.1.raw
  modified_base (159)..(159): a, c, t, g, unknown or other
  misc_feature (159)..(159): n is a, c, g, or t
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgngttgacacagtctccaggcaccctgtctctgtctccgagggganacacgcccaccctctcctgcgagggccagtaggagtgtcaagtaacgtacgttaggctggtaaccaacgacgaaacctggccagggcctaccccaggcctccgtcgacttccataggatcgcactacccaacgtcgggtcccctgggccgtaccccgagaccgtacgggtttcccggtggacgtagggttcgggtcgtacggggaactacggtacgtttccaaccgttcctaccgtacccgttcgacgcgacggtccgtaggtaccgtcccgtagtacgttggtacgttttacggaccttaacgttttaccgttcgttacgtacgtaacgtaccgtacgtcccggtttacccgacccgtaccgtacccggttccttaccggtaccgggttttacccgggggaccggggggtaaccgtacggggtacgggtaacgtagggttacggaacggtaacccggttaaacggttcggtaccgggtccgttaccgaccgtaccgtagttacccgtaggttcctttaccgtacccgtttcccccgg

SEQ ID NO: 112147 - DNA, 628 bp, Homo sapiens
  misc_feature: GYAE6OF02FWLGJ.45.36.D03.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
  modified_base (352)..(352): a, c, t, g, unknown or other
  misc_feature (352)..(352): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccaggtaggagtgtcagtaagtacttaggctaggtaccaanagaaacctggccaggctccgagcctcncatccatgatgacactccgaacgtacgggtcccnggccgtacccagaccgtaggttccgnggacgtagggtcgggtctggggacaggtacgttcacctcgtccaccgtcacgtcacggccgtggacgtcctggtattgtagttttcgactttacgtttacttcgttagtctagtccgtaggtccgtttcccgacgtacccgccgtcctccgtaccggttcggggaccggggacctggggttacggagtacgtaggacggaacgtacggtcgggtacggtcgttacggaccgtaaccgtcgtttaccggttccgtccgtttacgcccgtttaccccg

SEQ ID NO: 112148 - DNA, 692 bp, Homo sapiens
  misc_feature: GYAE6OF02G849D.45.36.D03.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (677)..(677): a, c, t, g, unknown or other
  misc_feature (677)..(677): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggccaccctgtctctgtctccgagggnacagccaccctctcctgcagggccaggtaggngtgtcagtaagtactaggctaggtaccaacgtagaaaccgtggaccaggcctccccgaggtcctccgtacactccaagtagactcgacaactacccgaaacgtcgggtcccctggacccgtaccgaaggtaccgacgggtttccgcggactaggggtacggggtctggggaactagtacgttcctaacgtcgtaccgaccggtaccagaccgacgtaccgtcggtacggcctaggtactagttacttttcgacgttaacgttttacgttccgttagtacgtacgtacctacgtaccgttcccgacccgtacgtcccgtccgttaccgttcgggttaccggggtccgggggaacgtacggggtacggtaacgagttacggacggtaccggtaaacgtgggtcggtaccgtacggtacccgacgttacgtcgttacgttaccgttntaccgttacccccgg

SEQ ID NO: 112149 - DNA, 1048 bp, Homo sapiens
  misc_feature: GYAE6OF02H6CJD.45.36.D03.1.454.CMB.1.raw
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccacggaaaattgtgtgacacagtctcaggcacctgtctctgtctccgagggagacacgccacctctcctgcgacgggacctaggtacggtagtcgtacgaaggttaacgtacgttaggtacgtacggtaacctaaacgaacgaaaaccgtcggacccgaacgggtacctaccccgaacgggtccttacccgtacctaacttaccccgaagtttagacgttacggacctaacctacccgtaaacggtaccggggttcccccttacggggtaccccggtaccccgtaacgggtaacccggttaccggggtttaccggtacgggtaccggtaacgggggttcggggggtttaccgttaacgggggaaccgttaaacggttaccggtttaccctaacccggtttaaccgttacccggaaaccccggtttcggaaaccggtttaacccggacgggttaaccccgggttacgggggtaaccgttaccccggtttaagggtaaaacgttcgggtttttaaacgttttccggtaaacccggtttttaaccgggttttttaccgtttaacccggttagggtttaaaccccgtaaacgggtaccggtttaaaccccggggtcccggttttaacccccgggacccggttaaccccggttacccggttacccggttttaccggttaaccccgggggtttttcccgggggggggaaccccgggggggttaaacccgggttaacgggggttaacggggtaaccggttaaacgggtacccggggaaccggttaaaccggggttaaaccggttccggggttaggtaaacccggttacccgggtaacctaacccggttaacggttttaccccggtttacggtttaccccgttttaaccgtaacccggttttccccccgg

SEQ ID NO: 112150 - DNA, 859 bp, Homo sapiens
  misc_feature: GYAE6OF02JNXWA.45.36.D03.1.454.CMB.1.raw
  modified_base (124)..(124): a, c, t, g, unknown or other
  misc_feature (124)..(124): n is a, c, g, or t
  modified_base (211)..(211): a, c, t, g, unknown or other
  misc_feature (211)..(211): n is a, c, g, or t
tcagacgcgatcgacacgaccggtgctcgatttagctgcgtcacgatctctcttggggaggaactgctcagttaggacccagagggaaccatggaacgccccagctcagcttctcttcctcctnctactctcggctccagactaccaaccggtaaaattgtgttgacacacgtctccaggccaccgtgtctctgtcctccgagggactacncgcccacctctccgtgacgacgggacctaggtaggagtcgtacgaagtaacgtacgttaggcgttacggtaaccaacgacgaaccgtcggtaccgacggtacctacccgaggtccctaccgtacgaaccttaccgtacgtacgtacgtcgtactaccgtaccgaacggtaccggttcctacgggtaccctaccgacgtaccggttacgggtccgtacggtacggtagggtccggtacggtacggtaaccgtaggttaaccttccgtaactccgtacccgtaacgtacgacgtccgacggttacccgaggaacccttcgtaaccgtaggtttacttttacggtttttacgggttaactttcccgacgtttcggtaacgttaacccgggcgtttaacccgggttccccgttaccgaaccccgggtccggttacccttttacgggtaacccggttttaccgggggggtttccgggggggaacccggggttaactttaccgggggggaataaccgggttagtaaacccggggttaggggaacccctttaaccgggggttggtacccggggccttaaaacccggccgtttaaccgttacgtttacccggttccggttaacccgttttcctacccggttccccgggtttaaccc

SEQ ID NO: 112151 - DNA, 752 bp, Homo sapiens
  misc_feature: GYAE6OF02IEFBY.45.36.D03.1.454.CMB.1.raw
  modified_base (201)..(201): a, c, t, g, unknown or other
  misc_feature (201)..(201): n is a, c, g, or t
  modified_base (710)..(710): a, c, t, g, unknown or other
  misc_feature (710)..(710): n is a, c, g, or t
tcagacgcgatcgacacgaccggtgctcgatttagctgcgtcacgagtctctcttgggggaggaactgctcagttaggaccagagggaaccatggaagccccagctcagcttctcttcctcctgctactctggctccagataccaccggaaaaattgtgttgacacagtctccaggcaccctgtctctgtctccagggganacagtccacctctcctgcacgggccagtacggagtcgtacgaagttacgtacgtttacggcgttaggtaccctaaaacaacggtaaaacccgttgggaccccgaacggggtcccttaccccgaacggggtccctttaccctacctaaccttccaagtttacggatttcggaccaacttcccgaaaacgccgggttcccgtagggccctaccccggaaggtaccgtacgggtttccccggtgggtaccgtaggggttcggggtccggtaggggaactacggttaacgttccgtaactccgttaccgacccgggttacaacgggcctagtaccgttacggaccggccccgttaagtcgtaggttacgtttcgtacgttacgttttacgtttcgttacgtcgtacgtcgttaccgtccgttaccgccgaccggccgtcctccgtcggttccggggaccggggtacgtacggggtagacgtacgtggacggtccggtaacttggtacgggtcncggtaccgtcgaacgttcttacgttcttccgtaccttcccgg

SEQ ID NO: 112152 - DNA, 756 bp, Homo sapiens
  misc_feature: GYAE6OF02IGZKB.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgcttcttttaagaggtgtccagtgtcaggtncgaggtggtggaggtcggggggagtcgttgtccgagccgtggggacgtccctagacgtacctcgtcctaggtcgctacggccttgtcggtactttcctccctacgtagtttaaccgttttcggttacccacggttcgggtccccgtaccgtacgggttccgagggacgtaagggggcttgggacggttcggggtccgcccttacgtacgtttccggaaagtagtcggaagtcggaaggaccggaccttactacggaacgtaccgtcggtaacggggaacgggtcccttacgtttaccaaccgtacgtcccgtaccgaagaacgtaactaacttaccgtaaagtacgttacgttaccctttagttttacgaacttaaacgtaggtaaacgttacgaccgttaagggtacgttacgggttaggaacggttaccgtaccgttacgttacggttacttaacttttccgtcggtacgggtaccggtaggggtaccctaggttaccgttagtcgttacggtcgtttacgggttccgttaaggtacgtacctaacgtaaccg

SEQ ID NO: 112153 - DNA, 740 bp, Homo sapiens
  misc_feature: GYAE6OF02GXHK5.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtcctctgtctccgaggggagacagcccaccctctcctgcagggccagtaggagtgtcagtaagtacttaggctggtaccaacagaaacctggccaggcctccgaggcctcctcactccatgactgccatacccaacgtacgggtcccctgggcccgtcccaggaccgtacgggttcccgtgggcgtacgggtggggtaccgtggggaacaggtacgttccacgttcctaccgaacccgttcgacgtacgacggccgttagggacctccgtgacgttgttacttttgaccgtttacgttttaccttcgttcgttctacggtccgtaacgttccccggttcccgacccgtaccgtccccgtaccgtaccgttaccgggttttcccgggggaccggggggttaacccgtagggggtacgggtaacggtacggtacgggtaacggtaaccgggtaaccggtttcggggtacgggtaccccgttacgggaacccgttaacccttacggtttacccggtttaccggtttacccgttttacccgtacgttttaccccccccgg

SEQ ID NO: 112154 - DNA, 755 bp, Homo sapiens
  misc_feature: GYAE6OF02I5K2T.45.36.D03.1.454.CMB.1.raw
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (391)..(391): a, c, t, g, unknown or other
  misc_feature (391)..(391): n is a, c, g, or t
tcagacgcgatcgacacgaccggtgctcgatttagctgcgtcacgatctctcgttgggggggagaactgctcagttaggacccagagggaaccatggaagccccagctcagcttctcttcctctgctactcgtggctacccagactaaccgaaccggtaaaattgtagttcgaacacagtcctaccgaggcctaccctgtcctctgtcctccgagggacacacgccncctctcgngcgaacggccaggtacggagtcgtagtaacgtaagttaccgtaggtcctacggtaacccaaacgaacgtaaaccgtcggacccaaggtcctcccgaggtcctccgtacactccgtaactggactcgacctaactacccgtaaggtaccgggtcccncgggtccccgtaaccaggtaccgtaacgggttaccgacgggtcgggttaccgggtttcggggttccgaaccgaggttaacccggttcttaacgtccgttaacctaccggtaaactaaacgtccgaaaccggttcgaccgtcctaacccgtaaccgtaacgttaacgttacgtttacgtactaacgttctaacgttcgtactaccgatacgtaccgataccgtaagtccggtactcgtaccgttacggtaccgggtacggtacgggtaaacgaggtacggaacgtacgtaacgaaaccggtcgtaacggtcgaacgtcgtaccgtaccgtacgttcccggtacttacctacgttacccttacccg

SEQ ID NO: 112155 - DNA, 837 bp, Homo sapiens
  misc_feature: GYAE6OF02JJFLX.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggcctcccagactaccaaccggaaaaattgtgttgacacagtctccaggccaccctgtctctgtctccgagggagtacacgcccaccctctccgtgccgagggccctaagtagggagttcgtacgtaagtaacgtacgtttaggcttaggtaaccaacgacgtaaaccgtggacctacgggcctaccccgaggtccttccctactacgttccagtacgacttacggcctaacgtaccgaacggtaccgggtacccgttcgggacccgtaccccgtaggtaaacccgttacgggtttcccggacggtaccgttacggggtacgggggtttacggtacgggtaaccaacgggttaccgtttaccgtaaccgttcccgtacccgtaaaccggtccgacgggtaccgaacgggtacccggtacgggtaaacggtcccgttaggtaaacgttcggtttaacgtttacgggtacctttaaccggttttactttaccggttcgtaccgtaaacgtcgtcggtacccggttccccggacgtacccggtcccgtaccgtttacccggtaccgggttttaccgggggacccgggggttaccgtaaacggggtccgggtaacgggtaccgtacggtaacgggaccgttaagggtcggttcggtacgtacccgaacgtacggtacttaccgggttccttactttcgaaccgttccccg

SEQ ID NO: 112156 - DNA, 776 bp, Homo sapiens
  misc_feature: GYAE6OF02HKAYL.45.36.D03.1.454.CMB.1.raw
  modified_base (130)..(130): a, c, t, g, unknown or other
  misc_feature (130)..(130): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
tcagacgcgatcgacacgaccggtgctcgatttagctgcgtcacgatctctcttgggggaggaactgctcaggttacggacccagagggaaccatggaagcccagctcagcttctcttctcctgctactntcggccccagataccaccggaaaattgtgttgacacagtctcaggcaccgtgtctctgtctccgagggnacagccacctcncctgcaggccacggtggagtcgtcagtagtacgtagtctacgtaacaacgagaaaccgtcggaccgacgggtcccaggcttacattcctagtttaacgtcgaacgctactaccggaaacggacggcctagtcggactactccccgagtccgtaggttcgtacggtcggtacgagggtttacgggcgttacggggaacctagggtaccttttacgacccgtttacccgtacacccgtaagttccgacgggtacgaaaccggtcccgtaaccgggttaaccccgtagggttaacgggttaactttttcccggaacggtttaactttaaccggttaacttcgttaccggtagaccgtttcgggtacgggttcgggaacccggtacggtacgtccggttaccgtttaccggtacgggtttaccggggaccggggaaccgggtaaacggaaccggggtaggaaacgtacgtaaaccgggaaacggttaccggtaggttacgggttaccgtaccggaacttaacccgttagtccgtttccggtttaacccttccggtaaccctttaccccg

SEQ ID NO: 112157 - DNA, 705 bp, Homo sapiens
  misc_feature: GYAE6OF02FTN7R.45.36.D03.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccaggcaccctgtctctgtctccgagggganacagccaccctctcctgcaggccagtaggngtgtcagtaagtacttaggctggtaccaanacgaaacctggaccacggcctacccgaggtcctcctcactccatgatgcactaccaacgtacgggtcccctggccgtacccacggtacgtacgggttccggtcggccgtagggttcggggtcgtacggggacgtaaggtacgttaccgtaccgttccgtaccgtacccggttaccgaccggtacgaccggtcccgtacgggaccgtcccggtagttacgttgttacgttttcgacgttacgttttacctttcgttcttacgacgtcgaacggttcccgttacccgcccgtaccgtccgccttaccggttaccggttcccgggggaccgggggtacccgtagggttacggaggtaccggtagggaccggtaaccggtaagttcgggtacggtccgtacgaccgtacccgtagttccgttccggtactttccgactttccccgg

SEQ ID NO: 112158 - DNA, 665 bp, Homo sapiens
  misc_feature: GYAE6OF02G3ORR.45.36.D03.1.454.CMB.1.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctacaggcaccctgtctctgtctccagggganacagccaccctctcctgcagggccagtaggagtgtcagtagtacttaggctggtaccaacagaaacctgccaggctcccgaggcctcctcactccatgatcgcactccaacgacgggtccctggcccgtcccaggtaccgacggttccgnggcagggtcgggtctggggacaggtacgttccacgttcgtaccgtacccgtcgtacgctacggccgtaggacgtcccgtagacttcggtattttggacctttaggttttacttacgttcggtactaggtcctacgtcccggttaccgcccgtaccggtcccgtacgtacccgttacgggtttcccgggggacggggtaccggtaggggtcgaacggtagtacgggtaaggtacccgtaacggttggacgggtaccgtcggacccgtaccgtaacgtttcccgtacgtttaccgttaccgtacgtttcccccgg

SEQ ID NO: 112159 - DNA, 814 bp, Homo sapiens
  misc_feature: GYAE6OF02I96AX.45.36.D03.1.454.CMB.1.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
tcagacgcgatcgacacgaccggtgctcgatttagctgcgtcacgatctctcttgggggaggaactgctcagttaggacccagagggaaccatggaacgccccagctcagcttctcttcctcctgctactctggctccagtataccaaccggaaaattgtgttcgacactagtctccaggccacctgtctctcgtctcgagggacacacgcccaccttctaccgngacgacgggccaggtacggngtctcgtaagtaacgttacgtaggctacggtaaccaacgaacgaacctggtaccacggtcctacccgaggaccttccactacgtccatacgacgtcgtaccaattacccgaaacggtcccgtaccgtccggaccgttaccaccggtaacgtaccgggttaccggtggtaaccgtggttacggggtacgtagggaacccgaaggttacgttaccgtaaccttccgtaacccgtacccggttagaccggacgttacgaccgtcgggtaaccgtcgttaacgtacgttacgtttcgttttaacgtaccgtttacgtttttaacggttaccgttcgttccgaacgttaccgtaccggttcccgtttccgaacccgttaccgggttccctaccgttttacccgggttaccgggttccggggggtaaacccggggtaccggttaacggggtcgggtaaacggtccgtaaggggttaaccggtaacccggtggtttaacgggtcggttaaaccgccgaacccgtttaccgttagtcccgttaacggttcccttaccggggtttaacccttccccgg

SEQ ID NO: 112160 - DNA, 716 bp, Homo sapiens
  misc_feature: GYAE6OF02GFBM7.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggccaccctgtctctgtctccgagggganacacgcccaccctctcctgcacgggccaggtagggagtgtacagttaagtacttagggccttagggtaacccaaaacgaaaaacccgtcggaccgacggccctaccccgagggtcctacacttacctactacctagtcggaccgactacgtaccggaaacgtaccgggaccacgtcggaccaccgtcccacggaccgtaggttccgaggtcggcgtagggttggggtaccgtagggaactaggtacttccgacgtacctccaaccagtcgacgccacgtcccggtacggacccgtggtaggttactttcgaccttaactttacctacgtcgtacacggtcgtaggtccgggtacggacccggtaccggcgtccggtaccttcggtacccggtttcgggggcccggtaaacggaccgggtaagggtacggaacgtaaccgtaacggaaacggtaaccggttcggtacggtactaccgaccgtaacccgtatttccggtaccgtttccttaccg

SEQ ID NO: 112161 - DNA, 825 bp, Homo sapiens
  misc_feature: GYAE6OF02IXO4P.45.36.D03.1.454.CMB.1.raw
tcagacgcgatcgacacgaccggtgctcgatttagctgcgtcacgatctctcttggggggaggaactgctcagttaggacccagagggaaccatggaagccccagctcagcttctcttcctctgctactctggctcccagactaccgaccggaaaattgtgttgacacagtctaccgaggcaccctgtctctgtactccgaggggacacacgccaccctctcctgaccgtgggccaaggtacggacggtcgtacgaacggttaacgttacgttacggcttacggtaaccaaacaacggaaaccgtcggccgtaacggtcctaccccgaaggtccttcccgtacgacttacccgagttaccggacttcggacctacgtacccaacggttaccgggtcccgtacggggtccctacccgaggtaaccggtaccggggttccggtacgggaccgtagggttacggggtaccggttacggggtaaccgtacggttacgttaccgtaaccctccgttacggaacccgttacgacgtaccggtagcccggtggtaccggcgtacgtagttaggtcgttttacgtaccggttaacgttttcccttagttcgtaccgtaacgttcgtaaccgtccccggttacccggtacccgtaccggttccccgtacgtacccgggttaaccgggtttccccgggggaacgggggggttacccgaacggggttagggtaacccgtagtaccggtacgggtaaccgacggtttacggtacgggaccgttacggaccttaccgtacggtttaccgtccggtttaacccttcgtacccgttcccg

SEQ ID NO: 112162 - DNA, 680 bp, Homo sapiens
  misc_feature: GYAE6OF02F44KZ.45.36.D03.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (409)..(409): a, c, t, g, unknown or other
  misc_feature (409)..(409): n is a, c, g, or t
  modified_base (426)..(426): a, c, t, g, unknown or other
  misc_feature (426)..(426): n is a, c, g, or t
tcagacgcgatcgacacgaccggtgctcgatttagctgcgtcacgatctctcttgggggaggaactgctcagttaggacccagagggaaccatggaagcccagctcagcttctcttcctcctgctactctcggccccagataccaccggaaaaattgtgttgacacagtctccaggcaccctgtctctgtctccgagggganacagcccaccctctcctgcgagggccaggtaggngtgtcagtaagtacgttaggctacggtaccaacacgaaacctggccaggcctccgaggtcctcctcactccatgatgacactaccgaacgtacggggtccctgggccgtcccgagacgtacgggttccgtggcgaggtcgggtcgtgggacaggtactcactcgtcaccgtanacgcaggtccgtggacnccttaggatttagtgttttgaccgtttagttttaccgttcgttgttaccgagtaccgacggttcccgttacccgcctaacccggtcccgtccttccggttacccgggtttccggggggaccggggggttaaccgtagggggtacgtacgggtacgttaacggaacgggtaccgtacggttcgggacggtccgttacgacccgtaaccttacggttccgttacgtttaccctcgttacccttccccgttccccgg

SEQ ID NO: 112163 - DNA, 596 bp, Homo sapiens
  misc_feature: GYAE6OF02F36AR.45.36.D03.1.454.CMB.1.raw
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
tcagacgcgatcgacacgaccggtgctcgatttagctgcgtcacgatctctcttggggagctctgggagacgagcccagcactggaagtcgccggtgttcctttcggtgatcatcactgaacacagaggactcaccatggactttgggctgacctgggttttcctcgttgctcttttaagaggtgtccagtgtcaggtgcaggtggtggaggtcggggggaggcggttgtccgagccgtggggacggtccctgacgactctcctgtgcagcctgtggattcctcctcagttaactttggtttccacgttgggtcccgcgtacggttccaggcgaaggggctgggagtgggtcgccctntacttcgagntggaagtgagacgctacnagactcgtagacggcctctcacatctaccgagacgactaataccaagtactcgtcctttctttacgactaatagtaagtacgtcctagtagtaggttggaacgtacgtacgttctacgttacttatttcgtggtcgaccgggtagggtaactacttacgtagttgtagttcgttacgggttacgttaggtacgttaacgtcttaaacccg

SEQ ID NO: 112164 - DNA, 507 bp, Homo sapiens
  misc_feature: GYAE6OF02HR9OC.45.36.D03.1.454.CMB.1.raw
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (445)..(445): a, c, t, g, unknown or other
  misc_feature (445)..(445): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctggtaccaacagaaacctggccaggctcccaggctcctcatccatcgatgcatccaacagggtccctggcgtcccagacagggttcctggcaggtgggtcngggacagacgtcactntcaccgtcagcagcctggacgctgagtgatttgctagttacttcttgtcagctagcgttcgccacgcccgctcncgttcgcgggggtccagggtgagntgagacgaacgtgtggctgcacnctctgtcttcatccc

SEQ ID NO: 112165 - DNA, 621 bp, Homo sapiens
  misc_feature: GYAE6OF02FN7FF.45.36.D03.1.454.CMB.1.raw
  modified_base (202)..(202): a, c, t, g, unknown or other
  misc_feature (202)..(202): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacacgccaccctctcctgcgaggccaggtaggagtgtacagtaagtacttaggctggtaaccaacaagaaaccgtggaccaggcctcccgaggcctcctcactccatgatgcactccaacgcgggtccctggcctcccaagaccgtacggttccgtgcgtaggtcgggcgtcgggacaggtcgttcgacctcgtaccaccgtacacgcacgccgtggacncgtgntgttntttgacttagttacttcgtcgtcagtcacgtcggttcccgaccgtccggtacccgtccgttccgttacggtttaccgggggcccgggggtaaccgtaggggtacgaggtacgtagggaacgaccggtaagttcggtcggtacgtcgaccgtaccgttacgtaccgttcgttcgttacctaccgttcccg

SEQ ID NO: 112166 - DNA, 755 bp, Homo sapiens
  misc_feature: GYAE6OF02H4WBZ.45.36.D03.1.454.CMB.1.raw
tcagacgcgatcgacacgaccggtgctcgatttagctgcgtcacgatctctcttggggaggaactgctcagttaggaccagagggaaccatggaagccccagctcagcttctcttcctcctgctactctggctcccagataccaccggaaaattgtgttgacacagtctccaggccaccctgtctctgtctccgagggagacagcccacctctcctgacgacggaccgagtaggaagtcgtcaagttaacgtacgttacggctacggtaaccaaacgtacgaaaccgtggaccgagccctaccgacggctcccacgtactaccatcgactcgacactccgaacgacggtccctgccgtaccacggtacgtacggttcgacggacgtacggtgggtacgtacggtacgacggttacgtactcgtacctccgacggtcgacgactaccggtcgtacggtaccgtaccgtgtaacgttacggttaacgttttcggtaaccgttaaccgtttttacgttccgttacggttaaccgtggtaccggttaaccgtcccggttacccgacccgtacccggttacccggttacccttacccggggtttaaccgggtttcccgggggaccgggggggtaacccgtaggggttaccgggtaacgttaaccgggcggttaaaccggtaccggtaaccgttcggggttcgaaccgtcgacccgtcgttaacgttccgttaacggttccttaccgttaccttaccccgg

SEQ ID NO: 112167 - DNA, 749 bp, Homo sapiens
  misc_feature: GYAE6OF02GQC6O.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggcccccagataccaccggaaaattgtgttgacacagtctccaggccaccctgtctctgtctccgaggggacacacgcccaccctctccgtgccagggccaggtaggagtgtacgaagtaagttacgttagggctaggtaaccaagtaacgaaaccgtggaccgaacggcctacccgacggcctccgtcactaccatagactgacaactcccgaacgtacgggtccctgggcctacccgagtaccgtacgggttcccggaggccgtaggtcggggtacgtacgggactaggtacgttacgactcgtacccacggttccaacggtaccgacggtacccggtggaccgtcgttaagactttcggtttaatttttggacctttaaggttttacttccgttgttacgtagccgttacggtcccttcccggacctacccggtccgtccttacccggtttacgggttcccggggggtaccgggggaaccgtagggggttaccgaagggtaacgtaccgggtaggtaacccggtagggttacggttaccggggacgtaccggaacccgttaacttccggtttacgtttaccgtaaccttttccggtaaccgtttcccctaacccg

SEQ ID NO: 112168 - DNA, 789 bp, Homo sapiens
  misc_feature: GYAE6OF02I84EI.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagcccagctcagcttctcttcctcctgctactctggctcccagataccactggagaaatagtggtgacgcagtctccaggccacctgtctgtgtctcgagggganacacgccacctctcctgcgacgggccaggtaggacgtgtacgaagtaacgtacgttaggcttaggtaaccaacgaacgtaaacctggaccgacggcctacccgacggccttccctactactacctatacggactcggacctactaccgaacgtcgggttaccctggtacccgacccgtaagtaccgtacggggttccggtagggtaccgtagggtaccgggttacgtacgggactaacggtacgttcctaccttccgaccgtaaccgtctacggactcggtacgttacgggaccgtaccgtaggtactttaacggttacgtttcggaaccgtttaacgtttttaccgtacgttaggttaccaacggttaccgtacgggtttaccccgttccggacccgtaaccggtcccgttaccggttacccgggttaaccggggttttacccggggggaccgggggttaaacccgagggggttaccggtaacgggtacggttaccggggaacggtaacccggttagggtttaacgggcggttaccgtcgggtaaccccttacgtaacgttttccggtcggtttacccgtttaccgg

SEQ ID NO: 112169 - DNA, 670 bp, Homo sapiens
  misc_feature: GYAE6OF02FOR5M.45.36.D03.1.454.CMB.1.raw
  modified_base (231)..(231): a, c, t, g, unknown or other
  misc_feature (231)..(231): n is a, c, g, or t
  modified_base (450)..(450): a, c, t, g, unknown or other
  misc_feature (450)..(450): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctcaggcaccctgtctctgtctcgaggggagacagccacctctcctgacaggccagtaggngtgtcagtaagtacgttagcgtaggtaccaagacgaaacctgggaccacggacctccccgaaggcctccgtcctacgtacccagttcgaactgtaccaacttacccgaaacggtacgggtccctagggtccctcccgaagtaccgtaggttcccgtggtccgtaggttcggggtcttacggggacaaggtacgtttaccgacttccgtacgacccggtnaaccggcgtacgccggtacgggacgtcggtacgtagttacgtagttttacgactttacggttttctacgttcgtcgtagtccgtggtcccgtcccgtccgaaccgtccggtcctacgttcccgggtttacggggccggggtaacgtcggggtagagtacgtggacggtaagcggtggtaggtcgtgccgtacgtcttcgttacggttcctgcccgttccg

SEQ ID NO: 112170 - DNA, 649 bp, Homo sapiens
  misc_feature: GYAE6OF02HFR56.45.36.D03.1.454.CMB.1.raw
  modified_base (177)..(177): a, c, t, g, unknown or other
  misc_feature (177)..(177): n is a, c, g, or t
  modified_base (227)..(227): a, c, t, g, unknown or other
  misc_feature (227)..(227): n is a, c, g, or t
  modified_base (340)..(340): a, c, t, g, unknown or other
  misc_feature (340)..(340): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
  modified_base (627)..(627): a, c, t, g, unknown or other
  misc_feature (627)..(627): n is a, c, g, or t
tcagacgcgatcgacacgaccggtgctcgatttagctgcgtcacgatctctcttgggaggaactgctcagttaggacccagagggaaccatggaacgcccagctcagcttctcttcctcctgctactctggctcccagactaccactggaagaaataggtggtgacgcagtctaccnggcaccctgtctgtgtctaccgaggggagagacgtccaccccttcgtccngccgacggaccaggtacaaagttcgttacgcgaaccggtataccgtttaagccttaggtaaccgagaccgaagtacggacctgggcccaaggccctcccgagccttcccttanactcgtatcgggtcctacgtactccctacccggacggttcccgtcgtcggtaccgttccccgacggtacgttacgacgggtcgcgtaggtcgggtctacgggactagtcgtttcacgtctctaacgactcgacgcgacgccgttncgtacgtntacgagtttacttacgtacttacgtttaatttacgtcgtcgtactacgttaaatttactaaagtcttacgtaccgtccgttaagggtccgttaccggccgaacggttacgtagggtactaacgaactaagtacnggtacgcgtacgctactgtccg

SEQ ID NO: 112171 - DNA, 812 bp, Homo sapiens
  misc_feature: GYAE6OF02IYI2A.45.36.D03.1.454.CMB.1.raw
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggccaccctgtctctgtctccgaggganacagccacctctcctgcgagggccaagtaggagtcgtcaagtaacgtacttaggctcggtaaccaacaacgaaaccgtggaccgaggcctaccgaggcctccnactcatgactgactacgtaccaacggtacgggtccgtcggtacccgtacccgagtaccggtaacggttccggtacgggtacgtacgggtcggggtttacggtacggggtacgtaacggtacggtttacctaaccgtaccctaccggtaacccgttacgaaccggacgtaacgggtaccccgttagggtaacgtacccgtaggttaacgttacggttacgttttacgcgttttaaaccgtttctttacgttacgtttaccggaagtaccggttaacgttcccgtacccggtacccgaaccggttcccggttaccctaccgggtttaaccggggttccggggggacccgggggttaaaccgggtacgggggtaacgggttacgggtaaccgttacgggaaaacgggtacccggttaaacggttgggtacccgggttcgtaacccgaccgttaaaacccggtcttttaaccggttcgttaacccggttttacgacccgttttcccccgg

SEQ ID NO: 112172 - DNA, 743 bp, Homo sapiens
  misc_feature: GYAE6OF02HEZJB.45.36.D03.1.454.CMB.1.raw
  modified_base (428)..(428): a, c, t, g, unknown or other
  misc_feature (428)..(428): n is a, c, g, or t
  modified_base (501)..(501): a, c, t, g, unknown or other
  misc_feature (501)..(501): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccgaaccggtaaaaattgtgttgacacagtcctcaggccaccctgtctctgtctccgagggacgacacgccaccctctcctgcgacgggccaggtaggagtgtcagttaacgttaccgttagggctcgggtaacccaacgtaacggaaacgttcccgggaccacggggcctccccggtaagggaccttcccgtccgtaacctcccgaagtcggacttggacctaactcccgaaacggtacgggttccccgtcggaccgtcccgtaacgacgttacgggttccgnggtacgcgggttcggtcgtacgggatacgttaggtcctacgtcctccaccggtcacgcgtcggtccgtggacncccgttagacgttacgttagttttcggcgtttaacgttttaccgtttcgtaggttaccgtacgtcgtaacgtcccggtttcccacccgtaccggtcccgtaccgtacccgtacgggtttccggggaccggggggttaaccggacggggttaggacggtggtacgtaacgggacgtaacgttcgggttcggtccgtacgtacgacccgtcgttaccgtccggtttacttcgttacgttccccg

SEQ ID NO: 112173 - DNA, 917 bp, Homo sapiens
  misc_feature: GYAE6OF02G5KY8.45.36.D03.1.454.CMB.1.raw
  modified_base (172)..(172): a, c, t, g, unknown or other
  misc_feature (172)..(172): n is a, c, g, or t
  modified_base (203)..(203): a, c, t, g, unknown or other
  misc_feature (203)..(203): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggttttcctcgttncttacttttagaggtgtccagttgtcaggtncgtagggtggtgggacgggttcggggggagtcggttgtccgagccgtaggggacggttccctggacgtacctcctccgtgtcgcacgtcccttcgtcggtaacttcccttcccctacgtaacggtttaaccgtttttcgggtttaccccacggtttccgggggtaccccgtacccggttacgggtttccccgaagggaccggtaaacgggggggttccttaggggtagggttcggggtcccggtaccccgttacgtaaccggttttacccggaaaggttacgtacgggtaaggttacggaaacgggtaccggtaccctttaacgtccgtaaacggtaccgttacccgggtaagggaaacccggggtccctaaccgtttcccgaaaccctacgttacccgtacccgtaaaggtaaccgaaccgttaaccttaacccgaaaagtaacgtttacccgtttcccgtttacgtttttacggaaaccttaaacgttacggtaaagttcccggttaacgttaacgggagttaacgggtttacgggaaacgttacccgtacggtttaccgttacgtttacgttaactttttcggtacgttacgggtaccggggtaaacggggtacctaacggtttaccgttaaacggttggttaaccggtttacggtttacggggtttttaacgtaacgggttaacgtttaccgttaaacccttaaccccgg

SEQ ID NO: 112174 - DNA, 777 bp, Homo sapiens
  misc_feature: GYAE6OF02GVU6W.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctcggcccccagataccaccggaaaattgtgttgacacagtctccaggcaccctgtctctgtcctccgagggganacacgccaccctctcctgcgacgggccaggtaggagtgtacagtaagtacgttaggctacggtaaccaacgaacgaaaccgtggaccaggcctcccgaggcctccgtactactccagtgatcgactactacccgaaacgtccgggtccctacgggcccgttaccccgaaggtaccggtaacggtttcccggtgggaccgtaaggttcggggtccgtaggggactaacggtacgttaccacttaccgtccaccgttacgacgtaccgtacggtccgtacgggacgtccgtagtacgttacgttaacgtttcgacgtttacgttttaccgtcttaacggttccgtacgtaccgtcggttcccgttacccgaccggtcccgtcccgtaccgtttacccggttaccgggtttcccgggggacccgggggttaccgtaacgggggtacgtaaacgggtaccgtacgggtaacggtaaccggttaacgtccggggttacggccggttaaccgtaccctaaccggtaacgtttcccgttaccggttaaccctttcgttacccgttcccccggttacccgg

SEQ ID NO: 112175 - DNA, 991 bp, Homo sapiens
  misc_feature: GYAE6OF02G7JW7.45.36.D03.1.454.CMB.1.raw
tcagacgcgatcgacacgaccggtgctcgatttagctgcgtcacgatctctcttggggagaactgctcagttaggacccagagggaaccatggaagccccagctcagcttctcttcctcctgctactctggctcccagactaccaccggtaaaattgtgttgacacagtctccaggcaccgtgtctctgtcctccgagggacgacacgtccaccctctcctagcgacgggccaggtaggagtcgtacaggttaacgtacgttaggcgtacggtaaccaacgtaacgtaaaccgtcggaccgaacggtccttaccccgacggtccttaccctacacgttaccctaagtcggaactccggacctaaccgtacccgaaaccggttaccggggttcccctccggggaccccgttaccccgaacgggtaacccggttaccgggtttacccgggtcgggacggttaacgggggttaccggggtttaccgacgggggttaaccgaaggttaccggtttaccaacccgttacccgtaccgtaacccggtagaccgggtacccgtaaccgggtcccgtacggggtacccgttaccggtaggttaccgttacggtttacgttttacccgggtcgtttttaaacccgttttccgtttaccggtttaaccggttacctacccggaaccggtttaccccggtttaccccggggtaaccccgtaccccccggggttaccggtacccccccggtttagggttttaacccccgggtttacccgggggtttacccggggggggaacccccgggggggggtttacggtaaaaccggggggggttaaccggttagggaacgggttacccggggtaacggggttaaaccccgggttaagggttccggggaccgggttaccgggttaaccccgtaaccggttacggttaccccgggttttaacttcccgggggtttaacccttttaccggtacccccggttttacccccggg

SEQ ID NO: 112176 - DNA, 728 bp, Homo sapiens
  misc_feature: GYAE6OF02HHXSU.45.36.D03.1.454.CMB.1.raw
  modified_base (197)..(197): a, c, t, g, unknown or other
  misc_feature (197)..(197): n is a, c, g, or t
  modified_base (505)..(505): a, c, t, g, unknown or other
  misc_feature (505)..(505): n is a, c, g, or t
tcagacgcgatcgacacgaccggtgctcgatttagctgcgtcacgatctctcttgggggaggaactgctcagttaggacccagagggaaccatggaagccccagctcagcttctcttcctctgctactctggctcccagactaccaacggaaaattgtgttgacatagtctcaggcacctgtctctgtctcgagganacacgccaccctctccgtcgcgacggccgaggtacggagttcgtacgtaagtaacgttacgtaggtacgtacgtaacgaacgaacgtaaccgtcgacgacgcctaccgacgtcctcctactctactagtacgcgtcgacacctaaccgtaacggtccggtaccggtccgtacccgtacccgacggtaccgtacgggttccggttcggtacgtacgggttacggggtcgttaaggggaccgtaagttacgttaccgtacctaccgtacccgtacgtacgacgtcgacggtccgtacgggctccgtagtntttaacgtgtttactacgtttaccgtttctacggttcacggtacacggtaccgttccctaccgtcccgtaccgtccggttccacgggtttccggtcgggggacccggtacggtagggaaccgtagttacggacgggtaacgtaaccggtaggttacgggcttaccggaccgtaacgtccttacggttaccgttccgtttaccggttatttcccccgttaaccg

SEQ ID NO: 112177 - DNA, 694 bp, Homo sapiens
  misc_feature: GYAE6OF02FPGE5.45.36.D03.1.454.CMB.1.raw
  modified_base (197)..(197): a, c, t, g, unknown or other
  misc_feature (197)..(197): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggacttgggctgacctgggtttcctcgttgctctttaagaggtgtccagtgtcaggtncagggtggtgggaggtcgggggggagtcgttgtccaggccgtggggacggtccctggacgaccttccgtcctggtacgctacggtccctgtacgggtatttcctccctacgtacgttacgtttcggttcctacgtcggtcccgcgtacggttcacgggtcgaaggggctgggaggtcgggtcggtccctgtacgttaccggaagtacgtaggaagtacggaagtacggtaccgtaacgtcgaacgtaccgttccggtaagggaaccgggccctacgtccaaccgtcctaccgtacgtaacgaagtacctaaacgttaccgaaacgttacgtcgttacccttcgttttacgactaaagtacgtaactaccggtcgtagtagtaggttacggacgtacgtacgtacgttcgttcgttacttacgtcgtcggacggtacggtactacgtactagtacggtagttaggttcggttacgtagtcgttaacgtaccttaacgg

SEQ ID NO: 112178 - DNA, 844 bp, Homo sapiens
  misc_feature: GYAE6OF02IYE41.45.36.D03.1.454.CMB.1.raw
  modified_base (163)..(163): a, c, t, g, unknown or other
  misc_feature (163)..(163): n is a, c, g, or t
  modified_base (468)..(468): a, c, t, g, unknown or other
  misc_feature (468)..(468): n is a, c, g, or t
tcagacgcgatcgacacgaccggtgctcgatttagctgcgtcacgatctctcttgggggaggaactgctcagttaggacccagagggaaccatggaagccccagctcagcttctcttcctctgctactctggctccagataccacggaaaattgtgttgacanagtctcaggcaccctgtctctgtcctccgagggagacacgccaccctctctagcagggccagtaggagtgactaagtaagtacgtaggtctaggtaaccaaacgtagtaaaaccgtggacccgaaggaccttaccccgaaggtcccttaccctaccgtaacttacccaattacgatacggactaaccgtacccgaaccggtacggtaccccgtcgggtaccgtaccccgaagacgtacgggtttcccgaggacccgtagggttcgggtaccgtgggacaggtacttccgactcgtaccaccgtanagtccgacgtccgtagggactcccgtaacgtagttacgttacgtttacgttacgtttaacgttttaccgttcgttaggtacccgttaacggtacgaaccggtttccccggttaaccccggtaccggaacccccgggttacccggttacccgtttaccccggggttaaaccgggggtttttccccgggggaaaccgggggggggttaaccccgggtaaaggggtttaccgggggtaaacggtaacgggtttacgggaaacgggtttaaccccgggaagggttcggggttaacccggccggtttaacggacccgttttaaccgaactttaccggggtttaccctttaacggtttacccccttaaccggttttccccgg

SEQ ID NO: 112179 - DNA, 738 bp, Homo sapiens
  misc_feature: GYAE6OF02GQ8UD.45.36.D03.1.454.CMB.1.raw
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgccagggccaggtaggagtgtcagtaagtactaggctggtaaccaagagaaacctggaccaggcctcccaggcctcctcatccatgatgcataccaacgtacgggtccctaggcccgtcccgagtaccgtacgggtttcccgtggaccgtagggttcgggtcgtggggactaggtacgttcacgttctacgaccgtcacgcgtacgcgtaggacgtcctagtactcgttattttcggcgtttaacgttttaccttcggttacgtactacggtaccgtaccgggttcccgtttacccgaccgtaccccggtacccggttaccgtttccccggttaccgggtttacccgggggggacccgggggggtaaaccgtacggggggttaacgggaacggtaacggttacgggaaccggtaacccgggttaacgggttcggggtaccgggtcccgttaccggaacccgtaaccggttacgtttcccggtttacggtttcccttaccgttacccgtttacccccgg

SEQ ID NO: 112180 - DNA, 793 bp, Homo sapiens
  misc_feature: GYAE6OF02IPKUU.45.36.D03.1.454.CMB.1.raw
  modified_base (755)..(755): a, c, t, g, unknown or other
  misc_feature (755)..(755): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctcggccccagactaccaacggaaaattgtgttagacactagtcctaccgaggccaccctgtctctcgtcctccgaggggacacacgccctaccctcctccgtacgcgacgggcctaaggtagggtacgttacggtaccgtaaggttaacgttaacgtaggtcgtacggtaacccaaacgaacgtaaacccgtcggacccgaacggtcccttaccccgaggtaccccttccgtacacgttacctaagttcgaacttccggactaaccgttacccggaaaaccggtccggggttcccccgtacggggtacccctaccccgaaggtacccggttccgggtttacccggacggtcggtaacgggttcgggtccgagggtaaccgtagttacgttaccgtacctaccgtccgaaccgtgacgcccgtaggtcccgtggacctactgtacttgtttaacgtttcacgtttagttttacctccgttagactacgaccgtccgttaccgttcccgcctacggtcccttactccggttacccggggtgggggacccggggtaacttggggaccgtaatcggtaccggtaagtacccggtaggttggaccgtaacggtcccgacctacggtttcncccggttttacaccgtctttacccggtccccttacccg

SEQ ID NO: 112181 - DNA, 799 bp, Homo sapiens
  misc_feature: GYAE6OF02FP87H.45.36.D03.1.454.CMB.1.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagactacccaaccggaaaaattgtgttgacacagtctccagcaccctgtctctgtctcgaggganacagcccacctcctcctgcgacgggcctagtagggtagtgtcgaagttaaacgttacttagggtctacggtaaccgaacgaacgaaaccgtccgggaccaacgggtccctacccgacgggtcccttccgtacctacgtaccagtacggtaactcgaccgtactaacccgaaccggtaccgggtccccgtaccgggtcccgttaccccgacggtaaccggtacgggtttcccgggtacggccggttaggggtccggtttacgggtacgggtacgtacggttacgttacctaaccgtccgtacccgtacccgtacggaccgtccgacggtccgtacggggtaccgtccgttaggtacgtttcggttagtttacgttaccggttacgttttaccgtttggtaccttaccggagtcccgtacgggttcccgttccggaacccgtccgtacccgttccgtacccggttccgggttacccgggggaccgggggtaacggtccgggagggtacgtacgggttacgacggaaccggttaggtggttccggtcggacgtacccgtaccgttagtcccgttacttccggttactaccgttacccccg

SEQ ID NO: 112182 - DNA, 777 bp, Homo sapiens
  misc_feature: GYAE6OF02IOYYU.45.36.D03.1.454.CMB.1.raw
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggtttttcctcggttgtcttcttttaaggaggttgtccgtagtgtcgtagggtgcgagggtgggtgggagggtcggggggagtcgttgtccgagccgtgggagtccctgacgactctcgtgtncgacgcctgtcggtacttcctcccgtanacgtttaacgttttcgggttacctaccggttcgggtcccggtccgtacggtttccgagggaccgggtaaggggtccgtagggagggttcgggtccggtccctagtaccgtttaccgaaagtacgtacggtaaagtacgaagggtaaccgtccttaacgtcgaacgtaaccgttccgggtagggtaaaccgggtcccggtacccttaccgtaacccgtaaccgttaccctaacccgaaggtaaccgtaaaccgtaaacgtttaaacccgaaaggttacttaccgtttcccttttacgttttagaaccttaaagtacgttaacgtacgtaccgtagacgtaggttcgaacgtacgtacgtcgttacgttctttacgttcgttggtaccgacgggtaaacggggctaagtacgttaagtcggtaagtttcggtttagggttacgttaggtaacgttaagttaccgtaaacc

SEQ ID NO: 112183 - DNA, 702 bp, Homo sapiens
  misc_feature: GYAE6OF02HJUX9.45.36.D03.1.454.CMB.1.raw
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccaccctctcctgcgagggccaggtaggagtcgtacagtaagtacttaggctggtaccaacagaaacctcggaccaggcctccaggctcctcatccatgatgctanaccaacgacgggtccctgggcctcccgagactacggttccgnggcaggtcgggttctgggggaacaggacgttacacttacctccgaaccggtccaaggtccacggtccctaggcgtccgtagatagttacgttttaggccgttaacggttttccttacgttcggttacgtaacggaccttacggtacccggtttacccggaccctaaccgggtacccttccgttacccgtaaccgggttttacccgggggaccgggggttaaacgggtaccgggttgaaccgggttaggtaaccgggtaacggttaaccgggtacggttacggttacggaaccggttcgaacggtacccttagtccgggttactttaccgtacttacccgttcccgg

SEQ ID NO: 112184 - DNA, 845 bp, Homo sapiens
  misc_feature: GYAE6OF02HUL27.45.36.D03.1.454.CMB.1.raw
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
  modified_base (370)..(370): a, c, t, g, unknown or other
  misc_feature (370)..(370): n is a, c, g, or t
tcagacgcgatcgacacgaccggtgctcgatttagctgcgtcacgatctctcgttggggagctctgggagacgagcccagcactggaagtcgccggtgtttcctttcggtgatcatcactggaacacgagaggactcaccagtggtacgtttgggctgtccgttagggttttccctcggttgccttagttttaaggagggttcgtcctaggtgttcgagggtcgacgtagggtgggtagggacggggtcgggggggagtccggttcgtaccgaggccgtggggacgtcccgtgtacgacctctcgtcgngccgagtccttcgtcggtacttccccncccttagtacggtttaccgttttccggtttaccncggttacggggtcccctcgtaccggttccgagggacccggagggtcgtaggggtggttaccggggtccgtcccctttacgtacgttaccggaaggtagttaccgggaagttacgtaaccgggacgtccccttaacggtaccgaacggtaccggtcccgggtaaagggtcccgggtacccgttacctttaccgaccctacgttacccgtccgtaaacggtaacgtaaacccgtagtaaacccgtaacgtaacggttccgttttaccgtttacgttttaaccggtaaccgttaaagtaaacgtaacgtaccggtacgttacggttaaaggttacggttaaggaccgtaaggttccgttagttccgtacgtttagttcgtacggtacggacccgggtagggtaaccttaggtaccgtagttaccgtagggttcgtttacgggttacgggttaacttacgttaaccttacgtaaacccg

SEQ ID NO: 112185 - DNA, 714 bp, Homo sapiens
  misc_feature: GYAE6OF02GQCMD.45.36.D03.1.454.CMB.1.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggagaaattgtcttgacacagtctccagccattctgtctctctctccgagggganacagccaccctctcatgcacgggccagtcagagtattagaacatacttggcctggtatcaatacaacgcctggccacgggtcccccggctccctctactctatgatcgtcttccgagcgcgggccacgtcggacacctacccgacgtccgtaggttccgagggtcggggtccgggtttggggtttccgacgtaacgtacggtacctttccgaaccttcctacgaacctaactccgaagtccctaacgtcccctaacccgtaacctaggtaaacgtttacttttacgacttacggttaaccttacgttttaccgtaggtaacctaacggtaacgtacggttaacgtaacggttaccgttaccgggtcctcccgttaaccggttaccggtttcccgggggaccggggtaaccggggtaacccggttaaagggggtaccgggtaacgtaaacgttaacccggaaaacgttcggtacgggttccggtaccggtacgtacccgtaaccgtttacgg

SEQ ID NO: 112186 - DNA, 814 bp, Homo sapiens
  misc_feature: GYAE6OF02GPRB7.45.36.D03.1.454.CMB.1.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggcctcccagactaccaaccggtaaaattgtgttgacacagtctccaggcaccctgtctctgtctccgaggganacacgccacctctcctgcgacggccaggtacggngtcgtacgtagtaacgtacgttaggcgttacggtaaccaaacgaacgtaaaacccgtggtacccgacggtcctaccccgacggtccttcctccgtaaccttacccgaagtacgtagttccgaccgtaactacccgtaaaccggtaccggggttcccgttaggttcccgtaccccgtaaggtacccggttaacgggttcccgggtagggtaccgttacggggttcgggtaccggttacggggaacgtaacggttacgttaccgtaacctaccgttcctaaccggtaccgaacggtaccgtaaccgtcccgggtaaagggaccgttccgttaaaggtaccgttggttttaaaccgtttcggaaacctttttacgttaccgtttcgttacggtcccgttaacgtcgtccccgttccgtccccgtaccgacccgggtccgttaccttaccggttccggggttacggggggcccggttaccggtaggggtgggtaacctagggcgtaacggaccggttacggtgggtcccggtatccggactaccgtcttacggttccttcgttaaccgccgtttaacccg

SEQ ID NO: 112187 - DNA, 754 bp, Homo sapiens
  misc_feature: GYAE6OF02IHPQF.45.36.D03.1.454.CMB.1.raw
  modified_base (527)..(527): a, c, t, g, unknown or other
  misc_feature (527)..(527): n is a, c, g, or t
  modified_base (566)..(566): a, c, t, g, unknown or other
  misc_feature (566)..(566): n is a, c, g, or t
tcagacgcgatcgacacgaccggtgctcgatttagctgcgtcacgatctctcgttgggggaggaactgctcagttaggacccagagggaaccatggaagccccagctcagcttctcttcctcctgctactcgtggctcccagataccaaccggaaaattgtgttgacacagtctcaggcaccctgtctctgtctcgagggaacagccaccctctccgtgcgacggccagtaggtacgtgtacaaggttaacgttacgttacggccgttacggtaaccaaacgtacggtaaaacctcggaccgaaggtcccttaccgacggtcctacccgtacctacgttacccgagttacggtaacttccggacctaaccgtacccgaaaccggtaccggttcccggtcggtacccgtacccgtaaggtaccggtaccggttaccggtcggacgtcggtcgggtacgtcgggaactaggtacttcgaccttccgtacgacccggtactcgtacgtaccgtcgtagggccgtaccgtntaaagtcgttcgtttacgactttaaccgtttcggttacncgggtactacgtctaccgggttctacccggacctcgtaccgtcttaccggtacccgggtttcgggggaacccgggacgttaggggtacgagttcgtaacgggaccgttacggttaccgtcggtgggtaacctccgaccgttaagtcgttaccggttccgttaaccgttcttacccggttccctaccgg

SEQ ID NO: 112188 - DNA, 831 bp, Homo sapiens
  misc_feature: GYAE6OF02HQDGV.45.36.D03.1.454.CMB.1.raw
tcagacgcgatcgacacgaccggtgctcgatttagctgcgtcacgatctctcttgggttttgggggaagaggaagactgacggtcctcccaggagttcaggtgctgggcaccttgggcacgggggagcgttgtccagccgtgggaggtccctgacgactctcctgtgcacgcctctggacttcctccctcaagttactttcggtttccacgtcgggtccgtacctaggttccaggaccgaagggggtctagggtaggttcgggggttacgggtccccttcgtaacgttttcccgaaaggtacgttagggaaggttgacggtaaacggtccctaccgtacaaggtaccgtaccggtaggtaaccggggcccgttcttaacccgtaccgacttcctaccgacgacgtaactaaacttccgaaagtacttacgttaccgtttctttttacgaactaattacgtaatcgtaccgtaggtacgttagtcggaacggtactacggttcttacggttacttaacgttttcgtaaggtcggacggtaacggggtcttacgtacgtagtacgtcggttacgttgggtttacggtagttacggtaaaccttacgtaaaccgtacctaccgttacccttagacgttacggtccggtacggttacgggtaacgaaccgggtacccgtttaccggacccggttaccgtcccgtacccgtacggaccgttaccctacccggaaccggtacccggaccttaccggtttacccggtccccgtttaccggtccggtccccgtccgtacgtaccgtacccggacggtacgtacccgtaccgttccgggg

SEQ ID NO: 112189 - DNA, 731 bp, Homo sapiens
  misc_feature: GYAE6OF02F64GW.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaccggaaaattgtgttgacacagtctccagcaccctgtctctgtctcgagggganacacgccacctctcctgcgacggccgagtaggagtgtacagtaagtacttaggctaggtaccaagaacgaacgtcggcaggcctccgagtcctctcactccagtgacgtcgaccactaccgaacgtaccgggtcccgtcggcccgtaccgacgtaaccgtgggttccgcggtacgtagggtcggggtacgtagggaacgtaggttacgttccgacgttccgtaccgaccggttcgacggtcgtacggtccggtaggacctccggtagtacgtttgttaacgttttcggaactttacgttttacctcggttacgttccgaacggtccgtaccggttcccgttcccggcccgttaacgggcccctttagtttaccccgggtaccggggtttcggggggaacccgggggtaacgacgggggttaacgacgtaacggttacgggaacgggttacgtaaccgggtggttaacggtcccgtaggtccctaacggtctttaccggttacctttaccttcggtaaccccctttcccgg

SEQ ID NO: 112190 - DNA, 838 bp, Homo sapiens
  misc_feature: GYAE6OF02IFNYV.45.36.D03.1.454.CMB.1.raw
  modified_base (447)..(447): a, c, t, g, unknown or other
  misc_feature (447)..(447): n is a, c, g, or t
tcagacgcgatcgacacgaccggtgctcgatttagctgcgtcacgatctctcttgggggggaggaactgctcagttaggacccagagggaaccatggaagccccagctcagcttctcttcctcctgctactctggctcccagataccaaccggaaaaattgtgttgacacagtctccaggcacctgtctctgtctccgaggggacacacgcccaccctctccctgccgacgggccaggtaggagtcgtacgtaaggtaacgttacgttagggactacggtaaccaaacaacggaaaccgtcggacctacgggcctcccgaacgggtcccttaccctaccgacttcccgagttcgaacgttcggaccaacctacccgaaaccgaccggggttccccgtaccggtacccggttaccccgaacggaaccggtttaacggggttacccggnggggtaccggtacggggttacggggttaccgtacgggggtaacaaccgggttacgttccgtaaccgttcccgtaacctaccgggttacccagggtacccgtaaccggtcccggttaaggggacccgtacccggtttaggagtttacggtttaacgttttcggtaaccggtttaacggttttttaccctacgtttacggaccttaacgggtcgttacccgtcccggttaacccgcccgttaaccggtccccgtctttaccgggtaacgggtttcccgggggaccggggtaacggtacggggtagtaggtagtacggggaaaccgtctaacgggttgtacggccttcggaaccgtacgtacgttccttggttcccttccggtacttcccccgg

SEQ ID NO: 112191 - DNA, 880 bp, Homo sapiens
  misc_feature: GYAE6OF02GX76E.45.36.D03.1.454.CMB.1.raw
  modified_base (216)..(216): a, c, t, g, unknown or other
  misc_feature (216)..(216): n is a, c, g, or t
tcagacgcgatcgacacgaccggtgctcgatttagctgcgtcacgatctctcgttgggggaggaactgctcagttacggaccagagggaacatggaagccccagctcagcttctcttcctctgctactgtcgctcccagactaccgaaccggtaaaattgtgttgaacacagtctccgaggccacccgtgtcctctcgtctaccggagggacgacncgcccacctctcgtcgacgacggccaaggtaggtagtcgtactaggtaacggtactaggcgtacggtaacacgtaacgaacgtggaccagtcctaccgcgtactactccgatccgagtcgtactcgacctactaccgaaacggtccggttccgtacggacccgtaccgtaacggtaacttccggggtacgtaccgtcggttaacggtcggggttacggtcggtaactacggttactacgtaaccgtccgtttaaaccgaccttagggaccgtaccgtacggtaccggttacggtaccgtacgtacggttacgttacggttaccgttacgttacgttacggttttaaccggttcgttacccggtacggttaccgtaaccgttacccggttccttaacccgggtacccgttaacccgggtaccccgtttccggttaaccccggtttaccggggttaccgggggtaacccgggggttaaccgggttaaacgggttaccgggtttaaacgggttaccgggtaaccggttaaccgggtaaaccggttaacccgggtttacgggttaacccggtccggttaaacggccccggtttaaaaccgtttaaccgggtttcccgttaaccgggtttttaaccggtttacccggttaacccgtttttacccccggg

SEQ ID NO: 112192 - DNA, 814 bp, Homo sapiens
  misc_feature: GYAE6OF02FIJM8.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagccacctctcctgcacgggccagtaggatgtcaagtaagtacttaggctggtaaccaacgacgaaacctggccaggtcctaccccgaggtcctcccgtcaactccatgatcgacatcccgaacgtacggggtcccctggccgttaccccgaggtaccgtacgggttcccgtaggcctaggggttcgggtccgtaggggaactacgggtacggtttcccaaccgtttccgtacgtaacccggttcgaaaccggtaccgtaacggtacccgttggggaaccgtcccggttaaggtaacggtttacggtaacggttttttaccggtaaccgtttaacgggttttaaccttttccggttacggtttaccgtaacggtccggttaacgttcccggttttacccggacccgttaaccggtccccggtacccgttaccggttaacccggttttccggggggacccgggggggtttaacccgaacgggggtttacgggaacggtacggttacgggaaccggtaaccgggtaaccggttcggttaccggggtaccgtacggtaacccgtaccgtacgtttcccgttacgtttccgttaccgttacgtttacccccg

SEQ ID NO: 112193 - DNA, 794 bp, Homo sapiens
  misc_feature: GYAE6OF02IEGRE.45.36.D03.1.454.CMB.1.raw
  modified_base (206)..(206): a, c, t, g, unknown or other
  misc_feature (206)..(206): n is a, c, g, or t
  modified_base (291)..(291): a, c, t, g, unknown or other
  misc_feature (291)..(291): n is a, c, g, or t
tcagacgcgatcgacacgaccggtgctcgatttagctgcgtcacgatctctcttggggagctctgggagacgagcccagcactggaagtcgccggtgtttccctttcggtgatcatcactgaacacagaggactcaccagtggtacgtttgggctgaccgttgggttttcctcgttgtcttacgtttagaggtgtccgagtgtcgnggtgcgtagggtggtgggaggtcgggggagtcggttcgtccacggccgtggggtaggtcccgtaggtacgcgtctccgtgtcgcncgtcctcgtggtacttccgtcctacgtacgttacgttttccggttcctccggttccgggtcccgtaccggttaccggttccggacgggtaacggtaacggggtcgtaggggtcggggttcgggtacccgtcccgttacgtaccgtttaacggaacgttaggttaggaagttaccgggaacggtaccgtccgtaactacgtacgtacgtccggtaggaccgggttcccgtactccgaacctacgttacccgtacggtaacgtaacgtaacctagtaacccgtaaagttacgttccgtttacgtttacgtttacggaacttaaacgttaagtaaacgttaccgtaccggttaagtacgttacggtacgtaacggaacttccgttacttcgttacgtttaagtttcgtaacggttccggaaccggtacgggaattacgttaccgtgtaacggttcggttcggtttacggtaccggtttaagtttacggttacgtaacccgttaacg

SEQ ID NO: 112194 - DNA, 839 bp, Homo sapiens
  misc_feature: GYAE6OF02JNJ2P.45.36.D03.1.454.CMB.1.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (250)..(250): a, c, t, g, unknown or other
  misc_feature (250)..(250): n is a, c, g, or t
  modified_base (602)..(602): a, c, t, g, unknown or other
  misc_feature (602)..(602): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagactaccaaccggtaaaattgtagttgacacagtctaccaggccacctgtctntgtcctcgaggganacgtacgcccacctctacctgacgacgggtccaggtaggacgtntacacgttaagtcgttacggcgtacggtaaccaacgtaacgaaaccgtcggaccgaacggtccctaccgcggtcccttacctccgaacttccgaattgactaggacctaccctaaccgtaacgcgggtacctacggtccctaaccgtacggtacgtacggttcccggacggtaccgtggggtacgggttcggacggtacgtacggtacgttacccgtcgtaacgtcccgaacgttccgacgtaccgtaccggtcggtacgggtaccttacgggtacggtagttcgggtttaacttccgttaacggttacccgttactttaacgttacggtaccgggttaactaaacccgggngtttacccgtaaaccgggtagttacccggggtacccgtacccgttacgttaacccggttaccgggtttacccggggaaacgggttaaacccggaaccggggtttaagggtaacgggtcgttaaaaccgggttaaaccgtaaaaccgggttcgggtttacgtacccgggttacgtacctaacccggttacgggttaacctttacgggttacccggtttacccctacggtttacccccg

SEQ ID NO: 112195 - DNA, 784 bp, Homo sapiens
  misc_feature: GYAE6OF02HFI30.45.36.D03.1.454.CMB.1.raw
  modified_base (199)..(199): a, c, t, g, unknown or other
  misc_feature (199)..(199): n is a, c, g, or t
  modified_base (373)..(373): a, c, t, g, unknown or other
  misc_feature (373)..(373): n is a, c, g, or t
tcagacgcgatcgacacgaccggtgctcgatttagctgcgtcacgatctctcttgggggaggaactgctcagttaggaccagagggaaccatggaagcccagctcagcttctcttcctcctgctactctggctccagactaccaacggaaaattgtgtagacacagtctccaggccacctgtctctgtctcgagggganacacgccaccctctcctgcgacgggccaggtacggagtcgtctaaggtaacgttacgttacggctacggtaaccaaacgaagtaaaccgtcggaccgaacggacctacccgaaggtccctcctacgactccgatacgaactcgacctactacccgaaacgtccggggtttcccncgggtacccggtacctaagggtaccgtaacgggggtttccagggtacgtacggggttcgggttaccgtgggtaacgtaaggtcgttaccacgttccgtaccgaccggttaccaggtcccgtaacggtcccgtaaggaccggtaccgtaggtacgttaagtttacgtttacggtacgtttaacggttttaccttcgttacggtttacgtaccggtacgttaaccggttcccgttccgaacccgtacccggtacccgttaccgttaccggttaccggggttcccgggggaacggggggtacccgtttaacgggggagtaacggtacgggtacgggtaaacgtaccgggtaacgtcgggtaacggtcgaccgtcgtaaccgtcgttaccgttcgtactttacgacgttaccccg

SEQ ID NO: 112196 - DNA, 776 bp, Homo sapiens
  misc_feature: GYAE6OF02FWJCZ.45.36.D03.1.454.CMB.1.raw
tcagacgcgatcgacacgaccggtgctcgatttagctgcgtcacgatctctcttgggggaggaactgctcagttaggacccagacggaaccatggaagccccagcgcagcttctcttcctcctgctactctggcccccagataccaccggaaaaattgtgttgacacagtctccaaggcaccctgtctctgtctccgaggggtagaccagcccaccctctcctgcagggccagtaggacgtgtacagtaagtacttaggctcggtaccaacacgaacctggaccacggctccgagctcctcactccatgatcgtacactacccacgtaccgggtccacggccttacccacgaccgtacgggtttccgtggaccggtaggttcgggtcgtacggggacctaagggtccgttacaccgttccgtaccgtaccggtaccgacggtacccaacggtcccggttagggtaaccgtccggttacgtaacgttacggtttaacgtttttcgaccggtttacgtttttaccgttacgtttcggttaaccgtacgttacggtacccggttaccgggtttccccgacccgtaacccggtcccgtaccgtttacccggttccgggtttaccgggggtaccgggggtaccggttaacgggggtacggtaacggtcggtaacggcgggtaaaccggtacggttaacggggttccggtacggtccggtaaccgtaaccgttacggttcgtttaccggttccttaccggttaccttcccggttaaccccgg

SEQ ID NO: 112197 - DNA, 700 bp, Homo sapiens
  misc_feature: GYAE6OF02HGI5A.45.36.D03.1.454.CMB.1.raw
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggganacagccaccctctccngcagggccaggtacggagtcgtacaggtaacgtacgttaggcttagggtaccaaacgaacgaaacctggaccaggcctacccgaggacctcctacgacttccaagtgaacttcggacctaactacccgaaactcgtcggttccccgtggacccgtacccgaggaaccgtacgggtttccgtagggaccgtaggttcggggttacgtagggaaccaggtacgttaccgacttctaccgaaccgtcgaacgacgtacgccgttagggacgtccgtaggacttgttaacgtttcggtacttaacgttttacttcgttcgtaccgagcgtacgtccgtttaacccgctaccggccgtccttcgtaacgggtttccgggggaccgggggacggtaaggggtcggaagtacgtacggaacggaaccggtacgttcgggtacgacgttaccggacctacggtacttccggttacgttacttaccgtaccg

SEQ ID NO: 112198 - DNA, 705 bp, Homo sapiens
  misc_feature: GYAE6OF02GK5YP.45.36.D03.1.454.CMB.1.raw
  modified_base (131)..(131): a, c, t, g, unknown or other
  misc_feature (131)..(131): n is a, c, g, or t
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (499)..(499): a, c, t, g, unknown or other
  misc_feature (499)..(499): n is a, c, g, or t
tcagacgcgatcgacacgaccggtgctcgatttagctgcgtcacgatctctcttggggagaactgctcagttaggacccagagggaaccatggaacgccccagctcagcttctccttcctccctgctactntggctcccagatacccgaaccggtaaaattggtgttagacacagtctccaggcacctgctctgctccagggacacagccacccttcncctgcacgggccagtaggacgtntcgtaagtaaagttaccttaaggcctaggtaacccaacaacggaaaccgtcggaccgaggactaccccgaggccttactacactacccaagtcgactggacctactaccgtaaaaccgcgggtacctcgggtaccgacccgtagaccgtaacgggtttcgtcgggactgggtacggggtcgtaaggggtaacgacgtaaggttccactcgttacccgaccgtacgaccgcacggtcgtacggacgtaccgtgtaacgngttacgttacgtacgtacgtttacttacgtcgttacgacgtacgcgtaccgttccgaccgttaccggccgaccttacggtcccggttaccggggaccggggtaccgggtagggtaacggagtacgtacggagtaccgtaaggtaccgacggtcgtaccggtaactaccggtaacgttccgtacgttccgttacgtacccgtacccg

SEQ ID NO: 112199 - DNA, 720 bp, Homo sapiens
  misc_feature: GYAE6OF02GMKBI.45.36.D03.1.454.CMB.1.raw
  modified_base (239)..(239): a, c, t, g, unknown or other
  misc_feature (239)..(239): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggcctcccagataccaaccggaaaaattgtgttgacacagtctccaggcaccctgtctctgtctccgagggacacacgcccacctctcctgcgacggccaggtacggngcgtacagtaagtacgtaggctacggtaaccaacaacgaacctgccacgcctccgaggtcctcctcatccatcgatcgactacacccaacggtaccggtcccgtcggaccgtacccacgtaccgtaccggttccgacgggcgtacgggtcgggtacggtcgggactaggtcgttaccagttccgtaccgtacccggtcgacgtaccgtacgtcccgtaggtaccgtcgtgtacgttggttactttcgtacgtttaacgtttcgttcggttcgtaccgtcgtacgtacggtcccgtaccgtaccgtcccgtaccgttcccgtccgttaacccggggttccgggggtaccggggggtacggttacggggtacggtaagggtacgtacgggaacggtacggttaaccggttcggggtccgtacgaccggtaccgttacgttaacggttccgttaccgttaccgttaccgttacgttccccccgg

SEQ ID NO: 112200 - DNA, 691 bp, Homo sapiens
  misc_feature: GYAE6OF02JYGBO.45.36.D03.1.454.CMB.1.raw
  modified_base (322)..(322): a, c, t, g, unknown or other
  misc_feature (322)..(322): n is a, c, g, or t
  modified_base (452)..(452): a, c, t, g, unknown or other
  misc_feature (452)..(452): n is a, c, g, or t
  modified_base (645)..(645): a, c, t, g, unknown or other
  misc_feature (645)..(645): n is a, c, g, or t
  modified_base (669)..(669): a, c, t, g, unknown or other
  misc_feature (669)..(669): n is a, c, g, or t
tcagacgcgatcgacacgaccggtgctcgatttagctgcgtcacgatctctcttgggggaggaactgctcagttaggacccagagggaaccatggaagccccagctcagctctcttcctctgctactctggctcccagataccaaccggaaaattgtgttgacacagtctccaggccaccctgtctctgtctccgaggggagacacgcccacccctctcccgtagccgaggcccgtaggtaggacgtgtcgaagttacgtacgtaggcttaggaaccacaaggaacctcggaccagggtcctaccgacggtacctcccgtanactacctagtctacgtctcaactacccgaaacggtcgggttcctccgggaccgtcctaacggaccgttacggcgttacggcggaagggttcggtccggtggaccgtagtacgtcacgtctacgacctgancgacgcgtgaccgtcctaggtacgtgttacttgtacttaacgttttccgtcgttcgtcggacgttacgccgttccgtaacccgggccctaccgggtaccctcccgtttacgtcccggggttcgggaacccgggggttagtacccggggagttaccgggagttacggacgtaaggcggttacggtcggggaccnggtaccgcgtacgttacccggttnttaccgttccgtcccgtcccgg

SEQ ID NO: 112201 - DNA, 1049 bp, Homo sapiens
  misc_feature: GYAE6OF02I439V.45.36.D03.1.454.CMB.1.raw
  modified_base (221)..(221): a, c, t, g, unknown or other
  misc_feature (221)..(221): n is a, c, g, or t
tcagacgcgatcgacacgaccggtgctcgatttagctgcgtcacgatctctcttgggttttggggggaagaggaagactgacggtcctcccaggagttcaggtgctgggcaccgttgggcgacgggggagcgttgtccagcctgggacggtcctgagactctcctgtgcagcctctggtattctccctcagttaacttttggtttccacgttcggggtccnccgtaggtttcccagggccgaagggggtccgttgggaggttcggggtcggccccgttactacgttttacccggaaaggtacgttagggaacggttggaaggaacgggtcccttaccgtacgacgtacccgttcggtacggaacggggtccccgttacgtttcccgaacctacgttaccctacccgtaacggtaaaccgaaccttaaaccgtttaaccgtaaaacggtaaaacgttttccggtttaccccttttacggtttttttacgaaccgttaaaaacgttaccgggtaaaacttaaccggttacccgttagggtaaacggttacggttttaagggaaacgggtaacccggttaaccggttaccgtttaccggtttaacccggttttaactttttccgggtttacggttccggggttaacccgggtaaaggggggtacctaacggtttacgttacgtaacgggttaccgggtttaccggtttacgggtttaaccggtttaaggttacggtttaaaccgttaacccttaaacccgttaaccctttaaccgtttaaacctaaccgttacgttaccggggtaaccgttacccggggttacgggtaaacccggtaaaaaccgggtcccggttaaccgggttacccgtaacccggttccgttaacccggtacccgtaacccggtcccgttaaccccgtaaccccgggaccgggtaccccgttaacggtttccccgggtttaccccgttcccccgggtaccgggtcccgttacccggtccgttacccgggtacccgtaacggtccggtacccgttaacccgggttccggggg

SEQ ID NO: 112202 - DNA, 706 bp, Homo sapiens
  misc_feature: GYAE6OF02FNCNY.45.36.D03.1.454.CMB.1.raw
  modified_base (204)..(204): a, c, t, g, unknown or other
  misc_feature (204)..(204): n is a, c, g, or t
  modified_base (313)..(313): a, c, t, g, unknown or other
  misc_feature (313)..(313): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccaggccaccctgtctctgtctccgagggganacgacgccaccctctcctgcgacgggccagtcgagggtgtaacagctactacgcctaggtaaccaacaaaacctggaccagctacccgaggcctcatcatctatcgacncactcgaacgcgggaccacgtcggcactacccgagtaccacggttcgaggtcggcgtagggtcgggtacgtacggggaacgtacgtacggttccaccttccgtaccgtacccgtacgacgtcgacggtccgtacgggacgtacccgttaggaatttcggtttaacttttacggttacgtttttaccttacggtcgtttacgacgtcgtaccggtcccggttccgtccgtacccgtcgtacccgttccgtaccggggtttccgggggaccgggggttaccggtagggggtacgggtaccgtagggtcggaaccggtaacgggaaccggtttggggaccggtacggtacggtaccctaccgttaccggtacgtttccgttaccttcgttaccccg

SEQ ID NO: 112203 - DNA, 884 bp, Homo sapiens
  misc_feature: GYAE6OF02HX20J.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacaggaggactcaccatggactttgggctgaccttgggttttcctcgtttgcttcttttaaggaggttcgtcctagtgtcaggtgcgagggtggtggacggtcggggggagtcgttgtccgagccgtaggggacgtcccgtgagcctccgtccgtggtacgcacgtccgttcgtaggtactttcccgtcccttacgtaacgtttaaccgtttttcggtttacccgtacggttaccggggtcccgtccgtacgggtttcccggaaggggtaccggaacgggggtccggtaggggtacgggtttccgggggtaccggtaccccccgttacggttaaccgttttacccgggaaaggttacggttacgggaaggttaacggaacgggtaaccggtaccctaacggttacgaaccggtaccgttacccgggtacggaaccggggtccccgtaccgtttaccgacccgtactcccgtaaccgaacggtaacgtaaccgtaaacgttaccgtaaaggtactttaccgtttacccttttaccgttttagaaaccgttaaagttacgtaacgtaaccggtaccgtaaggtaaccgttaggttacggaacggttaccgtacggtttaccgttacgtttacgtttacgtttcgttacggttacgggtaccggtaacgggggtaccttaacggttacgttacgttacggtaggtttacggttacgggtttaccggtttacggttaacgtttaaccggttaacccgttaaaccg

SEQ ID NO: 112204 - DNA, 789 bp, Homo sapiens
  misc_feature: GYAE6OF02JM0F8.45.36.D03.1.454.CMB.1.raw
  modified_base (173)..(173): a, c, t, g, unknown or other
  misc_feature (173)..(173): n is a, c, g, or t
  modified_base (180)..(180): a, c, t, g, unknown or other
  misc_feature (180)..(180): n is a, c, g, or t
tcagacgcgatcgacacgaccggtgctcgatttagctgcgtcacgatctctcttgggagctctgggagacgagcccagcactggaagtcgccggtgtttccttcggtgatcatcactgaacacagaggactcaccatggactttgggctgacctgggttttcctcgttgcttntttaagnggtgtccgagtgtcgaggtgcgaggtggtgggaggtcgggggggagtcggttgtccgaggccgttggggacgggttcccctggacgaccgttccgtccgtggtcgtccgaggcccttacgtcgggtaactttccgtcccgtacgtacggtttaaaccgttttcggtttcccgaaccgttcggggtaccccgtccgtacgggtttccgacgggtacgaacgggggtccttagggacggttggggtccggtcccgtcgtacgtttacccggaagtcggttacggtaaggtacggtaacggaacggtaccttaccgtcgagtaccgttccggtagggaacggcccgtacttaccgaccgtaagtccctaccgagaaccgtacttaacgtccgaaagtaacgtctaccgtttcgttttacgacgtaaatcgtaagttacgacccgttagaacgtaggtttagaccccgtaaagttccgtacgttacgtaccgtttaactttcgtacggttacggtacccggtaagggggtacctaacgtttaccttagttaaccgggtcgtttcgttaccggggtttaccgtagggtttaacggtaccgttacttaaacccgg

SEQ ID NO: 112205 - DNA, 796 bp, Homo sapiens
  misc_feature: GYAE6OF02H42GE.45.36.D03.1.454.CMB.1.raw
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (331)..(331): a, c, t, g, unknown or other
  misc_feature (331)..(331): n is a, c, g, or t
tcagacgcgatcgacacgaccggtgctcgatttagctgcgtcacgatctctcgttgggggggaggaactgctcagttaggaccagagggaaccatggaagccccagctcagcatctcttcctcctgctactctggcctccagactaaccgaaccggtaaaattgtgttacgacactagtctccgaggccacccgtgttctctcgtctccggagggganacncgcctacctcgtctgcgtacggctaggtacggtagtccgtagtaacggtaacgttacggtacggtactacggtaaccaacgtaacgtaaccgcggacacggtcctaccgngtcctcgtacacgtaccagttacgacgtactaccgtaaccgtacccggtaacggttaccggtcccggtccgggtaacccgtcccggtaacggttaaccgggtccggtttacggacggtcccggttaaggggtccgggtacgtacgggacgttaacgggtccttccgaacgtttcccggtaccgtcggtaacgtcgaccggtacgtccgggttaaggccggttccgagttaacggttgttaacggtttcgacgttttacttagttccgttaggacctgggtactacggtcccggttaacgcccgttaaccggcccgtttaccggtaccggtttaccgggggtccgggggtaccggggtaacggtcggggtagttaccgggcgttaacggaccgacgggtttaacgcgggtaaccgtccgtacgttaccgacggttacgttcgtttacgtccgttgtttaaccccgg

SEQ ID NO: 112206 - DNA, 770 bp, Homo sapiens
  misc_feature: GYAE6OF02G50P6.45.36.D03.1.454.CMB.1.raw
  modified_base (209)..(209): a, c, t, g, unknown or other
  misc_feature (209)..(209): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagaaaccattggagaaatactgatgacgctagtttccacgccaccctgtcctgtcgtctccgaggggaaancgcccaccctctcctgcgtcgggccagtcgagtagtgttacgaccaacctacgttacgccgtaggtaccagcaacgtaaaccgtcggaccacggccctacccagaccttcctacttacttttacgttcggtttcctttaccgtacccggtacgggtcccgtcgttcggttaacctccccgacggtcccgtaggtttccgaggttccgaccgtagggtcggggtacgtacggggactacggtacgttcctaccgttccgtacccaaccgtacgtacgacggtacctacggtcccgttggacccgtaacggttacgtaacgggtaagtacgggttacggggtacgttaccgtttaaggttttacgtttcggtcgttacgttacgtaacgttaacttaaagtttaattttaaccgttacttttaccggttttaccccgttaccgtttaccgggttttcccgggtacccgtaacgggtaacctaaagggttcgtaacttaacgtaaccggtaaacgttacgtcggtcgtacgttaccactaacctgtaccgttatacccgttacc

SEQ ID NO: 112207 - DNA, 903 bp, Homo sapiens
  misc_feature: GYAE6OF02IGXIQ.45.36.D03.1.454.CMB.1.raw
tcagacgcgatcgacacgaccggtgctcgatttagctgcgtcacgatctctcttggggggaggaactgctcagttaggacccagagggaaccatggaagccccagctcagcttctcttcctcctgctactctcggcccccagactaccaccggagaaattgtgttgacacagtctccagccaccctgtctctgtcctcgagggagacacgccctacccgtctccgtagcgtacgggcctaggtagggacgttcgtacgtaaggttaacggttaacgttagggtaccgttacggtaaacctaaaaccgaacgtaaaacccgtacgggtaacccgacggtacccgtaccccgtaaggtaccttactacgtacctattaccttacgtaccggacctacgtaaccgttaacgaaccgtaccgggacctaccggtacgggtacctaacccggtaccccgtaacggtacccggtaacgggtttaccggaacgggttacgggacccggttaggggttaccggggttaacggtacgggggtaaactaccggggttaaccgtttacccggaacccgttacccgtaccgtaacccggttacgaaccgtccgtaaccggtccggttacggaaacccggtcgttacggtaagttcgttaacggttttcggtaccgtttaacggttttcttaccggtaccgttcgtaacggtacggttaaccggttcccgtaccggccccgtaccgggttacccgacggtttaccggttacccgggtttaccgggggtacccgggggtaaccggtacggggttacgggacggttaccggtaacgggtaaccgggtaacggtaccggttagggtcccgggtacgtaccgtaccggttaccgtacggtttcccgtacgtttaaccccg

SEQ ID NO: 112208 - DNA, 696 bp, Homo sapiens
  misc_feature: GYAE6OF02GC14Y.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagaaaccattggagaaatactgatgacgcagtttccagccaccctgtctgtgtctccgaggggaaagacgccaccctctcctgctgggccagtcagagttgttagcaacccacttacgcctaggtaccagcaacgaaacctgggaccaggcctcccagacctcctactattttagtcggtttcttcgtaccgacgggtccgtcgtaggtactcccgagccgtaaggttcgaaggtcgacgtagggtgggtcgtaggggacaggtagttacacgttctaccgacctataccagccgtaacgcccgtacggacgtacgttcgtaggtaacgttacgttttagacgtttaaggtttttacttttcgtagttctaggtacgtacgttatacctaacgttaaccgtggttaccgttacgttacggtttaggttttccgggacggtaaccggggtaaccaacgggtacgtaacgggtaaacttaccggaaaaccggtaacgttacgggttcggtaccgttacggacccgtaaccgttacgtccgttacggttccctttacccgg

SEQ ID NO: 112209 - DNA, 776 bp, Homo sapiens
  misc_feature: GYAE6OF02I1ED7.45.36.D03.1.454.CMB.1.raw
  modified_base (97)..(97): a, c, t, g, unknown or other
  misc_feature (97)..(97): n is a, c, g, or t
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
tcagacgcgatcgacacgaccggtgctcgatttagctgcgtcacgatctctcttggggaggaactgctcagttaggacccagagggaaccatggaanccccagctcagcttctcttcctcctgctactctgctccagataccaccggaaaattgtgttgacacagtctccaggcacctgtctctgtctcgaggganacacgcccacctctccngacacggccagtaggagtcgtcaagttaacgtacgttacggcttacggtaaccaaacgacgtaaaacccgtggacctaacggtcctaccccgaggtaccttccctagaccttccgattaggaactcgacctactaacccgaacgtccggttaccccgtcggtacccgaccgtacgaccgttacggttccggtacggaacgttcggggttcgggtacgttcgggaccgtaaacggttcgtttacccgaacgttccgttacccgacccgtttacgaaccgtccggtaaccggtaccgtaccgggtaccgtacccgttacgtacgttacgtttaccgtttacggttacgttaacgtttaccgttacgtttcggtaccgtacgtaccgtcgttaccggttacccgtacccggtaccgtacccgtcgttacccgttaccgggttccccggggaccgggggttaaccggtacgggtacggaacggttacgacggtaacggtaccggtaacgtacggtacgtaccgtcgtaccgtacgtcttaccgtccgtacttccgtccgttaccccg

SEQ ID NO: 112210 - DNA, 715 bp, Homo sapiens
  misc_feature: GYAE6OF02GCW37.45.36.D03.1.454.CMB.1.raw
  modified_base (451)..(451): a, c, t, g, unknown or other
  misc_feature (451)..(451): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccgaggcaccctgtctctgtctccaggggagacagccacctctcctgccagggccagtaggagtgactaagtaagtacttaggctaggtaccaacgaacgaaacctggaccaggtcctcccgaggtcctaccctcgactacccatacgatcggacactccgaaacgtaccgggtccctacggccgtacccgaagtaccgagggtttcccggtaggtaccgtagggttcggggtaccgtcggggaactaggtacgtttcaaccgttcctccgaacccggtnacggtacacggtccgtacggtcgtcgtacggtattgttagtttacgtacgttacgttttaccttcgttagtacgtacgtaccgtcggtcccttccgcccgtaccgtaccgtccgttaccgtccggtttcccggggaccggggtacggtacggggtggtaaccggtaggtacgggtacggaaccggtaacgggtcggtacgggtcggtacggacccgttaccgtacggttccgtttacggttaccgtttcgtacctttcccccgg

SEQ ID NO: 112211 - DNA, 646 bp, Homo sapiens
  misc_feature: GYAE6OF02FSTP6.45.36.D03.1.454.CMB.1.raw
  modified_base (201)..(201): a, c, t, g, unknown or other
  misc_feature (201)..(201): n is a, c, g, or t
  modified_base (593)..(593): a, c, t, g, unknown or other
  misc_feature (593)..(593): n is a, c, g, or t
  modified_base (603)..(603): a, c, t, g, unknown or other
  misc_feature (603)..(603): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggganacagccacctctcctgcacggccagtaggatgtacagtaagtactaggctggtacaacgacgaaaccgtcggaccaggcctcccgtaggcctccgtcagtccctaagtcgatcgacacgtaccaacggtacgggtccctaggcccgtaccgacggtacgtacggttccgtggacgtacgggtgggtacgtgggacctagtacgttccgtactccgtacgaccgtcgacaccgtcgtccgtaggacgtccgtgtactagttacgtttcgaccgtttacgtttccttgtacgtcgtacgtccgaccgttccgtacccgccggtccgtaccctccggtctaaccgggttccgggacgggtccgtagggtcgaagtcgtaggaacgacggttacgnggttaccggngaccgtaccgtactacgttcctggttcctaccgtcgttacccg

SEQ ID NO: 112212 - DNA, 677 bp, Homo sapiens
  misc_feature: GYAE6OF02HRYLM.45.36.D03.1.454.CMB.1.raw
  modified_base (280)..(280): a, c, t, g, unknown or other
  misc_feature (280)..(280): n is a, c, g, or t
  modified_base (414)..(414): a, c, t, g, unknown or other
  misc_feature (414)..(414): n is a, c, g, or t
  modified_base (634)..(634): a, c, t, g, unknown or other
  misc_feature (634)..(634): n is a, c, g, or t
  modified_base (656)..(656): a, c, t, g, unknown or other
  misc_feature (656)..(656): n is a, c, g, or t
  modified_base (665)..(665): a, c, t, g, unknown or other
  misc_feature (665)..(665): n is a, c, g, or t
tcagacgcgatcgacacgaccggtgctcgatttagctgcgtcacgatctctcttggggagctctgggagtacgagcccagcactggaagtcgccggtgttcctttacggtgatcatcactgaacacagagtactcaccatggactttgggcctgacctgggttttcctacggttgctcttttaaggaggtgttccagtgtcaggtgtcaggttggtgagttcggggggagcgttagtccagcctgggaggtccctgaagctactctgtacgcacgcctcncggtattccccgtctcgaattacggtttcgtacctgtccgggttcgaacccgtacgttcggacggacggtacggtcggtacggtacgggtggtcccggaccttcgttaacggtcccgtaaagccggttaaaggnggtacgtaacgtaacggccctttaagaccggtgtaaccgtcggttacgggaaccggccttcgggtaaccctccgtaacttccgacgtacggtaataaccgtacttaaccgaaagttctcgttaacctttcgtttagaaccttcgttaaagtaacgttctaaccgtgtaagcgtacgtagacgtactcgttgttaactcttcgttacgtcgtgacggcgtntaaccgtgttctggacttcggngttaccggngtactcggtacc

SEQ ID NO: 112213 - DNA, 748 bp, Homo sapiens
  misc_feature: GYAE6OF02GDS3L.45.36.D03.1.454.CMB.1.raw
  modified_base (205)..(205): a, c, t, g, unknown or other
  misc_feature (205)..(205): n is a, c, g, or t
  modified_base (260)..(260): a, c, t, g, unknown or other
  misc_feature (260)..(260): n is a, c, g, or t
tcagacgcgatcgacacgaccggtgctcgatttagctgcgtcacgatctctcttgggggaggaactgctcagttaggacccagagggaaccatggaagccccagcgcagcttctcttcctcctgctactctggctcccagattccacgggagaaatagtgatgacgcagtctccagccaccctgtctgtgtctccgaggggaaanagtcaccctctcctgcagggccagccagagtgtcagcagcgactagcctggaccngcaagaaaccgtggaccaggcctcccgaggcctccgtcatcctagtggtctccttcctccgacgggccctacgttcggtactccccgaaggccctagggttcaggttcggcgtagggttcgggtcgtaggggaacctcgggttccgttttaccgccctactaccctaactaccgtaaccgtcgtccccttaccgacggtttacctaaggtaaacgtttacgtttttacgacgtttaaacggttttattttaccgtacgttccaaaccgttaagttaaacttaaacgttaacgttccggggttaacccgttccgggttaaccggggttaaccgggtttacccgggaaccggtaaaaaccgggggtaccggttaaaagggggttaccggtaaaacgttaacccggtaaaacggtaaccggttacgggttaacggaccgttacgaccgttaacccgtaagttcccgtttacggttaccgttcccttaaccg

SEQ ID NO: 112214 - DNA, 959 bp, Homo sapiens
  misc_feature: GYAE6OF02JGOWV.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttcgtcttccctcgtgacctcgtcgtgtcctaccagtactaccgaaacgtaaattgtgttacgacacgtagtcctaccgacgacctacccgttgtccttccgttcgtaccgtccgggaagggaacgtaccgaccgtaccccctacccgttcccgtccgtacggaccggaccggggtaccgtaagggtaacgggtacggttacgtaacggttaaaggttaacggtttaacggttacggtaccgttaaccggtaaaccctaaacgaaaccggtaaaccggtccggaaccgtaaccggcccctaaccggacgtccttacccaacgtaccgtaccctaggtacagttccgaacctaaccgtaaccggaaccggtccggttccggacggtaccccgtacgaacggttaaccggttcgggttacccggtacgtaccggttaggggttaccggttacgggaaccggtaacgtaaggtttcccgttaaccgtacccttcggtaaccccgtaccgtacggtaacccgcgtaccgtccgggtaacgacccgttcgtacggttacgttagttaccgtttaggtaaccttttacgtttacgttacggttaccgtgtaccgtcgggtaacccgttcccggtaccccggtacgtccccgtaccgtaccgttacccggtttaccgggggttccgggggaacccgggttaacggtccggggttaaacgggacgttacgggtacccggaaacggtacccgggttaacggtccgggtaccggttccggtaacccgttacccggtacggttaacccgtttccggttaccccgtttaccgttttacccggtaccccctttaccccgggg

SEQ ID NO: 112215 - DNA, 964 bp, Homo sapiens
  misc_feature: GYAE6OF02H32KQ.45.36.D03.1.454.CMB.1.raw
  modified_base (197)..(197): a, c, t, g, unknown or other
  misc_feature (197)..(197): n is a, c, g, or t
tcagacgcgatcgacacgaccggtgctcgatttagctgcgtcacgatctctcgttgggggaggaactgctcagttaggacccagagggaaccatggaacgcccagctcagcttctcttccgtcctgctactctggctcccagactaccaaccggaaaattcgtgttagacacagttcaccaggccacctgtctcgtntctacggagggacacgacgccctacctctcctcgacgacgggacctaggacgggtagtcgtaccgaagtaacggttacttacggtcgttaacggaaaccctaaacgtaacgaaaacccggttcgggacccgttaaacggcccgttaccccgaaggtcctttacctcgtaaacccgttcaccgttaaggacttacgaccaaccgtaccgtaaaaccgtccggggtccccttaagggacccccttaccggaacgtaacccggtggggtttcccggttacgggacccggtaaccggggtttggggttaccgggtaacggggaactaacggggttactttaacccgggtaaccttttcgaaaccccggtaacgtacccgtaccgggaaccgtacggtaaccgttaccggggtaaccgttaaccgttcgggaaaccgtttaaggtttacgttttaccggttaccgttaccggttttttaacggttactaacggttaccgaacggttacggttaaccgtttccccgggtaaaccgcccggttaaaccgccccgggttaacctttaccccggggtttaaacccgggggtttacccggggggaccgggggtaaccccgggtaagggggtttaaacggtacgggttaacccggaggggttaaaccggtaaccggttaaaccgggtacccggtttaaagggtccgttccggaaaccccggtaactttaacccggggttatttacccccggttgtttacccgttaccgtttacccccg

SEQ ID NO: 112216 - DNA, 723 bp, Homo sapiens
  misc_feature: GYAE6OF02GJ75S.45.36.D03.1.454.CMB.1.raw
  modified_base (473)..(473): a, c, t, g, unknown or other
  misc_feature (473)..(473): n is a, c, g, or t
  modified_base (501)..(501): a, c, t, g, unknown or other
  misc_feature (501)..(501): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggttttcctcgttgcttacgttttaaggaggttgtccagttgtcaggtgctagggtggtggtagggtcggggggagtcgttgtccaggcgtgggacggtccctagacgtactccgtccgtaggtgcctacgtcccgtgttcggtacttccttccctagtacggtttaacttttcggttcctacggttccgggtcccgccggttacgggttcccgacgggtaccggtaacgggggtcgttacggggaggttcggggtccgggtccctcgttacgtttaccggaaagtacgtaggaagtggaagtaacggtcctacngacgaccgtcggacggacggctcctacncgtactccgtacgagacgtaacctattacgaacgtatcgttaccttgtttacgaattaagtagtaactgtacctaggtacgtacggttacgagtaccgcgttcgttgttacgttaactttcgttgggtacggccgggtacggggtaaccaggtttaccgtaacgttgggtagtttaccgggttaggtttaccggttaagtttacggttacctacgttaaccg

SEQ ID NO: 112217 - DNA, 780 bp, Homo sapiens
  misc_feature: GYAE6OF02I41FG.45.36.D03.1.454.CMB.1.raw
  modified_base (541)..(541): a, c, t, g, unknown or other
  misc_feature (541)..(541): n is a, c, g, or t
tcagacgcgatcgacacgaccggtgctcgatttagctgcgtcacgatctctcttgggggaggaactgctcagttaggacccagagggaaccatggaagcccagctcagcttctcttcctcctgctactctggctcccagactaccgaaccggtaaaattgtggttgaccacagtctccgacggccaccctgtcctctcgtctccgaggggacgacacgtcccaccctcctccgtgaccgacgggcctaaggtacggacggtcgtacgaggtaacgtacgtaggaccgtacggtaaccaacgaacgtaaccgtcggaccgacggtcctacccgacggtcctaccgtacctactaccgtacgtgtacgtacgactaacctacccgaacggtacccgggtacccgtacgggtccccgtaccgaacggtaccgttaccgggttccggcggtacggtacgggttacgggtacggtacgggacgtaacggttacggttcctaacgtccgtaccgacccgtcgacgccgaacggtcccgtagggtacnccgttaggacgttacggttacgtttcgaccgtttacggtttacttcgtagtaccgacgttcgtacgtccccggtccgaacccgccgtaccctcggtaccgttccgggggtccggggcggggtaaccgtcgggggtaacacgggtcgtaccgggagtaccgggtaaggttccggtcgggtaacctccggaaccgttacgtcggttccgtaccgttacccgttacggtccctttacccccg

SEQ ID NO: 112218 - DNA, 651 bp, Homo sapiens
  misc_feature: GYAE6OF02HNK9O.45.36.D03.1.454.CMB.1.raw
  modified_base (227)..(227): a, c, t, g, unknown or other
  misc_feature (227)..(227): n is a, c, g, or t
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (383)..(383): a, c, t, g, unknown or other
  misc_feature (383)..(383): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (507)..(507): a, c, t, g, unknown or other
  misc_feature (507)..(507): n is a, c, g, or t
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
  modified_base (623)..(623): a, c, t, g, unknown or other
  misc_feature (623)..(623): n is a, c, g, or t
  modified_base (641)..(641): a, c, t, g, unknown or other
  misc_feature (641)..(641): n is a, c, g, or t
tcagacgcgatcgacacgaccggtgctcgatttagctgcgtcacgatctctcttgggggaggaactgctcagttaggacccagagggaaccatggaacgccccagcctcagtcttctcttcctcctgcctactctggctcccagactacccgaaccggtaaaattgtgttgacacagtctccaggccaccctgtctctgtctccgagggacacacgccacctcctcngcgacgggccagtgagttgactagtacgtacgtagctggaaccaacacgaaccnggaccacggtcctaccnggcctccncgactcccgatcgtaacngcctaacgtacccaaggtccgggtcctcggccttaccgacgtacggtaccggttccggngacggtgggttcggtacgtagggactacggttcgttaaccgttcctaccnccggtntaaccggcaaggcccgtaagcgtctaggcttgtttacttccgtacttacgtttacctgttctcgtacncggtacggttcccncccggtacncccggtactacgtccggttaggcccgggggttcggaccggtaggcgtcggagtacgacggttacgtaggccgtagccgtacgccgtaacggtntcgtttacgtccgttacnccgttacccg

SEQ ID NO: 112219 - DNA, 893 bp, Homo sapiens
  misc_feature: GYAE6OF02F47B7.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctcgacctgggttttcctcgttgcttacgtttaaggaggtctccgagtgtcgaggtgcgtagggtgggtgggaggtcgggggggagtccggtttgtccgaggccgtaggggacggtcccgttggaacgtaccttccgtccgttaggtcgccacgtaccctcgtggtactttcccctcccgttactaacggtttaaaccgttttcgggtttaccctacggttcggggtaccccgtaccgttacgggtttacccgagggaccggtaacgggggtcctaggggtacgggtcggggttcgaccccgttacgttaacggtttacccggaaaggtacggttaacggaacggttagggaaacggtaaccgggtaccctttaacggtaccgtaaacggttaaccccggttcggggttaaacggggtaaacccggggttccccggttacctttaaccccggaacccgttaaccgtttacccgtacccgtaaaggaaacgtaacccgttaaaaccgttaaccgtaaaacggtaacgtttcccgttaccgttttacgtttttaacggaactaaacgttagtaaacgttcgttaccgtaaggtaacgtaggttacggtaacgtaaccttacggtttccttagtaccttttaacgtttccgtaggttaccgggtaaccgggtaagggtactaacggttcgtaaggtaggttacgtcggtttacggttagtaggtttaacgttaccttaccgtaaacc

SEQ ID NO: 112220 - DNA, 792 bp, Homo sapiens
  misc_feature: GYAE6OF02HOKQH.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctcggcccccagactaccaccggaaaattgtgttcgacacagtctccagccaccctgtcctctgtctccgagggacgacacgcccaccctcctcctcgccgacgggccaggtaggacgtacgtacagttaagtaccgttagcgttacggtaaccaacaacggtaaaccgtggacccgtacggtaccctcccgacggtccctacccgtacgaactcccgtatcgtacgtacgtacctaaccgtaccctaaaccggccgggttccccgtacgggtccccgtaccgaccgtaaccgttaccggggtttcccggacggtccggtacggttccgggtacggtacggggtaacgtacggtacgtttaccggacctttcgtacccgtacccgttacgaccgtacggtaccggttacccggtacggtacccggtacccggtacgggttacgttaacggtttacgtttaccggtacgtttacgtttttaccgttccgttacgtttcgtacgtcggttaccgtccggttcccaccgtaccgccgtaccgtaccgttccgggttccgggtccgggggtaccgtaggggtcgaacggtcgtacgacgggtaccgtacggtcggcggtcgtacgcctaacgttcgttactccgttcgtacgtcgttcccgtacccg

SEQ ID NO: 112221 - DNA, 855 bp, Homo sapiens
  misc_feature: GYAE6OF02H4W0K.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggaccagagggaaccatggaagccccagctcagcttctcttcctcctgctactctggcctcccagactaccaaccggaaaattgtgttgacacagtcctccaggccaccctgtctctgtctcgaggganacgacgcccaccctctccgtgcgacgggccgaaggtaggagttgtacgtaaggttaacgttacgttaggtctacggtaaccaaacgtaacgaaaccgtggacccgtaacggaccctacccgaggtcccttaccctctactcctagtcgacgttacgacctaaccgtacccgtaaaaccggccccggggtttcccgttaccgggaccccggttaccccgaacgggtaacccggttacggggtttccccgggtaggggtccggtacggggtttcgggggtaccggtacggggaaccggttaacggtaccggtttacctaacccgttcccgttaacccggtaaccgtccgaccggaccgtaccgggtaccggttcgggccggtccgttaggtaacgtttagttaacgttttcggaacgttttacggttttaacgttccgttaggttaccgcggtaccgttacgggttacccggttcccgacccggtacccgtcccgtacccgtttcggttaccggggttcccgggggcgggggtaccgtaggggtacggtacgggtacggtacgggaaccggtaaccggtaacgtcgggtacgtaccgtacgtaccctaacgttcgttacctttccgggttacttccggacctttacccccggg

SEQ ID NO: 112222 - DNA, 710 bp, Homo sapiens
  misc_feature: GYAE6OF02HNZA3.45.36.D03.1.454.CMB.1.raw
  modified_base (206)..(206): a, c, t, g, unknown or other
  misc_feature (206)..(206): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacacgtctccgaggccacctgtctctgtctccgagggganacacgccaccctctcctgcgacgggccaggtaggagtgtacagtaacgtacttacggtactaggtaaccaacgagaaacctggaccaggcctcccgagtcctccatacncctagngtagtcgacactaccgaacgtaccgggtcccttacggcccgtaccacggtaccgtacggggttcccgtgggacctaggggttcgggtacggtacgggaccgtaggtacgttaccgtaccgttccgtaacccgtacccggttacgaacggtcccaacggtccgttacgggaccgtaccgtagtaacggttacgttacgttttcgacgtttaacgttttccttacgttcgttacgacgtccgacgtcccggtcccgacgtccgtcctccgtacgtaccgggttcggggacgggggtacgtacgggtacgtagtggacggtcggtaacggtacgtgggttacgcgtaccgaacgtcctacgttcgttccgttaacttcgttaccttccccgg

SEQ ID NO: 112223 - DNA, 808 bp, Homo sapiens
  misc_feature: GYAE6OF02GA2WJ.45.36.D03.1.454.CMB.1.raw
tcagacgcgatcgacacgaccggtgctcgatttagctgcgtcacgatctctcttggggagctctgggagacgagcccagcactggaagtcgccggtgttccttcggtgatcagtcactgaacacagaggactcaccatggactttgggctgaccttgggttttcctcgttagcttacgttttaagaggttcgtaccagttgtcgaggtgcgaggtggtagggaggtcggggggaggtcgttgtccagccgtgggtacggtccctggacgtacctccgtcctggtcgcgtacgtccttacggtggtacttccgttccctagtaacgtttaaccgttttcggttaccctacggttcgggtaccctacccggtacggttacccgagggtaccggtaacgggggtccttaggggtcggttacggggttccggtccccgttacgttaacgtttacccggaaggtaccgttagggtaaaggttggaacggtaaacggtcccttaagtaccggaacgtacccgttaccgggtaacggtaccggggtccctaccgtttaacccgacctactacccgtaccaacggtaacgtaaccgtaacgttaccgaaacgtaacttcgttaccgtttacgtttactacgttaagtacgtaacgtacgtaccgtaggtaagttaggtcgtaacgtcgtaacgttcgttacgttcgttaacgttcgtcgtacgggtaaccggtacggggtaacttacgtacggttacggtacggttacggttaccgttacgggtttacgtacggtttacgttacgtaacttaaccg

SEQ ID NO: 112224 - DNA, 804 bp, Homo sapiens
  misc_feature: GYAE6OF02GA436.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggccaccctgtctctgtctccgaggganacacgccaccctcctcctgccagggcccaaggtacggagtcgtcgaagtaacggttacgttaggcctacgggtaacccaaacgaacggaaaaccctgggaccctagggtccctacccgaggcctccctcacttacccgattcggatcggacctacgtcccaaaccggttacgggtcccctcgggtacccgtaccccgaacggtaccggttacgggttccggtagggccggttaagggttcggggtaccgtgggtaacccgtggaacgtttcaaccgttctacccgaccgttcaccgcgacgtcccgtacgggtacgtcccgtaggtaagttacggttacgtttacggtaaccgttccgtttttaagttttccgtaggttaccgtacggttccgtaacgggtttaccccgggtttccgaccccgtaccggtcccgtccccgttacgttacccggggtttcccggggggaccggggggttaccgtcgggggttacggaacgttacggacgggtaaggaacccggtttaaggccgggttacgtccggtacggtacccaaccggtttgttaccgtccggttttactaccgttccgttaccccgg

SEQ ID NO: 112225 - DNA, 803 bp, Homo sapiens
  misc_feature: GYAE6OF02I3EJK.45.36.D03.1.454.CMB.1.raw
tcagacgcgatcgacacgaccggtgctcgatttagctgcgtcacgatctctcgttgggggaggaactgctcagttaggacccagagggaaccatggaagccccagctcagcttctcttcctctgctactctggcctcccagactaccaccaagtaaaaattgtgttcgaacacacgtctccaggccaccctgtcctcgtgtcctaccgagggacaccgacgcccacccttcctccgtcgaccggacgggaccctaggtaacgggcgttacggtaccgtaaggttaaacggttaaccggttacggtacgttaccggtaaaccgaaacgtaacggtaaacccgtcgggaccgacggtacccgtacccgtacgggtcctaccctacgtactacccgtagtacgtaactcgacctaactaccgaacgtaccgggttccgcggtacccgtaccgacggtaccgtacggttccggcgaacggtcggtcgggtacgtacgggactacggtacgtttcccgacttcccgtaccgcccggttacgaccgtcgtacgcccgggttaggaaccgttcccgtagttacgtttgttaccgtttcgtaaccgttacgttttccgtacgttacgtcgtaacggtccgtaccgttccggtacccgccgtacccggttccgtacgttacggtccgggtttccgggggaccgggtcggttacgttacggggactacggtacggtaaccggtaccggtaaggttccggacggttccgtacgtaacctaccggtctttaccggtcgttacctagttaccccgg

SEQ ID NO: 112226 - DNA, 821 bp, Homo sapiens
  misc_feature: GYAE6OF02G3M7N.45.36.D03.1.454.CMB.1.raw
  modified_base (201)..(201): a, c, t, g, unknown or other
  misc_feature (201)..(201): n is a, c, g, or t
  modified_base (447)..(447): a, c, t, g, unknown or other
  misc_feature (447)..(447): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggganacacgccaccctctcctgccgacgggcctaggtacggagtgtacgtaagttaacgtacgttaggccgttaggtaacccaaacaacgtaaacccgtgggacccgacggtccttaccccgacgggtcccttacccgtctaacttaccccagttacggaacgttacgaccctaacgttacccgaaaaccggccggggtttaccccgtgggtaccccgtacccgaacggtaccgtaccgggttttccggnggaccgttaggggttccgggttacggtacggggaacgtaacggttaccggttacaccgttccgttaccgacccggttacgaccgtaccgaccggttcggtaacgggtaccgtaccgttacggaacgtttaggtttacgttttacggtacgttttaaccgttttacccgttcttacggttaccagtaccggtacggttcccgtacccgaccgtaccggtcccgtccgttaaccgggttaccgggttccggggggaccgggggtaccgttagggggtaacgtagggtaacggttacggaacggtaccgtaacgggttcgtacggtcgtaccggtaccgtactacgttacgtcggttcctttaccgacgtttccccg

SEQ ID NO: 112227 - DNA, 814 bp, Homo sapiens
  misc_feature: GYAE6OF02GIW0F.45.36.D03.1.454.CMB.1.raw
  modified_base (164)..(164): a, c, t, g, unknown or other
  misc_feature (164)..(164): n is a, c, g, or t
  modified_base (179)..(179): a, c, t, g, unknown or other
  misc_feature (179)..(179): n is a, c, g, or t
  modified_base (210)..(210): a, c, t, g, unknown or other
  misc_feature (210)..(210): n is a, c, g, or t
  modified_base (577)..(577): a, c, t, g, unknown or other
  misc_feature (577)..(577): n is a, c, g, or t
  modified_base (688)..(688): a, c, t, g, unknown or other
  misc_feature (688)..(688): n is a, c, g, or t
tcagacgcgatcgacacgaccggtgctcgatttagctgcgtcacgatctctcttggggagactgctcagttaggacccagagggaaccatggaacgccccagctcagcttctcttcctcctgctactctggctccagactaccaaccgtaaaattgtgtgacangtactcacgcacctntctctgtctcggagggatacacgaccacctntcctgacgacggacctaggtacggtagtgtacgtaagtaaacgtacgttaacggtcgtaaccgtaaaccaacgtaacgtaaaccgtcggaccaacggaccttacccgacggtcctacctaccggactaccgtaatagtattacgacctaacgttaccgaaacggttccgggtaccctgggtacccctacgtaaccgtacggtacggttaccggttggaacgtcgggttccggtaacggtcgggtaacttacgggtaacttccgtaacgtaccgttacccggtaacccgtgaaccggttaacgtccggaacggttcggtaccgacgtttacgtaggttatttaaccgtttgacgtttaacttttaccnggtaaaccgtcggtataccggtcttaccccgggacgtaaccggttccccaacgttccggtcgggttaaacccgggggtttcccggggaaaccggggacgggttaaccgggngggtttaaaccgtacggggtaaggtaacccgtacggttaacgggtagtaccggggttctaaaccgggacccttaacggtccggtttaaacggccttttaccggacccctttcggtttaacccccgg

SEQ ID NO: 112228 - DNA, 760 bp, Homo sapiens
  misc_feature: GYAE6OF02HOSN3.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggtttcctcgttgcttctttaagaggtgtccagtgtcaggtgcgaggtggtggaggtcggggggagtcgttgtccgagccgtggggacgtccctggagacctcctccgtgtcgcacgtcccttcgtggtactttccgtccctactaacgttaacgtttcggtttccacgtcgggtccaccgtacggtccgacggcggaaggggcgtaggtaggtcgggtcgtcccgtctacgttaccgaagtacgtaggtaacgtggaacggtacgtctaacgtcgacggtaccgtcggtacgggaaccgggtcccgttcgtaccccaccgtactacccgtacccgaacggaacgtaaccgtaacttaaccgaaaaggttacgttaccgttccgtttacgttttaacgactaaacgttactaaacgtacggtaccgtaggtaacggttacggttaacgggacgtaaccgttaccgggtttcttcggtttacgttaagtttttccgacggttcgtaccgggtaacggggtacctaacgttaacgtacgttacgggtagtttaccgggtttacggttacggtttaagtttaccggttaactaacgttaaacccg

SEQ ID NO: 112229 - DNA, 852 bp, Homo sapiens
  misc_feature: GYAE6OF02F8SAB.45.36.D03.1.454.CMB.1.raw
  modified_base (100)..(100): a, c, t, g, unknown or other
  misc_feature (100)..(100): n is a, c, g, or t
  modified_base (782)..(782): a, c, t, g, unknown or other
  misc_feature (782)..(782): n is a, c, g, or t
tcagacgcgatcgacacgaccggtgctcgatttagctgcgtcacgatctctcttgggggggaggaactgctcagttaggacccagagggaaccatggaanccccagctcagcttctcttcctcctgcctaccctggcctccagactaccaaccggaaaaacttgtgttgacacgtagtcctccgaggcaccctgtctctgtcctcggagggacacgtacgcccacccttccgtccgtacgccgtacgggccctaaggtacggtagttcgtacgtaagttaacgttaacgtagggtacgttaccggtaaccaaacgaaccgtaaaccgtggacccgaacggtaccttaccccggaggtaccccttccccgtaactaccgttaccgtaggttacccgtaacggtccgaacccgtaccgtaacccgtaaacccgggtccgggtttaaccccggttcggggtaccccgtaccgttaaccgtaccgggttaccggtttccggttacggaccggttagggttcggtaccgggttacggaacgttacggttacccttacgttacccgtccgttaccgacccttcggacgtactcggccgtaccgtacgtccggtagttacgttacgttagtttgtaccggtttacgttttaccgtacgtcttaccgacggttaccgtcgttcccggttccccaggccccgtttaccgtacgttcccgggttaaccgggttacgggtaccgggggttaccgtagggtcaacgtagggtaccggacgtacggtttaccggnggtaccgtcggtacccgtacgaccgtttcggtccttaccggttccttacgttaccgttccccgttacccg

SEQ ID NO: 112230 - DNA, 660 bp, Homo sapiens
  misc_feature: GYAE6OF02FV7H0.45.36.D03.1.454.CMB.1.raw
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
  modified_base (293)..(293): a, c, t, g, unknown or other
  misc_feature (293)..(293): n is a, c, g, or t
  modified_base (433)..(433): a, c, t, g, unknown or other
  misc_feature (433)..(433): n is a, c, g, or t
  modified_base (476)..(476): a, c, t, g, unknown or other
  misc_feature (476)..(476): n is a, c, g, or t
tcagacgcgatcgacacgaccggtgctcgatttagctgcgtcacgatctctcttggggaggaactgctcagttaggacccagagggaaccatggaagccccagctcagcttctcttcctcctggcactctggctcccagactaccaccggagaaattgtgttgacacagtctccagccaccctgtctttgttaccgaggggaaanagccacctctacctgcgtagggccaggtcagggtntaacagctacgttagcctaggtaccaacaaactggaccaggctaccagctcancacactatacgacgcagtcgaaccgacggccactcggaccactcccagcctagggtaccacggtgacgaggtcgggtctaggggtacagtcgtttaccacgttcctacgaccctatcgactcgtacgccgtacgtaccgnggtacggttacttacgaccgttattttaaccggacttcggacngtccgtaacgggctacgggtcggaacgtcgtaccgtccgttaaccgtcggtttccgggcggggtaaccgtaaccggaaagggtccggaagggttacgtaccgtaaacgggtaaccgttcgggtacggacccgttagcccggtaaaccctggtccttacggttacccgtacttacccgtttcccg

SEQ ID NO: 112231 - DNA, 942 bp, Homo sapiens
  misc_feature: GYAE6OF02FKTCR.45.36.D03.1.454.CMB.1.raw
tcagacgcgatcgacacgaccggtgctcgatttagctgcgtcacgatctctcttggggaggaactgctcagttaggacccaggagggaaccatggaacgcccagctcagcttctcttcctctgctactctggctccagataccaacggaaaattgtgttgacacagtctccaggccacctgtctctgtctccgaggggacacgacgcctacctctccgtgccgagggccaggtaggtcgtgtacgaaggtaacggtacgttacggcgttacggtaaccaacgtaacggaaaccgttcgggacctacgggtccccttacccgaacgggtccccttcccgtaccgtaccttacccgtaaggttaccggtacgttccggtaccttaaccgtaccccggaaaccgggtacccgggggttccccgtaccggggtccccgttaaccccggaaacggttaccccggttacggggtttcccggtacgggaccggttaggggttcggggtcggtacgggggaactaacgggttacgttacccttacgttacccgttacccgacccgggttaacacccgggtacgtacccgggttaccggtacgggtacccgtcgggttaacggttaacgggtttcggtttaaacgtttttgggtaaccgttttaacccgtttcgtttacgttcggtacccgttcgggtaccgttacccgggttcccggttccccgtaccgggcccggttcccgttaccggtttaccgggtttccgggggttacccgggggggtaaccgggggttaaacgggtcggggttaaggggaacgtttacggggtaccgggtaacgggttaacccggtcggggttaaccggtggggtccccgtacccggtaaacccgttcggtaaccggttttccgttaccgggtttacccttaccgggttacccctttcccccggg

SEQ ID NO: 112232 - DNA, 753 bp, Homo sapiens
  misc_feature: GYAE6OF02JST3F.45.36.D03.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
tcagacgcgatcgacacgaccggtgctcgatttagctgcgtcacgatctctcttgggggaggaactgctcagttaggacccagagggaaccatggaagccccagctcagcttcctcttcctcctgctactctcggctcccagatacccgaaccggaaaaattgttaggttcgacacacgtctccaggccaccctgtctctgtcnccgagggagacncgacctccctctcctagccgagggccaggtaggagttcgtactagtaacgtacgtacggtctaacggtacctaaccgaacgaccgtgccgaggtccctaccggacgtcctaccctcactccgagtgactcgactactccgaaccgtcggtccccgtggtccctaccgaacggtccgtacggtccggtacggtacgtaggtcggggtcggtaacgggtaactaggtaccgttacccgtactaccgttcccgaacgttccgacgaccgtacggtccggttacggacgttaccgtaacgggtacttacggttacgtttcgaacctttcgggttttacctcggttaccgcgtacggtcgtacgtcccgtcccgttaccgccgtacccgtcgtaccgtacgggtccggggtaaccggggtaccgtgggtacgacgttacgtacgggtaaccgtaacggtcgggtttcgtaaccggtccggttaaccggtcctaaccgtacggtttaccgtccggtttaaccccgttaggttaccctccccgg

SEQ ID NO: 112233 - DNA, 717 bp, Homo sapiens
  misc_feature: GYAE6OF02JSZG4.45.36.D03.1.454.CMB.1.raw
  modified_base (173)..(173): a, c, t, g, unknown or other
  misc_feature (173)..(173): n is a, c, g, or t
  modified_base (239)..(239): a, c, t, g, unknown or other
  misc_feature (239)..(239): n is a, c, g, or t
  modified_base (566)..(566): a, c, t, g, unknown or other
  misc_feature (566)..(566): n is a, c, g, or t
tcagacgcgatcgacacgaccggtgctcgatttagctgcgtcacgatctctcttgggggaggaactgctcagttaggacccagagggaaccatggaacgccccagcctcagcttcctcttcctcctgctacctcgtccggccccagactaccgaaccggtaaaattcgtgtanacacgcgtctccgaggcctaccgtgtctcgtcgtccgtacgaggggacacacgccctacccttccnctacgcgacggcctaggtacggtagtcgtacgtagtacgtcgtaggcctacggtacaacacgacgcgacgacggtcctccgagtccttccacgtactaccgtaagtgtactcgacctaaccgtaccgtaaccggacggtcccgtaccgtaccgtacccgtagtaccggttccggtccgtacggtacggcggttacgggtacggtacgggactaggtacgttaccgtactaccgtaacgaaccgtaccgttacacgggttctacccgtaccggtaccgtaccgttggttaccggttacttcgtaaccttacgttacaccgttgaacgngtccgaggtccgtgaccgtggcctcgtaccgtcggtacgtacgggaccggtaacgcggtaacggtacgattacccgaagaccgtttagggcggttaccgaccttcgaacgttcctggttacgtccgtactacccggttctaacccgtcccg

SEQ ID NO: 112234 - DNA, 852 bp, Homo sapiens
  misc_feature: GYAE6OF02F9VB2.45.36.D03.1.454.CMB.1.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctccaggccacctgtctctgtctccgaggganacgacgccacctctcctgacgagggccagtaggagtgcagtaagtacgtaggctggtaaccaacacgaaacctggaccgaggtcctacccgaggcctacctacactaccagtagatcgactactaccgaaacggtacgggtccccgtagggtaccccgttacccgaaggtaaccggtaccgggttccggacgggtaccgtaaggggttcgggggtaccggtaggggtaacgtacggttaaggtttacccgtaaccgttacgttaccccggtaaccggttaccgaaccggtaccgtacgggtacccggttacgggggaaccttacccggttaagggtaaccgtttaggtttaacggttttttaccgaacccgtttaaaggtttttcccctttaggttaccggttacgtaaccggtaccgtaaccggggttccccgttacccgaccccggttaaccggtccccggttacccgtttacccgggttaccgggtttacccggggggggaaccgggggggttaaacccctaggggggttaacgaacgggttacggtaccgggaacgggtaaacccgtagggtaccgggtttacggaccgttacgaacccgttacgacgttttaccgtcggtttaaccttcccgtacgtttacccccg

SEQ ID NO: 112235 - DNA, 965 bp, Homo sapiens
  misc_feature: GYAE6OF02HI8DR.45.36.D03.1.454.CMB.1.raw
  modified_base (200)..(200): a, c, t, g, unknown or other
  misc_feature (200)..(200): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctcaggcaccctgtctctgtctccagggganacacgccaccctctcctgcgacgggccagtaggagtgtcaggtaagtacgtaggcgtacggtaccaaacgacggaaaccttggacccaggcctacccgaaggtccctcctacgtactacccgtagtacggtactcggacctaacgttacccgaaacggtacccggggttacccctacggggtccccgtttaaccccgaaggtaaccggttacccggggttttaccggttacggggaccgttaaggggttcgggggttacgttacgggggaaaccttacgggtaacggtttaccgtaaccgttacccgttaacccgtaacccggttaccgaaccggtacccgtacgggtaccccggttaacgggggtaccggtaccccgttagggtaacgttaccgggttttaacgttttcggaccgttttaacggttttttacccttccgggtttaacggtttaccgtacggtaaccggttaccgggttaccccgtttaccccggggaaccccgtttaccggggtacccccgtttaccgtttaacccggggtttaaaccccggggttttcccggggggggggaaaccccggggggttaacccggttaccggggggggttaagaaccgggttttaaccgggcgggggttaaaaccgggtaaaccccgggtttacgggttaaccggggttttcgggaccccggttaacggaccccgtttaccgtacgggttcccgtttacggtttaccccggtttacgtaccccgttttacccccgg

SEQ ID NO: 112236 - DNA, 696 bp, Homo sapiens
  misc_feature: GYAE6OF02IABQK.45.36.D03.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgtgacacagtctccaggcaccctgtctctgtctccgaggganacncgccacctctcctgacacgggccaagtaggagtgtacaggtaagtacgttaggctaggtaaccaacgaacgaaaccgtcggccgtaggcctacccgaggtctcctnactcagtagatcgacactaccaacggtccggtccgcggtcccgtaccgacggtacgtacggttccggnggtacgtaggtacggggtcgtacgggaactacggtacgttccacttactaccggacgtaccacggtacgtacgcccgtgggaacctcgtagtagttcgttatttcggaacctttacggtttaccttcgtacgttcgaacgtacgtaccgtcgttacccgccgttaccggcccgttagtacccggttaccgggttccgggggaaccgggggtaaccgtcgggggtaggaacgtcggttaggaccgggtaaacgtcggttcgggtcgtacgtcgtacctacccggtattcccgttacgttaccttccggactttaccccgg

SEQ ID NO: 112237 - DNA, 954 bp, Homo sapiens
  misc_feature: GYAE6OF02FO1DW.45.36.D03.1.454.CMB.1.raw
  modified_base (190)..(190): a, c, t, g, unknown or other
  misc_feature (190)..(190): n is a, c, g, or t
  modified_base (206)..(206): a, c, t, g, unknown or other
  misc_feature (206)..(206): n is a, c, g, or t
tcagacgcgatcgacacgaccggtgctcgatttagctgcgtcacgatctctcgttggggagctctgggagacgagcccagcactggaagtcgccggtgttccttcggtgatcatcactgaacacagacggactcaccatggactttggctgaccttgggttttcctcgttgtccttactttaaggaggtntccagtgtacgaggtnacgtaggtggtggaggtcggggggagtcgttcgccgaggccgtgggacgtccgtagacgtactcctcgtgcgcgacgcctagtcgactttccgtccgtacgtacgttaaccgtttcgggttacctacggttcggtcccgaccgttaacggtttcccgaacgggtaccggtaacggggtcgtacggggtacggttcggggttacccgtaccccttcggttaaccgtttaaccgggaaaacggttacggtaccggggttaaacgtacggggtaaaaccgggtaacggtacccccgtttaacggtaaaaccgtccgggtttaaaccccggtaacccgggttaacggggaaaccccggggggtttccctaaccccggtttaacccggtaaacccggttaaccgttaccccgttaaacccgggaaacggtaaaccggttaaacccgttaaacgttaaacccggtaaacggttaaaccgtttaaccgtttaacccgtttaccggtttttaaccggaaacgtttaaacgttaacggttaaaccggtttaaccggtacccggttaagggttacgggttaaacgggtttacggaaccgggtaccgtttaaccgggttccgttaccggtttacggtttaacttaccggttccgggttaccggtaccggtaaccggggtattaccgtacggttaacgttacggttaccgttacggttcggtttaaaccggttaggtaacttaccgtacctttaacccgg

SEQ ID NO: 112238 - DNA, 725 bp, Homo sapiens
  misc_feature: GYAE6OF02FQLNZ.45.36.D03.1.454.CMB.1.raw
tcagacgcgatcgacacgaccggtgctcgatttagctgcgtcacgatctctcttggggagctctgggagacgagcccagcactggaagtcgccggtgtttcctttcgggtgatcatcactgaacacaggaggactcaccatggactttgggctgaccgttgggttttcctcgttgcttcgttttaagaggtgtccagtgtcgaggtgcgtaggtgggtgggagggtcgggggggaggtcggttgtccgagccggtggggacggtccctgacgtacctcctccgtggtgccacgccttcgtaggtacttccttccctactacgttaacgttttcgttcctacggtcggtcccgaccgtacggttccgacgggcggaacggggtcgtagggtggtcgggtcgtcccgtcgttacgttacgagtagtaggagtaggaaggacgtacctactcgaacgtccgtacgtacgggaaccgggtcccgtcctaccgtacctaccgtccgtacccaaggaacctaacgtaaaccgtaaccgaaagttacgtaccgtttccgttttaacgtttagaaacttaaattacgggtaactccggtactagaggtaggttacggaacgttaccgtacgttcgttcgtacttttacgttgtagttcggccgggtagggactacggtacttaggtagtcggttcggttcggttaagttacggttaacttactaccgtaaccg

SEQ ID NO: 112239 - DNA, 912 bp, Homo sapiens
  misc_feature: GYAE6OF02IPHVD.45.36.D03.1.454.CMB.1.raw
  modified_base (512)..(512): a, c, t, g, unknown or other
  misc_feature (512)..(512): n is a, c, g, or t
  modified_base (653)..(653): a, c, t, g, unknown or other
  misc_feature (653)..(653): n is a, c, g, or t
tcagacgcgatcgacacgaccggtgctcgatttagctgcgtcacgatctctcttgggggagaactgctcagttaggacccagagggaaccatggaacgccccagctcagcttctcttcctcctgctactctggctcccagactaccaaccggtaaaaattgttgttgactacagtcctccgaggccaccctgttcctctcgtcgtccgaggggacgacgacgccctaccccgttctccgtgacccgacgggcccgtaagggtaggtaggttcggttaaccgtaaggttaaacggttaccgtttaacgggtccgttacggttaaacccaaacgtaaacggaaaccccgttcgggccccgtaaacgggtccgttacccccggacggttccccttacccgtactaaccgttccaacggttgacgttcgaccctacgtaacccgtaaccgggttccgggttacccctcgggtacccccgttacccgtaacggtccggttaaccggggtttcccggngggtaccgttaggggttccgggttccgggtacggggaactaggtaccgtttaccgtaccgtccttaacccgacgttaccgaccgtaccgccggtaccgtacgggaccgtaccgttagtacgtttacgttacggtttttcgngttttaaacggttttacctttccttacggtacctagggtacccgtaccggtttcccccggtaccgtaccctaccggttcccccggttaaggtccccggttttaaccggggggtttcccgggggaacccggggggttacggacgggtttaacgaccgttaggtacggtaacgggaaaccgttttcgtacggggtaccgcttaccgggtaccctaccggttacgtacgtttccgtttaacccgttcgtaccgtttaccccg

SEQ ID NO: 112240 - DNA, 700 bp, Homo sapiens
  misc_feature: GYAE6OF02FOL6T.45.36.D03.1.454.CMB.1.raw
tcagacgcgatcgacacgaccggtgctcgatttagctgcgtcacgatctctcttgggggaggaactgctcagttaggacccagagggaaccatggaagcccagctcagcttctcttcctctgctactctggcctcccagacgacctccggaagtaaattgttcttagacacagttcctaccagcctattctgtctctctcgtcgagggacacacgccacctctacacgtgacgacgggcctagtacgaggtaattaagtaacgtaactacttacgtcggtaccttggttaactactaaacgtaaccaacggtccgtcgggaccgtacccgggggttccccgcttacccgtacgtacttccgtacgtagtacgttcgtaccttaccgcgacgtcggacctacggtcggaccaccgtacccacggtccgttaggtccgtagggttcgggtcggggttagttcgggaacgtagtcggtacttcacgtctacacgtacacgacgtaccgtacaccgtacctacgtacgtaacgtttacgttcgtactacgttactacgtttactacgtactaacgtacgtacgtaacgttacgtcgttacgtccgtcgttacgtaccggttacggacgggtaccggtaacggtaacggggtctaaacggtagtaaccgaacgttacggtcggtacgtcgaacgtccgtattccg

SEQ ID NO: 112241 - DNA, 838 bp, Homo sapiens
  misc_feature: GYAE6OF02IRBVE.45.36.D03.1.454.CMB.1.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacacgccaccctctcctgcgaggccagtaggagtgtcgaagtaacgtacgttaggccgtcggtaaccaaacaacgaaaccgtcggaccacggcctaccccgaaggtcctccgtcactcccagtacgattcggactaacctaccgaaaccggtccggggtaccctcgggaccccggttacccgaacggtaccgtaaccgggtttccgtagggcggtacggtcggggttcgtacggggtaacgtaggtacgttttccaaccgttactacccggttaacccgtaccgtaacggcccgtaacgtccccggtacgggtaacgtaccggttaggtacgtttaccgttttaaggtttttcccggtaaggttttaaccggtttttacctttccggtttagtacccggaacgttacccgttaaccgggttccccggttttcccggaacgttccccggtacccgttaccgttcccgttaccgggggttttaccgggggacccgggggggtaccgttaggggttacgggaacgttcggttaacgggaaccggtaaccgggttaacggtccggtacgggttccgtaacggtacccttaaccggtcggtttacgtttaccggtacctttacgtaccccgtttaacccgg

SEQ ID NO: 112242 - DNA, 897 bp, Homo sapiens
  misc_feature: GYAE6OF02GYFY1.45.36.D03.1.454.CMB.1.raw
tcagacgcgatcgacacgaccggtgctcgatttagctgcgtcacgatctctcttggggagctctgggagacgagcccagcactggaagtcgccggttgtttcctttcggtgatcatcactgaacacagaggactcaccatggtactttgggctgtaccgttcgggttttcctcgttgtcttctttaaggaggttgtccgagtgtcgaggtgtcgagggtgggtagggagggtcgggggaggtcgttgtccgaggccggtggggacggttcccgtggacgtcttaccgtccgtggtacgcgtaccgtccgtcgtcggtactttcccgtacccgtcgtaacgtttaccgttttcggttacccgaccggttccgggttcccgaccggtaacgggtttacccggaacgggtaccggtaacgggggtcggttacggggacgggtttcgggggtacccggttccccgttacggtttaacggttttaccgggaaacggttaggttaaacgggtacggttaacgggaacgggtaaccggttacccgtttaacccgtacggtaaccggttaacccgttaaccggggtacggggtaaccgggcccgtttaccgttaaccgacccttacgttaccgtaaccgtaacgggaacgtaaccgttaaacttaaccgtaaaggttaacgttcccggtttaccctttttacgttttaacgtaaacgttaaacttaacggttaaacgtaccggttacggtagtaacggttaaccgggttaaggtaccgggtacgttacccggttagtttacgttactttaacgggtttctacggtccggtaacgggtacgggtaacctaggttactaggtacgtttagtccgttggttcggttagtacgttaactacgttaaacc

SEQ ID NO: 112243 - DNA, 716 bp, Homo sapiens
  misc_feature: GYAE6OF02H2WZH.45.36.D03.1.454.CMB.1.raw
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (663)..(663): a, c, t, g, unknown or other
  misc_feature (663)..(663): n is a, c, g, or t
tcagacgcgatcgacacgaccggtgctcgatttagctgcgtcacgatctctcttggggaggaactgctcagttaggacccaggacgggaaccagtggaacgccccacgctcagcttctccttcctcctgctactctgcctcccagactaccgaaccggtaaaattgtgttagacacagtctccnggccaccgtgtacctntcgtctcggagggacgacgacgccctaccctctacncgtacgcgtggaccgagtcgtaagaagttaacgtaacgtaactacgttacgttcggtacgttagtactactaacacgtaacggtccgaccggtaccggcccggggtccccgtacttcctacgtcttactagtacgtacgttccgtaccgttcgacgtacggaccggtacctaccgtacgcctacccgtaccgtaccggtacgtacgggttacgtccggggttagggttcgggtttacggtacggaccgtacgaccgttacctcctactacccgtataaccgtcacgtacacctacccgactaaaccgtcgtaatacgtttaggtctaaccgttacgttactttacgtagtacgtactaacgtctaacggtactacgtcctacggaccttcgacggtaccggtcgggacgtacggtacggtacgtagnggtaactaccggtaagtacgtcgtacgtcgtcgtaacctacggtcttacgtcg

SEQ ID NO: 112244 - DNA, 823 bp, Homo sapiens
  misc_feature: GYAE6OF02GJD24.45.36.D03.1.454.CMB.1.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccaggccaccctgtctctgtctccgagggganacgacgcccaccctctcctcgacgacgggtccgaggtaggagtgtacagtaagtacgttaggcgtacggtaaccaacgaacgaaaccgtggtaccaggtcctacccgaggtcccttaccgtactaacgtccctaagttacgtacgtacgaccgtaaccgtaacccgaaccggtaccgggttccccgtcgggtaccccgtacccgaacggtaccgttaccgggttccggtacggtccgtacgggttacggggtcgtacgggggtaacgtacggttacgttaccgtacgttcccgtaccgtacccgttacgacgtaccgtacggtcccgtaagggtaccgtccgtaggtacggttagttaacgttttcgggtaaccgttacggttttacccttgttaccggtacgtaccggtaacgttccgggtacccggtttacccgacccggtaccgtacccgtccgttacccggtaccgggtttacccggggggtaccggggggtaccgtacggggtacgggtaagtacggttacggtaacggtaaccggtacggtgggttaccggaccgttaacggcccgtaaccgttcgttacccgttcggttaccttacgtacccggtttacccg

SEQ ID NO: 112245 - DNA, 750 bp, Homo sapiens
  misc_feature: GYAE6OF02JTQZ7.45.36.D03.1.454.CMB.1.raw
  modified_base (194)..(194): a, c, t, g, unknown or other
  misc_feature (194)..(194): n is a, c, g, or t
  modified_base (292)..(292): a, c, t, g, unknown or other
  misc_feature (292)..(292): n is a, c, g, or t
  modified_base (529)..(529): a, c, t, g, unknown or other
  misc_feature (529)..(529): n is a, c, g, or t
tcagacgcgatcgacacgaccggtgctcgatttagctgcgtcacgatcgtctcttgggggaggaactgctcagttaggacccagagggaaccatggaacgcccagctcagtcttctcttcctcctgctactctcggcctacccagacgtacccgaccggaagtaaattgttgttacgacggacacggtctaccnggctacctcgttcctgtctcgagggaacgcgaccacctctcgtcgcgacggcacgcacgtactagtcgtcggacacgtctacgtacgccgtagtaccngtacacgaaaccgttcggaccgtacggtaccctacggtccctaccgtacgttaaccacgtttacgtaacgtcggtaaccgtaccgtaaccaaaccggccgggtaaccaccggttacgggacttaaccgtacccgaacggtaaccggtacggttagaccggggttagaccgttacggggtccgtacggtacggctaacgttacgtacgtcctacgacgtaccagtttcacgtcgtacncgacgtacgacgtaagtacgtacgttacgttacgttagtagttacgttacgtacgtacgtacgttacgtaccgtacgtaccgttaccgttccgtttacgtccggtttaccggtaccgttaaccggaaccgttacggtacgtaacgttaacgtaacgttaaaccggacgttacggtacgtacggtacgtacccgtaacgttaccgtacgttaccgtttaccg

SEQ ID NO: 112246 - DNA, 833 bp, Homo sapiens
  misc_feature: GYAE6OF02HK71T.45.36.D03.1.454.CMB.1.raw
  modified_base (322)..(322): a, c, t, g, unknown or other
  misc_feature (322)..(322): n is a, c, g, or t
tcagacgcgatcgacacgaccggtgctcgatttagctgcgtcacgatctctcttggggggaggaactgctcagttaggacccagagggaaccatggaagccccagctcagcttctccttcctctgctactctggcctcccagactaccaaccggtaaaattgtgttcgactacagtcctccgacggaccacctgtctcgtctctaccgaggggagaccacgccgaccctcctccgcggacgacgggcgaaggtacggacgttggactaacggttaacggtacgttaggtccgttaacgggaacctaaacgaacggtaaaccncggaccgacggccgtaccgaggtccctccgtacactacccgagtcgtatcaaccgtacctacccgaacggtaccggtttccccggtacggacccggtaccccgaacgggtaaccggtttaccgggtacccgggttacggaccgggttacggggtccgggggtacggtaaccggggtacgggtaacggtacgtttacccgtaccgttaccttacgaacccggtcgtaacgcccggtacccgtaccggtccggggtaactcccggtacgtagttacggttaaccgttttcgttaacgtttaccgggttttaactttcggttaacggttccgtcggtaacggttaccgtacccggttcccgggacccgttacccggtacccggttaaccggtccttacccgggttaccgggggtaaccgggggtccgggtagggacggggtacgagggtacgagggaccgtacgcggttacggccgttacgccgacgtacgtgtacgttctacgtaccttccgg

SEQ ID NO: 112247 - DNA, 566 bp, Homo sapiens
  misc_feature: GYAE6OF01B62BT.13.74.G08.1.454.CMB.1.raw
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
tcagtcacgtactacacgaccggtgctcgatttagtagctctatcaggggagctctgggagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaactccctgacactgtcttgtgtagcctctggattcagcttcagaacctatggcatgcacgtgggtccnccacggccccaggcgaaggggctggagtggctgacttctttancatatgatggaatactaaaattctatgacagactccgtaggaacgggtccgtattccaccgttctaccgacgggaccaacctaccgaaacgaacctaaccttatattcgtagacaagagtacgaacgacgtcctaggagacggtgaaccggacgtacggctacgtagtccgtttactggtacgccgtaaactaacgtatacggtattggttgggagttagg

SEQ ID NO: 112248 - DNA, 553 bp, Homo sapiens
  misc_feature: GYAE6OF01AORSV.13.74.G08.1.454.CMB.1.raw
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (436)..(436): a, c, t, g, unknown or other
  misc_feature (436)..(436): n is a, c, g, or t
tcagtcacgtactacacgaccggtgctcgatttagtagctctatcaggggagctctgggagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggagcgtggtccagcctggggaatcccctgacactggtcttgtgtagccctctggattcagcttcagaacctatggcatggcactgggtcccnccacggccccaggcgaaggggctgggagtggctgacttctttancatangatggaatactaaaattctatgcagacgtccgtgacggccgtatcaccgtctccgacgggacaactaccaagaacctaccttanatctgcagactagaactcgccgtagagaggtacgacggtaaccgtgtaccgtagtacttaccgttcgtgtcggaccgtaaacaaacgtacgttagattcgggtttgggagttacggg

SEQ ID NO: 112249 - DNA, 600 bp, Homo sapiens
  misc_feature: GYAE6OF01ECLGP.13.74.G08.1.454.CMB.1.raw
  modified_base (358)..(358): a, c, t, g, unknown or other
  misc_feature (358)..(358): n is a, c, g, or t
  modified_base (574)..(574): a, c, t, g, unknown or other
  misc_feature (574)..(574): n is a, c, g, or t
tcagtcacgtactacacgaccggtgctcgatttagtagctctatcaggggagctctgggagaggaggccagcactaggagtcggcggtgtttccattcggtgatcagcagtgaacacagaggactcaccatggagtttgggctgagcttgggtttttcctcgttgcttcttttaagaggtgtccagtgtcaggtgcagctggtggaatcgtgggggaggcgtggtccaggccgtggggaactccctgacactgtcttgtgtacgcctctggattcagtcttcagaacctatggcatgcacgtcgggtcccgccgacggccccgaggacgaaggggctgggagtggctgacttctttanctatatgagtaggaatactaaaattctaatgacagaccgtcggtaggaacgggccgtagttccaccgttcctaccgaacgggaacaaccgtaccgaaacgtaacctaccttatactctagacaagacgtagaaccgagtacctaggacggtaggtacgaccggtacgtccggtacgttagttacgttacgtttcgtaggtcgaactaacaaacgtntagtagtttcggttgggaggttaggg

SEQ ID NO: 112250 - DNA, 628 bp, Homo sapiens
  misc_feature: GYAE6OF02GT0J1.13.74.G08.1.454.CMB.1.raw
tcagtcacgtactacacgaccggtgctcgatttagtagctctatcaggggagctctgggagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaatcccgtgacacgtgtcttgtgtagcctctggattcagtcttcaagtaacctatggctatcgacacgtcgggtcccgccgacggcccccgagggccgaacgggggcgtgggagtggcctgtaccttcttttagctaattagtgtagtagggaaacttaacgtaaaaattctaagtcgactagtaccgtccgtaggaacgggtaccgtacttccgaccgtccgtaccgaacgggaccaaccgtaccaaacgaacctaccctttaagtacttctacgacgagactacgaacgtacgtacgtaggagacggtacgacgtacgtccggtactagtacgttacgttcgtacggtgaaccgtaacgtaactagtacgtagttcggtttagggagttacgg

SEQ ID NO: 112251 - DNA, 124 bp, Homo sapiens
  misc_feature: GYAE6OF01AFRXM.29.3.A03.1.454.CMB.1.raw
  modified_base (124)..(124): a, c, t, g, unknown or other
  misc_feature (124)..(124): n is a, c, g, or t
tcagatagagtactcacgaccggtgctcgatttagagagcgtcacaggggcacagcggccctgggctgcctggtcaaggactacttccgagtgcgtctctgagcgggctggcaaggcgcatagn

SEQ ID NO: 112252 - DNA, 124 bp, Homo sapiens; identical to SEQ ID NO: 112251
  misc_feature: GYAE6OF01ENQA4.29.3.A03.1.454.CMB.1.raw
  modified_base (124)..(124): a, c, t, g, unknown or other
  misc_feature (124)..(124): n is a, c, g, or t

SEQ ID NO: 112253 - DNA, 125 bp, Homo sapiens
  misc_feature: GYAE6OF01CDNP6.29.3.A03.1.454.CMB.1.raw
  modified_base (124)..(125): a, c, t, g, unknown or other
  misc_feature (124)..(125): n is a, c, g, or t
tcagatagagtactcacgaccggtgctcgatttagagagcgtcacaggggcacagcggccctgggctgcctggtcaaggactacttccgagtgcgtctctgagcgggctggcaaggcgcatagnn

SEQ ID NO: 112254 - DNA, 125 bp, Homo sapiens; identical to SEQ ID NO: 112253
  misc_feature: GYAE6OF01EU44L.29.3.A03.1.454.CMB.1.raw
  modified_base (124)..(125): a, c, t, g, unknown or other
  misc_feature (124)..(125): n is a, c, g, or t

SEQ ID NO: 112255 - DNA, 126 bp, Homo sapiens
  misc_feature: GYAE6OF01AL36X.29.3.A03.1.454.CMB.1.raw
  modified_base (124)..(126): a, c, t, g, unknown or other
  misc_feature (124)..(126): n is a, c, g, or t
tcagatagagtactcacgaccggtgctcgatttagagagcgtcacaggggcacagcggccctgggctgcctggtcaaggactacttccgagtgcgtctctgagcgggctggcaaggcgcatagnnn

SEQ ID NO: 112256 - DNA, 124 bp, Homo sapiens; identical to SEQ ID NO: 112251
  misc_feature: GYAE6OF02HB3MM.29.3.A03.1.454.CMB.1.raw
  modified_base (124)..(124): a, c, t, g, unknown or other
  misc_feature (124)..(124): n is a, c, g, or t

SEQ ID NO: 112257 - DNA, 128 bp, Homo sapiens
  misc_feature: GYAE6OF02IEUBS.29.3.A03.1.454.CMB.1.raw
  modified_base (124)..(128): a, c, t, g, unknown or other
  misc_feature (124)..(128): n is a, c, g, or t
tcagatagagtactcacgaccggtgctcgatttagagagcgtcacagggggcacagcggccctgggctgcctggtcaaggctacttccgagtgcgtctctgagcgggctggcaaggcgcatagnnnnn

SEQ ID NO: 112258 - DNA, 124 bp, Homo sapiens; identical to SEQ ID NO: 112251
  misc_feature: GYAE6OF02G10RX.29.3.A03.1.454.CMB.1.raw
  modified_base (124)..(124): a, c, t, g, unknown or other
  misc_feature (124)..(124): n is a, c, g, or t

SEQ ID NO: 112259 - DNA, 154 bp, Homo sapiens
  misc_feature: GYAE6OF02JFZ6R.29.3.A03.1.454.CMB.1.raw
  modified_base (127)..(154): a, c, t, g, unknown or other
  misc_feature (127)..(154): n is a, c, g, or t
tcagatagagtactcacgaccggtgctcgatttagagagcgtcacagggggtcacagcggccctgggctgcctggtcaaggactacttccgagtgcgtctctgagcgggctggcaagggcgcatagnnnnnnnnnnnnnnnnnnnnnnnnnnnn

SEQ ID NO: 112260 - DNA, 124 bp, Homo sapiens; identical to SEQ ID NO: 112251
  misc_feature: GYAE6OF02JF6DY.29.3.A03.1.454.CMB.1.raw
  modified_base (124)..(124): a, c, t, g, unknown or other
  misc_feature (124)..(124): n is a, c, g, or t

SEQ ID NO: 112261 - DNA, 124 bp, Homo sapiens; identical to SEQ ID NO: 112251
  misc_feature: GYAE6OF02HH58K.29.3.A03.1.454.CMB.1.raw
  modified_base (124)..(124): a, c, t, g, unknown or other
  misc_feature (124)..(124): n is a, c, g, or t

SEQ ID NO: 112262 - DNA, 123 bp, Homo sapiens
  misc_feature: GYAE6OF02FK3TV.29.3.A03.1.454.CMB.1.raw
  modified_base (123)..(123): a, c, t, g, unknown or other
  misc_feature (123)..(123): n is a, c, g, or t
tcagatagagtactcacgaccggtgctcgatttagagagcgtcacaggggcacagcggccctgggctgcctggtcaaggactacttccgagtcgtctctgagcgggctggcaaggcgcatagn

SEQ ID NO: 112263 - DNA, 131 bp, Homo sapiens
  misc_feature: GYAE6OF02FZEWB.29.3.A03.1.454.CMB.1.raw
  modified_base (126)..(131): a, c, t, g, unknown or other
  misc_feature (126)..(131): n is a, c, g, or t
tcagatagagtactcacgaccggtgctcgatttagagagcgtcacagggggcgacagcggccctgggctgcctggtcaaggactacttccgagtgcgtctctgagcgggctggcaaggcgcatagnnnnnn

SEQ ID NO: 112264 - DNA, 125 bp, Homo sapiens
  misc_feature: GYAE6OF02FVN99.29.3.A03.1.454.CMB.1.raw
  modified_base (125)..(125): a, c, t, g, unknown or other
  misc_feature (125)..(125): n is a, c, g, or t
tcagatagagtactcacgaccggtgctcgatttagagagcgtcacagggggcacagcggccctgggctgcctggtcaaggactacttccgagtgcgtctctgagcgggctggcaaggcgcatagn

SEQ ID NO: 112265 - DNA, 563 bp, Homo sapiens
  misc_feature: GYAE6OF01CY8UR.21.30.C08.1.454.CMB.1.raw
  modified_base (243)..(243): a, c, t, g, unknown or other
  misc_feature (243)..(243): n is a, c, g, or t
  modified_base (456)..(456): a, c, t, g, unknown or other
  misc_feature (456)..(456): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaatttntgtttttggaccagcagaagtcaggccaggcccctgtgttggtcatccatgaggacaggagacgaccctccgggatcccgtgagagattctctggctccaactcagggacggtggccagttgattctcaggtcggggcccagggtggaggatgaagctgactactactgttactcagcagacagcagtggtcatcgagggggctagttcgggnggacgggaccgtagggttcgacccggttccgtaggttcgacggcccgaagggcctcggcccccgttcggctaccgttccgtcgttccccgccccttcccgttccccg

SEQ ID NO: 112266 - DNA, 525 bp, Homo sapiens
  misc_feature: GYAE6OF01A9X1D.21.30.C08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagtctgacgtcaaagggaaaggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganattcattgaccaaaagatatacttgttggttccagcagaagtcaggccaggccctgtactggtcatccatgaggccagtcgacgacactccgggatccctgagagattctctgcctccagctcagggacaggtggccactttgactatcagtgggcccaggtggacgatgaagctgactactattgtacgcaccagacagtagtggtacatcgaggggtattcgggcggagggacctaaggttcgaccgttcgttggtcaggcccaaggctcgcccccttggtccaccttctcgttccccaccc

SEQ ID NO: 112267 - DNA, 554 bp, Homo sapiens
  misc_feature: GYAE6OF01C0ZAE.21.30.C08.1.454.CMB.1.raw
  modified_base (244)..(244): a, c, t, g, unknown or other
  misc_feature (244)..(244): n is a, c, g, or t
  modified_base (419)..(419): a, c, t, g, unknown or other
  misc_feature (419)..(419): n is a, c, g, or t
  modified_base (540)..(540): a, c, t, g, unknown or other
  misc_feature (540)..(540): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattgaccaaaaaatttntgtttttggaccagcagaagtcaggccaggcccctgtgttggtcatccatgaggacaggagacgaccctcgggatccctgagagattctctggctccaactcgaggggacggtggcctacgttgattctcaggtggggcccaggtggaggatgaagctgactactactgttactnagcagacagcagtggtcagtcgaggggctaggttcgggcggagggaccgagggttcgaccgtcgtacggtcacggcccgaaggcgtccgcccccgtcggtccaccgttcgtccgttccccncccgtcccttcccg

SEQ ID NO: 112268 - DNA, 531 bp, Homo sapiens
  misc_feature: GYAE6OF01B98NR.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgatctggagatgcattgaccaaaaaatttntgtttttggaccagcagaagtcaggccaggcccctgtgttggtcatccatgaggacaggagacgaccctcgggatccctgagagattctctggctccaactcgagggacggtggccacgttgattctcagtggggcccagggtggaggatgaagctgactatactgttactcagcagacagcagtggtcagtcgaggggcagttcggcggagggaccgaggttgaccgtcgtaggtcgacgcccaaggctcggcccctcggtccactctcgttcccgccctcctcccg

SEQ ID NO: 112269 - DNA, 560 bp, Homo sapiens
  misc_feature: GYAE6OF01B5ZUW.21.30.C08.1.454.CMB.1.raw
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
  modified_base (333)..(333): a, c, t, g, unknown or other
  misc_feature (333)..(333): n is a, c, g, or t
  modified_base (417)..(417): a, c, t, g, unknown or other
  misc_feature (417)..(417): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaatttntgtttttggaccagcagaagtcaggccaggcccctgtgttggtcatccatgaggacaggagacgaccctccgggatccctgagagattcnctggctccaactcgagggacggtgccacgttgattctcagtcggggcccagggtggaggatgaagctgactactactgttactnagcagacagcagtggtcagtcgaggggcagttcgggcggagggaccaggttcgaccggtccgtaggtcacggcccgaaggccgtcgccccccgtcggttccaaccgttccgttcggttcccccgtccccgttcccgttccccg

SEQ ID NO: 112270 - DNA, 539 bp, Homo sapiens
  misc_feature: GYAE6OF01CHQLP.21.30.C08.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagtctgacgtcaaagggaaagggggtgggctcaggaggcagagctctgggaatctaaccatggcctggacccctctcctgctcccctcctcactttctgcacagtctctgaggcctcctatgagctgacacagccaccctcggtctcagtgtccccgggacaaacggccaggatcacctgctctggagatgcattgaccaaaaaattnttgtttttggtaccagcagaagtcaggccaggcccctgtgttggtcatccatgaggacaggagacgaccctccgggatccctgacgagattctctggctccaactcagggacggtggccacgttgattctcgagtggggcccaggtggaggatgaagctgactactactgttactcagcagacagcagtgtcatcgaggggcagttcgggcggagggaccgaggttcgaccgtcgtaggtcagcccgaaggctcggccccctcggtcactctcgttccccgccctccgtcccttcccg

SEQ ID NO: 112271 - DNA, 778 bp, Homo sapiens
  misc_feature: GYAE6OF01BZU4T.21.30.C08.1.454.CMB.1.raw
tcagtcgtcgctcgcacgaccggtgctcgatttagtctgacgtcaaagggtaagggggttggggctccaggaggcacgagctcgtgggaatctcgacctatggtcctggacccctctcctgctcccctccgtcaccttctgccacacgtctcctgacggtccttcctactgagtcctggacaccgagccaccctcggtcctcgagtcgtccccgggacaaacgggccaggatcgacgtagctcgtggagatgacattcgaacctaaaaaagtttgttgtttttggaccagcagtagtccagccaggccctgtcgttggtcactccagtgaggacgaggcgacggaccgtcgggactcccgtagagacgtactttcctacgtcggtacctaccctacgtccggaacgggtacccggtacggacccgtaaccggttcgtacctttccgtaccgaacgggttccggggaacccgtagggtacgggaacgggtacttacggtaacgtccgttacggtaaccttaaccgttaacgttacgttaaccgtaccgtacggtacccttaaggaccgacggtacggtacggtacggtaccgtacggtacgggaacgggggtcctaacggggttacccgggaccgggtaacggaacggttacgggttacggtacccggttaccgtaaccggtaccgaaccggtcccgaaagggtcccgtcccgacccccgttaccgtaccgttaccgttccgttacccgttcccccgttacccgttcccgttaccccgg

SEQ ID NO: 112272 - DNA, 538 bp, Homo sapiens
  misc_feature: GYAE6OF01AO2AG.21.30.C08.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagtctgacgtcaaagggaaaggggtgggctcaggaggcagagctctgggaatctcaccatggcctggacacctctcctgctcccctcctcactttctgcacagtctctgaggcctcctatgagctgacacagccaccctcggtctcagtgtccccgggacaaacggccaggatcacctgctctggagatgcattgccaaaaaattntgttttttggaccagcagaagtcaaggccaggcccctgtgttggtcatccatgaggacaggagacgaccctccgggatccctgagagattctctggctccaactcgagggacgtggccacgttgattctcaggtgggcccagggtggaggatgaagctgactatactgttactcagcagacagcagtgtcatcgaggggcagttcggcggaggaccgagggttgaccgtccgtaggtcacggcccgaaggctcggaccccttcgggtcctaccgttcgtcgttccccgcccgttccccg

SEQ ID NO: 112273 - DNA, 623 bp, Homo sapiens
  misc_feature: GYAE6OF01DGVF0.21.30.C08.1.454.CMB.1.raw
  modified_base (248)..(248): a, c, t, g, unknown or other
  misc_feature (248)..(248): n is a, c, g, or t
  modified_base (450)..(450): a, c, t, g, unknown or other
  misc_feature (450)..(450): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtcccgggacaaacggccaggatcacctgctctggagatgctattagaacctaaaaaaatttnttggttttttaggaccagacagaagtcaggccacggccctgtactggtcatccatgaggccagtcgacgacacgtccgggatccctagagagtacttctctcgcctcagctcgagggacaggtcggaccacttgactatcgaggtcgggcccaggtggacgagtagaacgctagtaacttactagttcgttacgacaccganacgtagtagtgactagtcggtaggggtacttcgggacggtaacgggtacctaaggttccgtaaccggttccgttcggtaccacggtaccccgaagggcccgtaccggtccccccgttcggttaccctaccgttacccgttcccggtttcccccgtccccgttcccttccccgg

SEQ ID NO: 112274 - DNA, 762 bp, Homo sapiens
  misc_feature: GYAE6OF01ENVMA.21.30.C08.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtcccgggacaaacggccaggatcacctgctctggagatgcattgaccaaaaaattntgtttttggtaccagcagaagtcaggccaggcccctgtgttggtcatccatgaggacaggagaccgaccctccgggatccctgagagattctctggctccaactcgagggacgtcggaccacgttggactttcgtacgacggtcggggccctaggggtgggaacgggtagttaggaacggtccgttagggtaacctttaaccgttaacgttacggtttaaccttacgaagaccaaggtaaccaaggtacccgtaagggtttacgggttaccaaggttcccgggaagggggggtcctaaacgggtttccggggaaccgggggtaacggggtaacccgtaacgggggtttccgggtaacccgggttacccgttaacggggtacccgtaaccgggtaacccccgaaaagggggtccccttacccggggtaccccccccccgttccggggttaaccccgtaaaccccgtttccggttaccccggtttttccccccgaaccccccgtttccccgtttaccccccgg

SEQ ID NO: 112275 - DNA, 717 bp, Homo sapiens
  misc_feature: GYAE6OF01DLYWQ.21.30.C08.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgganaaacggccaggactcacctgctctgganatgctattgaccaaaagtatatacttgttgtccagcagagtcaggccacggccctgtactggtcatccagtgacgccagtccgacgacaccgtccgggatcccgtaggacgtagtacttcgtctcgtccctccgaagcctacgaacggggactaggtcggacccctaaccgttcggtaaccttagtaccggaacgggtccggggacccgtaaggggtacgggaacgtacgtaggtaacgtcgttacgtaaccttaacgttacgtttacggttaaccgtaccgtaaccctaacggaacgtaaggttaacgggttcggtaacgtacggttacgggtaacgggggttacggttaccgggggacgggtacgggtaaccgtaacgggttacggtaacccggttccggttccgggtaccgtaccggacccggtacggtccccgtcccggtaccccccgttcggtaccctaccgttcccgttcccgttcccccctaccccg

SEQ ID NO: 112276 - DNA, 559 bp, Homo sapiens
  misc_feature: GYAE6OF01CRM9Q.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattttgtttttggaccagcagaagtcaggccaggcccctgtgttggtcatccatgaggacaggagacgaccctccgggatccctgagagattctctggctccaactcgaggggacggtggccacggtttgatttctcaggtcggggcccagggtggaggatggaagctgactactactgttactctagcagacagcagtggtcagtcgagggggcagttcggcgggagggaccgagggttcgaccggtccgtacggtcgacgcccgaaggccgtcgcccccgtcggtcctactccgtcgttccccgcccctccgttccccg

SEQ ID NO: 112277 - DNA, 551 bp, Homo sapiens
  misc_feature: GYAE6OF01CHM21.21.30.C08.1.454.CMB.1.raw
  modified_base (243)..(243): a, c, t, g, unknown or other
  misc_feature (243)..(243): n is a, c, g, or t
  modified_base (536)..(536): a, c, t, g, unknown or other
  misc_feature (536)..(536): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaatttntgttttttggaccagcagaagtcaggccaggcccctgtgttggtcatccatgaggacaggacgacgaccctccgggatccctgagagattctctggctccactcgagggacggtggccagttgattctcaggtcggggcccagggtggaggatgaagcgtgactactactgttactcagctagacagcagtggtacagtcgaggggcaggttcggcgggacggacgaggttcggaccgtcgtaggtcgacgcccgaggcctccgccccgtcgtccaccgttctccgttccccncccgtccgtacccgg

SEQ ID NO: 112278 - DNA, 555 bp, Homo sapiens
  misc_feature: GYAE6OF01BCSGI.21.30.C08.1.454.CMB.1.raw
  modified_base (421)..(421): a, c, t, g, unknown or other
  misc_feature (421)..(421): n is a, c, g, or t
tcagtcgtcgctcgcacgaccggtgctcgatttagtctgacgtcaaagggaaaggggtgggctcaggaggcagagctctgggaatctaaccatggcctggacccctctcctgctccccctcctcactttctgcacagtctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctcagagatccctgagcgattctctggctccagctcagggacagcagtcacgttgactatcagtgaatccgaggcagaggacgaggctgaactattactgtacaaacagtanaacaagtagaaggtactacgtagttgggtgttcgggacgggacgggaaccgaaggccgtaggaacccggttcccgtacgggttaccgacggtaccccgaaacgggccttcccggccccccgttcgggtaccccg

SEQ ID NO: 112279 - DNA, 553 bp, Homo sapiens
  misc_feature: GYAE6OF01CLNRY.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaagatatacttgttgtccagcagaagtcaggccaggccctgtactggtcatcatgaggccagtcgacgacactccgggatcccgtgagagtattctctgccctccagcctcgagggacaggtcggccctaccttgactagtcgaggtcgggacccgagggtcgacgatggaagctagactatattgttacgcaccagacagtagtggtacagtcgaggggttattcgggaggacgggacgtaagttcggaccgttccgttggtcaggacccgaaggcctccgcccccgtcggtcctacctccttccgttcccctaccc

SEQ ID NO: 112280 - DNA, 531 bp, Homo sapiens
  misc_feature: GYAE6OF01BOAGP.21.30.C08.1.454.CMB.1.raw
  modified_base (241)..(241): a, c, t, g, unknown or other
  misc_feature (241)..(241): n is a, c, g, or t
  modified_base (521)..(521): a, c, t, g, unknown or other
  misc_feature (521)..(521): n is a, c, g, or t
tcagtcgtcgctcgcacgaccggtgctcgatttagtctgacgtcaaagggaaaggggtgggctcaggaggcagagctctgggaatctcaccatggcctggacacctctcctgctccccctcctcactttctgcacagtctctgaggcctcctatgagctgacacagccaccctcggtctcagtgtccccgggacaaacggccaggatcacctgctctggagatgcattgaccaaaaaattnttgtttttggaccagcagaagtcaggccaggcccctgtgttggtcatccatgaggacaggagacgaccctccgggatccctgagagattctctggctccaactcagggacggtggccacgttgattctcaggtgggcccaggtggaggatgaagctggactactactgttactcagcagacagcagtgtcagtcgaggggcagttcgggcggagggaccaggttcgaccgtcctaggtcacgcccaaggcctcgccccctcggtcaccgtctcgttcccncccttccccg

SEQ ID NO: 112281 - DNA, 570 bp, Homo sapiens
  misc_feature: GYAE6OF01EHITW.21.30.C08.1.454.CMB.1.raw
  modified_base (242)..(242): a, c, t, g, unknown or other
  misc_feature (242)..(242): n is a, c, g, or t
  modified_base (553)..(553): a, c, t, g, unknown or other
  misc_feature (553)..(553): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgttttttggaccagcagaagtcaggccaggcccctgtgttggtcatccatgaggacagggagaccgaccctccgggatcccgtgagagattctctggctccaactcaggggacggtggccacgttgattctcaggtcggggcccagggtggaggagtgaagctgactactactgttactcagcagacagcagtggtcagtcgaggggcagttcgggcgggagggaccgagggttcgaccgtccgtagggtcacggcccgaaggccgtccggcccccgtcggtacccgtaccgttccgttccgttcccccncccgttcccgttccccg

SEQ ID NO: 112282 - DNA, 604 bp, Homo sapiens
  misc_feature: GYAE6OF01BKUQW.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaattnttgttttttggaccagcagaagtcaggccaggcccctgtgttggtcatccatgaggacaggagacgacccgtccgggatcccgtgagagattctcgtggcctccaactcgacgggacggtcggcctacggttgtacttcgtcgaggtcggggcccagggtggaggagtggaagcgtagactactactgttactcgagcagacagcaggtgtcagtcgaggggctaggttcgggcgggtacgggaccgtagggttcgaccgtccgtacggtaccgacggccccgtaagggcccgtccggcccccgttcgggtaccctaccgttcccgttcccgttcccccgtaccccgttccccgttccccg

SEQ ID NO: 112283 - DNA, 514 bp, Homo sapiens
  misc_feature: GYAE6OF01CBUUW.21.30.C08.1.454.CMB.1.raw
  modified_base (240)..(240): a, c, t, g, unknown or other
  misc_feature (240)..(240): n is a, c, g, or t
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
tcagtcgtcgctcgcacgaccggtgctcgatttagtctgacgtcaaagggaaaggggtgggctcaggaggcagagctctgggaatctcaccatggcctggacccctctcctgctccccctcctcactttctgcacagtctctgaggcctcctatgagctgacacagccaccctcggtctcagtgtccccggacaaacggccaggatcacctgctctggagatgcattgaccaaaaaattntgtttttggaccagcagaagtcaggcaggccctgtgtgtcatccatgaggacagganacgaccctcgggatccctgagagattctctggctcaactcagggacgtgcacgtgatcnagtgggccaggtggagatgaagctgactacactgtactcagcagacagcagtgtcatcgaggggcagttcggcggagggaccagggtcgaccgtcctacggtcacgcccaaggcctcgacccccgtcggtcacctctcgtcccaccctccgtacccgg

SEQ ID NO: 112284 - DNA, 588 bp, Homo sapiens
  misc_feature: GYAE6OF01BLFM9.21.30.C08.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgaggcctcctatgagctgacacagccaccctcggtctcagtgtccccggganaaacggccaggatcacctgctctgganatgcattgaccaaaaaatttntgttttttaggaccagcagaagtcaggccaggccctgtgttggtcatccatgaggacaggagaccgaccctcgggatcccgtgagagacttctcgtggctccaactcgagggcgtgccacgttgatttcgtacgaggttcggggcccagggttcggaggtagtaggaagctaggtacttacgtactgttactcgtagacgagacgagccagtgtacagtcggaggggcacgttcgggacggagggaccgaggttcgaccgtcgtacggtcgacggcccgaaggccgtccggcccccgtacggtcctaaccgtccttaccgttccccaccccgttccgtaccccggg

SEQ ID NO: 112285 - DNA, 608 bp, Homo sapiens
  misc_feature: GYAE6OF01DFVRN.21.30.C08.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtcccgggacaaacggccaggatcacctgctctggagatgcattgacctaaaaaattnttgtttttaggaccagcagaagtcaggccaggcccctgtgttggtcatccatgaggacagggagaccgacccgtccgggatcccgtgagagattctcgtggctccaactcgagggacggtggcctacggttgacttctcgaggtcggggcccagggtcggaggataggagctgactactactgttactcagcagacagcgaggtcggtacagtcgagggggtctaggttcgggacgggacggggtaccgtaggggttcgacccggtccgtacgggtccgacggaccccgtaaggccgtccgcccccccgttcgggtaccctacccgttccgttccggttcccccctaccccttccccgttaccccg

SEQ ID NO: 112286 - DNA, 564 bp, Homo sapiens
  misc_feature: GYAE6OF01AE2UY.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaattntgttttttggaccagcagaagtcaggccaggcccctgtgttggtcatccatgaggacaggagaccgaccctccgggatccctgagagattctctggctccaactcgagggacggtcggcctacgttgattcgtcgaggtcggggcccagggtggagggagtaggaacgctgactactactgttactcagcagacagcagtgtcagtcgaggggcagttcgggacgggacgggaccgtaggttcgaccgtcgtacggtcacgcccgaaggccgtccgcccccgttggcctacctccgtccgttcccctcccttccctccccg

SEQ ID NO: 112287 - DNA, 679 bp, Homo sapiens
  misc_feature: GYAE6OF01AV249.21.30.C08.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaattnttgtttttggaccagcagaagtcaggccaggccctgtgttggtcatccatgaggacaggacgaccgacccgtccgggatcccgtgagagattctctggctaccaactcgagggacggtcggcctacgttgacttcgtcgtacggtcggggacccgtagggtcgggaacggtagtaggaacgtcgtacgtaaccgttaacgttacgttacggttaacctcgtaacgccgtaagaaccgacgtacgtaggttcggtacgtaacgtacggagggggacctacggttccggggacgggacggggaccttagggttcgtaacccggtccgtacggtacgaccggacccggtaacggtcccgtacccggtccccccgttacggtaccctacccgttccgttacccggttaccccctaccccgttccccgttccccgttacccgg

SEQ ID NO: 112288 - DNA, 564 bp, Homo sapiens
  misc_feature: GYAE6OF01AJ9G7.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaaattntgttttttggaccagcagaagtcaggccaggcccctgtgttggtcatccatgaggacaggagacgaccctccgggatccctgagagattctctggctccaactcagggacgtggccacgttgattctcgagttcggggcccagggtcgaggatgaagctgactactactgtactcagtcagacagcagtggtcagtcgaggggcagttcgggcggacgggaccagggttcgaccggtccgtacggtcgacggccccgaagggcctcggcccccctcgggtaccctaccgtcttccgttccccctcccgttcccgttccccg

SEQ ID NO: 112289 - DNA, 619 bp, Homo sapiens
  misc_feature: GYAE6OF01CR1GU.21.30.C08.1.454.CMB.1.raw
  modified_base (481)..(481): a, c, t, g, unknown or other
  misc_feature (481)..(481): n is a, c, g, or t
  modified_base (503)..(503): a, c, t, g, unknown or other
  misc_feature (503)..(503): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgacggcctcctatgagctgacacagcccaccctcggtctcagtcggtccccgggacaaacggccaggactccacctgctcgtggagatgactatttacgaaacctaaaaaaattttgtttaggttttttacggtaccagtacgaagaaagttcaggcccaagggccccctgtgttggtcatccatgaggacagggagaccgacccgtccgggactcccgtgagagtattctcgtcggctaccaactcgacgggtacggtcggaccctagttcgacttctcgagggtcggggcccagggtcgggaggagtaggagtcgtagacttacgtactgttacncgagtcaagcagctagtgtacngtcgaggggctacggttcggacgggacggaccgtaggttcgacccgttcgtacggtcgacgacccgaagccgtccgcccccgtgtccacgttcctcgttccccgcctcccttcccg

SEQ ID NO: 112290 - DNA, 648 bp, Homo sapiens
  misc_feature: GYAE6OF01DPHDJ.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattgacctaaaaaatttnttgtttttggaccagcagaagtcaggccaggcccctgtgttggtcatccatgaggacaggagaccgacccgtccgggatccctagagagtacttctcgtcggctaccaacttcgacgggtacggtcggcctacggttgtacttctacgtaggtcggggccctagggtcgggaaggtagtaggaaggcgtagaacttacgttaacgttcggttaactcgacgtacgtaacgacgtacggctaaggttcggtacaacgtcggaacgggggtctaggttccgggacgggtacgggaccggtaggttaccgtaccggtccgtacgggtaccgacggcccgaagggcctccggaccccccgttcgggtactaccgtccgttaccgttcccccaccctcccgttccccg

SEQ ID NO: 112291 - DNA, 640 bp, Homo sapiens
  misc_feature: GYAE6OF01BQQUV.21.30.C08.1.454.CMB.1.raw
  modified_base (249)..(249): a, c, t, g, unknown or other
  misc_feature (249)..(249): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtctcagtcgtccccgggacaaacggccaggatcacctgctcgtggagatgctattgaacctaaaaaatttnttggttttttacggaccagcagaagtcaggccaggcccctgtgttggtcagtccatgaggacaggagaccgacccgtccgggactcccgtgagagtattctctggctccaactcgagggacggtggcctacgttgattctcgaggtcggggcccagggtcggaggtagtaggaagccgtagtacttactacgttagttacctcgagtcaagacagccaggtgtacagtcgaggggctacggttcgggcgggacgggaccgtagggttacgacccggttacgtacgggtaccacggacccgtaagggtcccgttcccggaccccccgtttccggtttaacccttccgttacccgttaccccccctacccgttccccgtcccgggtaacccgg

SEQ ID NO: 112292 - DNA, 826 bp, Homo sapiens
  misc_feature: GYAE6OF01DN267.21.30.C08.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaatttnttgttttttaggaccagcagaagtcaggccaggcccctgtgttggtcatccatgaggacaggacgaccgacccgtccgggatcccgtgagagtacttctctcggtctacccaactccggaaggggtaccgggttcggcccgtaacgtttcgtaactttcgtacgtagggtccggggggtaccccgtaagggggttacgggacgggtaaggttacgggaaaggtccgttacggtaaacccgtttaaaccgttaccggtttacggttttaaccgttaccgtaacggtaccgtaaacgggaaccgtaaggtacccgtaagggtttacgggtaccgtaagttaccgggaacggggggggtacctaacgggtttaccgggggaccggggtaacggggtaacccggttaggggttaccggtaacccgggttaccggtaacggggtaccgaaacccggtaccccgggtaaagggtccccggttccccgggtccccccccggttacccgggtacccgttaaccccgtttaccccgttaccccggttttacccccccgtaaccccccgtttccccggttaaccccccgggg

SEQ ID NO: 112293 - DNA, 583 bp, Homo sapiens
  misc_feature: GYAE6OF01EXDAR.21.30.C08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagtctgacgtcaaagggaaagggggtggggctcaggaggcagagctctgggaatctcaccatggcctggaccctctcctgctccccctcctcactttctgcacagtctctgaggcctcctatgagctgacacagccaccctcggtctcagtcgtcccgggacaaacggccaggatcacctgctctgganattcattgaccaaaaagatatactttgttggttccagcagaagtcaggccaggcccctgtactggtcatccatgaggccagtcgacgacactccgggatcccgtgagagtacttctctcgcctccagctcgagggtacaggtcggcctaccttgactatcgaggtcggggacccaggtcggacgataggaagcgtagtacttaactatttcgttacgctaacagacagtagtgtcagtcgaggggttatcgggcggagggaccaagttcggaccgttcgttcggacgacgacccgaaggtcccgtaccggtcccccctcggtcctaccgttccgttcccggttcccccgcccgttcccccg

SEQ ID NO: 112294 - DNA, 578 bp, Homo sapiens
  misc_feature: GYAE6OF01BWI7P.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaatttnttgtttttggaccagcagaagtcaggccaggcccctgtgttggtcatccatgaggacaggagaccgaccctcgggactccctgagagattctctggctccaactcagggacggtggcctacgttgattctcgagtggggcccagggtggaggatgaagctgactactactgttactcgagcagacagcgagttggtacagtcgagggggcaggttcgggcgggagggaccgagggttacgaccggtccgtacggtcgacggacccgaaggcgtccggccccccgttacgggtcctaccgttcgttccgttccccctacccgttccccgttccccg

SEQ ID NO: 112295 - DNA, 642 bp, Homo sapiens
  misc_feature: GYAE6OF01DND4Y.21.30.C08.1.454.CMB.1.raw
  modified_base (248)..(248): a, c, t, g, unknown or other
  misc_feature (248)..(248): n is a, c, g, or t
  modified_base (464)..(464): a, c, t, g, unknown or other
  misc_feature (464)..(464): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacagccaccctcggtctcagtcgtccccgggacaaacggccaggactcacctgctctggagatgcattgaacctaaaaaatttnttgtttttacggaccagtacaagaagtcgacggccacggcccctgtgttgtcatccatgaggacaggacgaccgacccgtccgggactcccgtgagagtacttctcgtggctccaactcgagggacggtcggcctacgttgacttctacgtaggtccggggacccgtagggttcgggaaggtagtaggaacgcgtagacctacgttacgtgttacncgtagacagacagctaggtcgtacagtcggaggggtctaggttccgggacgggacggaccgtagggttcgaacccggttcgtacggtaccacggccccgtaagggtcccgtccggaccccccgttcggtaccctaccgttccgttacccgtttcccccgtccccgttccccgttcccg

SEQ ID NO: 112296 - DNA, 613 bp, Homo sapiens
  misc_feature: GYAE6OF01CYNY8.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacacctctcctgcctccccctcctcactttctgcacagtctctgaggcctcctatgagctgacacagcccaccctcggtgtcagtcgtccccaggacaaacggccaggatcacctgctcgtggagtattcattcgaaccaaaagatatacgtttgttggttccagcaaggaagtcaggccacggccctgtacgtggtcactccatgacggccaggtcgacgacaccgtccgggatcccgtagagagtattctctcgccctcagctcgagggactaggcggacctaccgttgactatcgaggtcggggacccgtagggtacggacgatagaacgtctagactacttacttcgtacgcaaccgagacgtagtaggtcggtacagtcggtaggggttcttcggggcggaacgggtaccgtaaggtccgtaccggttccgttcggtacacggaccccgaagggtcctcccggtcccccggttacggtacctaccgttccgttcccggttccccccg

SEQ ID NO: 112297 - DNA, 609 bp, Homo sapiens
  misc_feature: GYAE6OF01E26AY.21.30.C08.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (592)..(592): a, c, t, g, unknown or other
  misc_feature (592)..(592): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctgganatgcattcgaacctaaaaaatttnttgttttttggaccagcaagaagtcaggccacggccctgtgttggtcactccatgaggacgaggacgacgacccgtccgggactcccgtgagagtattctcgtggctccgaactcgagggacggtcggcctacgttgacttctcgacggtcggggcccagggtggagggtagtacggaagcgtagtacctacttacgtcgttactcagcagacagcgtagtgtcgacgtcgacggggtcacggttcgggcgggaggaccggtaggttcggaccgtcggtacggtccgacggcccgaaggccgtccggtcccccgtcggtcccgtaccttccgttcccgttaccccncccgtcccgttaccccg

SEQ ID NO: 112298 - DNA, 745 bp, Homo sapiens
  misc_feature: GYAE6OF01DJ95E.21.30.C08.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagtctgacgtcaaagggaaaggggtgggctcaggaggcagagctctgggaatctaaccatggcctggacccctctcctgcctcccctcctcactttctgcacagtctctgaggcctcctatgagctgacacagccaccctcggtctcagtcgtccccggacaaacggccaggatcacctgctctggagatgcattgacctaaaaattnttgtttttgacctagcagagtcgagccaggtccctgtcgtcggtcagtccagtgacggacgaggacgaccgacccgtcggactcccgtgagagtacttcgtcgtcggcctaccgacgtcgacgggacggtcggacctacggttgtacttcgtacggtacgggtccggggccgtaggggtcgggaaggtagtacggaacggtcgtacgaaccttaacgttaaccgttacgtttaaccgtacgaacggtaccgaacggtaacccgtaggtaccgtaaggttcggtaacgtacggtaccgggaacgggggttacctaccggggtttccgggggaaccgggtaaccggggttacccgtacggggttacccgggtaacccggttacccggttacgggtacccgaccggaacccgggtaacggtcccggtccccggtccccccgttacgggtacccctaccgttcccgttacccgttacccccgacccccttcccgtcccgtttccccgg

SEQ ID NO: 112299 - DNA, 653 bp, Homo sapiens
  misc_feature: GYAE6OF01EJ38Y.21.30.C08.1.454.CMB.1.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtcgtccccgggacaaacggccaggatcacctgctctgganatgcattgacctaaaaaatttnttgttttttaggaccagcagaagtcaggccaggcccctgtgttggtcatccatgaggacaggagacgacccgtcgggactcccgtgagagacttctctggctccaactcgaggggacggtcggctacgttgacttctcgaggtcggggcccagggtggaggtagtaggaagcttagaccttacgttacgtgttaacctcaacgcaagacaggctaggtggtacagtcggaaggggtctaggttccgggacgggtacgggaccgtagggttaccggaacccggttaccggtacgggttacccgaacgggaccccgtaaagggtccccgtacccggtccccccggtcgggttccctacccgttcccgttacccgttacccccaccccgtttcccctccccgtttaccccg

SEQ ID NO: 112300 - DNA, 589 bp, Homo sapiens
  misc_feature: GYAE6OF01E38SY.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtctcagtcgtccccgggacaaacggccaggatcacctgctctggagattcattgaccaaaagatatacttgttgtccagcagaagtcaggccaggcccctgtactggtcatccatgaggccagtcgacgacacgtccgggactcccgtgagagattctctcgccctccagcctcgagggacagtcggacctaccttgactatcgaggtcggggacccagggtcggacgagtggaagtcgtacgacttactatttgttacgcaccagacagtagtcggtcagtcggagggggttacttcgggacggacgggacctaaggttcgacccgttccgtggtaccgacggacccgaacggtccgtcccgcccccgttcggtcctacctccgttccgttccccgtaccccgttccccg

SEQ ID NO: 112301 - DNA, 840 bp, Homo sapiens
  misc_feature: GYAE6OF01CEE5T.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacacctctcctgcctccccctctcactttctgcacagtctctgacggcctcctatgagctgacacacgcccacccgtggtgtcagtcgtcccaggacaaacggcaggatcactgctcgtggatattcaatcgaaccaaaagtatatacttggttcgtccagcagaagtcgaggccacggtccctgtacctggtacactcagtgacgccagtccgaacgacaccggtccggactcccgtaggaacgtacgttacttccgtcgttcgacccttaccgaaggtcctacggaaacgggtacctacggggtccggtaccctaacgtttggaaactttacggtacgtacggggttcggggtacccgtaaggggttacggaaccgtaagtacggtaacgtaccggttacgtaaccgtttaacgttaacggtttaaccgttaacccggtaaccgtaaacccgtaacgggtaaaccgttaagggtttaaacgggttacgggttaacccgtaagggtttaaccgggggtaaaggggggtttaaccggtttaaccggggggaccgggggttaaaaccggggtaaacccggttaaagggtttacccgggtaacccgggtttaccggtttaccggggtaacccgttaacccgggtaaccccggtaaacgggtcccccgttaccccgggttaccccccggttaacggttaccccgtaaccccgtttcccggtttacccccgggttcccccccg

SEQ ID NO: 112302 - DNA, 552 bp, Homo sapiens
  misc_feature: GYAE6OF01DSQFY.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctaaccatggcctggaccccctctcctgcctccccctcctcactctctgcacaggctctgaggcctcctatgagctgacacagccaccctcggtgtcagtcgtccccaggacagacggccaggatcacctgctctgcagatggactgaccaaaagaatntgacttattaggtaccaacagaacgccaggccacggcccctgtacgttagtgatataataaacgacacgtgagacggccctacgagagactcccgtagacgcgtattcctctggcctccgagcctacgagggtacacgcagtactacgttagacttatacagtagaacgtcccgaggcaaggacggacgaggtctagaacttatacgtagtacaaacgtagtaagacgagtaagacgtactagtagttgggtgtcgggcggaaggacgagcgtcgccgtacgtagcacgccaaggctccgcccgtcg

SEQ ID NO: 112303 - DNA, 631 bp, Homo sapiens
  misc_feature: GYAE6OF01DIHVD.21.30.C08.1.454.CMB.1.raw
  modified_base (109)..(109): a, c, t, g, unknown or other
  misc_feature (109)..(109): n is a, c, g, or t
  modified_base (199)..(199): a, c, t, g, unknown or other
  misc_feature (199)..(199): n is a, c, g, or t
tcagtcgtcgctcgcacgaccggtgctcgatttagtctgacgtcaaagggaaagggggtgggctcaggaggcagagctctgggaatctaaccatggcctggaccccctntcctgctccccctcctcactttctgcacagtctctgaggcctcctatgagctgacacagcccaccctcggtctcagtcgtcccccggganaaacggccaggatcacctgctctggagatgcattgaccaaaagatatacttgttgtccagcagaagtcagccacggccctgtactgtcatccatgaggccagtcgacgacaccgtccgggactccctgagagacttctctcgcccttccagctcgaagggacagtcggaccctacgttgaaccttagtccgagggtccggggcccgtagggtcggaagttggagtggaagcgtagtaccttaacttagtttacgttaccactaccgaagacaggttagtgtacagtacggtagggggttattccggggacgggacgggtaaccgtaaggttacggtacccgttccgttcgggtccgacggcccgaacgggtcccgtaccggtccccccgttcgggtaccacccgttccgttcccgtttcccccgtccccccg

SEQ ID NO: 112304 - DNA, 555 bp, Homo sapiens
  misc_feature: GYAE6OF01CMX6D.21.30.C08.1.454.CMB.1.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
  modified_base (392)..(392): a, c, t, g, unknown or other
  misc_feature (392)..(392): n is a, c, g, or t
tcagtcgtcgctcgcacgaccggtgctcgatttagtctgacgtcaaagggaaagggggtgggctcaggaggcagagctctgggaatctaaccatggcctggacccctctcctgcctccccctcctcactttctgcacagtctctgaggcctcctatgagctgacacagccaccctggtctcagtgtccccggganaaacggccaggatcacctgctctggagatgcattgaccaaaaaattntgttttttggaccagcagaagtcaggccaggcccctgtgttggtcatccatgaggacaggagacgaccctccgggatccctgagagattctctggctccaactcgagggacgtggccacgtttgattctcagtggggcccagggtggagngtgaagctagactactactgttactcagcagacagcagtgtcagtcgaggggctagttcgggacggagggaccgtagggttcgaccggtcgtaggtcgacgacccgaacggctccggcccccgtggtccacgttcctcgttaccccaccctccctccttcccg

SEQ ID NO: 112305 - DNA, 586 bp, Homo sapiens
  misc_feature: GYAE6OF01EOVQB.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccccctcctcactttctgcacagtctctgaggcctcctatgagctgacacagccaccctcggtctcagtgtccccgggacaaacggccaggatcacctgctctggagatgcattgacctaaaaaaattntgttttttggaccagcagaagtcaggccaggcccctgtgttggtcatccatgaggacaggagacgaccctcgggatccctgagagattctctggcctccaactcgagggacggtcggccgacgttgactttcgtcgagttcggggacccagggtcggagggagtgaagctgactactacgtagttactcagctagacgagcgagtggcagtcgagggggtcagttcgggacgggagggaccgagggttcgaccggtaccgttaggcgacggcccgaaagggccgtccgcccccgtacggtcctaccgttcctaccgttccccctacccgtcccgtacccgg

SEQ ID NO: 112306 - DNA, 711 bp, Homo sapiens
  misc_feature: GYAE6OF01BV2UY.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtcgtccccgggacaaacggccaggactcacctgcctctggagatgcattgacctaaaaattnttgtttttggaccagcagaagtcaggccagccctgtgtgtcatccatgaggacagggacgaccgacccgtccggggacttccccgtaggaacgacgtatttccgtcgttcgggaccttacccaaccgttcgaacgggggtaccggtcgggaccctacggtttagaactttccgcgtacgggtcggggacccgtagggtggacgggtacgtaggaacgcgttaggaccttaacgttacgtagtttaacctcgaacgcgaacgacgacggtctaaggtcggtacgacgggttccgggggctaaccgggttcgggacgggtacgggaccgttagggttcgaccggttccgtacggttcgaccggtacccgaacgggtcccgttaccggccccccgttcgggtacccttacgtttcccgttacccggttcccccgttaccccgtccccgtttcccgtccggtttaccccg

SEQ ID NO: 112307 - DNA, 686 bp, Homo sapiens
  misc_feature: GYAE6OF01A8TOD.21.30.C08.1.454.CMB.1.raw
  modified_base (249)..(249): a, c, t, g, unknown or other
  misc_feature (249)..(249): n is a, c, g, or t
  modified_base (666)..(666): a, c, t, g, unknown or other
  misc_feature (666)..(666): n is a, c, g, or t
tcagtcgtcgctcgcacgaccggtgctcgatttagtctgacgtcaaagggaaagggggtgggctcaggaggcagagctctgggaatctaaccatggcctggacccctctcctgcctccccctcctcactttctgcacagtctctgaggcctcctatgagctgacacagcccaccctcggtctcagtcgtccccgggacaaacggccaggactcacctgctctggagatgcattgaacctaaaaaatttntttgtttttaggaccagcaagaagtcaggccacggcccctgtgttggtcatccatggaggacgaggacgaccggaccccgtccgggactcccgtaggagacgtacttccgtcgtcggcctacccaacgtcgaggggacggtcggccctagttgacttcgtacgagggtcggggcccgtagggtcggaggagtaggaacgtcgtacgtaccttacttacgttagttacctacgagtacgaagacgacgacgtacggttcggtaccaggtacgggacgggggtacctacgggtaccggggacgggaacggggtaccgtagggttaccgacccggttaccgttagggtcccgaaccggacccggtaacggtcccgtacccggtcccccgtggtccctaccgttccgtcccgttacccccnccccgttccctcccgtcccg

SEQ ID NO: 112308 - DNA, 787 bp, Homo sapiens
  misc_feature: GYAE6OF01C6796.21.30.C08.1.454.CMB.1.raw
  modified_base (254)..(254): a, c, t, g, unknown or other
  misc_feature (254)..(254): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgaggcccttcctatgagctgacacagcccaccctcggtctcacgtcgtccccgggacaaacggccaggactccacctgctctggacgatgctatacgaacctaaaaaatttntttaggtttttacgaactagactaaggaacgttcaacggtccgacggtcccttagttcgttacggtacacgtccagtaggacgacgtaaggacgtaccgaccgtaccgggactccgagtacgtacgtacttcgtcgtacggtcctaccgtaaccgttacggaacgggggtacggtacggtcccgtaacggtttacgtaacgtttcgtacgggtacggtccgggggtacccgtaaggggtcggagggtacgtacggagtacgttacgtaaccttacgttaacgttcgttaacttccgagtaacgagaccgacgtacgtaggttacgactaacggtcggaacgggggtcttaccgggttcgggaccgggtacgggtaaccgtagggttacccggtaacggttacccggtacggtaaccggacccggtaaaccggtacgggtacccgttaccccgggaccccgtttacccgggttaccacccggtttcccgttaccccgggtttaccccccctccccgttccccgttttaccccgg

SEQ ID NO: 112309 - DNA, 619 bp, Homo sapiens
  misc_feature: GYAE6OF01EOSMB.21.30.C08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctctatgagctgacacagcccaccctcggtgtcagtcgtcccaggacaaacggccaggatcacctgctctggatnttcattgaccaaaagatatacttgtgtccagcagaagtcagccagccctgtactggtcatccatgacgcctagtcgacgacacgtccgggatcccagagagtattctctcgcctacagctcgaagggcagtcggacctacgttgactatcgaggtcgggcccagggtcggacgtagtaggaacgtcgtagacttacgttatttcggtaccgactaccgaagtacaggttacgtggtactagtcgggtaggggttacgttcgggacgggtacggtaaccgtaggttaccggtacccgttacgttacggttcgaaccggtacccggaaaggtcccgttacccggccccccgttacgggttacccctacttccccggttccgttcccccggtccccccg

SEQ ID NO: 112310 - DNA, 585 bp, Homo sapiens
  misc_feature: GYAE6OF01D3DYL.21.30.C08.1.454.CMB.1.raw
  modified_base (243)..(243): a, c, t, g, unknown or other
  misc_feature (243)..(243): n is a, c, g, or t
  modified_base (373)..(373): a, c, t, g, unknown or other
  misc_feature (373)..(373): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaatttnttgtttttggaccagcagaagtcaggccaggcccctgtgttggtcatccatgaggacaggagacgacccgtccgggatccctggagagattctctggcctaccaactcaggggacggtggcccacgtttnattctcgaggtcggggcccgagggtggaggatggaagcgtgactactacttgttactcagcaagacagcaggtggtcagtcggagggggcagttccgggcgggagggaccgagggttcggaccggtccgtaggtccacggacccgaacggctccggcccccgtcgggtccacccgttccttaccgttcccacccccttccctcccgttcccg

SEQ ID NO: 112311 - DNA, 651 bp, Homo sapiens
  misc_feature: GYAE6OF01E11FZ.21.30.C08.1.454.CMB.1.raw
  modified_base (248)..(248): a, c, t, g, unknown or other
  misc_feature (248)..(248): n is a, c, g, or t
  modified_base (336)..(336): a, c, t, g, unknown or other
  misc_feature (336)..(336): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctcgtggagatgctattcgaacctaaaaaatttnttggttttttggaaccagcagaagtcaggccacggccctgttgttggtcatccatgaggacgaggagaccgacccgtcggactcccgngagagattctctcggcctccaacgtcgacgggacgggtcggcctacggtttgtacttcgtcgtacgggtcggggacccgagggttacgggaggtagacggaagtcgtacgtacttacgttaacgttcgtttaacgtacgagacgacgacgacgtcgaggttcggagtacgtggacggggctacgggttccgggacgggtacgggaccggtagggtccggaccggttccgtacggtcgaaccgtcccgaacggcgtcccgtcccccggtcggtaccctacttacccgttccttccccctccccgttcccttccccg

SEQ ID NO: 112312 - DNA, 545 bp, Homo sapiens
  misc_feature: GYAE6OF01CC1IL.21.30.C08.1.454.CMB.1.raw
  modified_base (243)..(243): a, c, t, g, unknown or other
  misc_feature (243)..(243): n is a, c, g, or t
  modified_base (373)..(373): a, c, t, g, unknown or other
  misc_feature (373)..(373): n is a, c, g, or t
  modified_base (417)..(417): a, c, t, g, unknown or other
  misc_feature (417)..(417): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaaattnttgttttttggaccagcagaagtcaaggccaggcccctgtgttggtcatccatgaggacaggagacgaccctccgggatccctgagagattctctggctccaactcagggacggtggccacgttgattcnagtggggcccagggtggaggatgaagctgactactatgttactnagcaagacagcagtggtcatcgagggggcagttcggcgggagggaccgagggttcgaccgtcgtacggtcacggcccgaaggcctcgcccccgtggtcctactctcgttccctaccccgtccttcccg

SEQ ID NO: 112313 - DNA, 601 bp, Homo sapiens
  misc_feature: GYAE6OF01ETKD7.21.30.C08.1.454.CMB.1.raw
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgttttttggaccagcagaagtcaggccaggcccctgtgttggtcatccatgagacgagganaccgaccctccgggatcccgngagagtattctctggctccaactcgagggacggtggcctacggttgattctcgacgggtcggggccctaggggtcgggaaggtagtggaagctaggtaaccttacttacgtgttactcgagcaagacagcgtagtcggtacagtcggaggggtctaggtcgggcgggacgggacgtagggttcgaccggtcgtaggccgacggcccgaaggtccctccggcccccgtcggtccctaccgttccgttcccggttcccccgtccctcccggtacccgg

SEQ ID NO: 112314 - DNA, 812 bp, Homo sapiens
  misc_feature: GYAE6OF01BG72V.21.30.C08.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccacctcggtctcagtcgtccccggacaaacggccaggatcacctgctctggagatgctattacgaacctaaaaaatttntttgtttttacggaacctagcaagtaacgtacgacggccacgggtcccctggttgttcggtactacttccgagtggaacggacgagggaacgacccgaccccgtccgggtaactcccgtaggacgtagtacgtttctcgtcggactaccgtaaacgtcggaacggggtcggtacggtacctacggttgtaactttccgtacgtacgggtcggggacccgtaggggttaggaacgggtagtacggtaaacggtccgttaacgtaacgttaccgtaacgtttacggttaacctaccgaacggtccgaaggaaccgtagaccggtaaggttcgggtaaccaagggtaccgggaagggggtaccgttaacgggttcccggggaacggggtaacgggtaacccggttaggggttaacccggtaaccccgggttaccggtacgggttaccggaaacccgtacccggtaacgggtcccgttacccccgggccccccggtttaccggtaaccctcccgtttacccggttacccccgttttccccccgaacccccggtttcccgtaaacccggg

SEQ ID NO: 112315 - DNA, 538 bp, Homo sapiens
  misc_feature: GYAE6OF01CHGWX.21.30.C08.1.454.CMB.1.raw
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
  modified_base (523)..(523): a, c, t, g, unknown or other
  misc_feature (523)..(523): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaaattntgttttttggaccagcagaagtcaggccaggcccctgtgttggtcatccatgaggacaggagacgaccctccgggatccctgagagattctctggctccaactcgagggacggtggccacgttgattctcagtgggcccagggtggaggatgaagctgactactactgttactcagcagacagcaggtgtcagtcgaggggcagttcggcggagggaccaggttcgaccgtcgtaggtcacggcccaaggctcgccccctcggtcacctctcgttccccncccgtccgtacccgg

SEQ ID NO: 112316 - DNA, 988 bp, Homo sapiens
  misc_feature: GYAE6OF01DWJYE.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacagccaccctcggtctcagtcgtccccgggacaaaccggccaggactcacctgctcgtggagatgctattcgaaaccttaaaaaaatttagttttcggtttttttacgggaaccctaggaccgtaaaggtaaacgtacgaaccgggcccaaccggggtccccccttgggtttcggtttacgggttacctaacgttaccccgtaagttagggaacggggtaaaccgaaggggaaccggaaccccggtaaccccccggtacccgggggtaacctccccggttaggaaacggtaaggtaactttccgtccgttacggtcccttaacccgaaccgttaccggaaccggggggttaccgggtacgggtacccgttaacgggtttacgtaccgtttaccgtcggtaacggggttccgggggtaaccccggttaagggggtacggggaacggggtaacggttaacgggtaaacggtaccgtttacggtaaaccttaaccggtttaaccgtttacggtttaaacctccgaacggtaaccgtaacgaaacgtacggacgtagggttaacgtacgtacggttacggggaacgggggttaccgtaacgggttccggggaacggggtaccgggtaaccgggttacgggttacgggaaccccggttaccggtacgggtaccgaaacccggggtaccccggtaaaccggggttccccgtttcccccgggtaccccccccggtttacggggttaaccccccttacccggtttacccccgggtttccccccgggtttaccccccccgttcccccgttcccccccggttttaccccccgg

SEQ ID NO: 112317 - DNA, 636 bp, Homo sapiens
  misc_feature: GYAE6OF01AOVV4.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggaccctctcctgctcccctcctcactttctgcacagtctctgaggcctcctatgagctgacacagccaccctcggtctcagtgtccccgggacaaacggccaggatcacctgctctggagatgcattcgaacctaaaaaatttattgttttttggacctagcagaagtcaggccaggccctgtgttggcatccatgaggacagggagaccgacccgtccgggactcccgtgagagacttctctggcctccaacgtcgagggacggtggccgtacgttgacttcctcgaggttcggggcccgtagggtcgggaggtagtaggaagtccgtagtacctacgtaacgttcgttacctacgagacgaagaccgagcaggtggtacagtcggaggggctaggttcggacgggacgggtacgtacgggttacggaccggttaccgtacggtaccgacggtacccgaacggtcccgtccggcccccgttacggtaccctacccggttcctacccggttcccccacccgttcccgtaccccggg

SEQ ID NO: 112318 - DNA, 652 bp, Homo sapiens
  misc_feature: GYAE6OF01CXZS3.21.30.C08.1.454.CMB.1.raw
  modified_base (200)..(200): a, c, t, g, unknown or other
  misc_feature (200)..(200): n is a, c, g, or t
  modified_base (383)..(383): a, c, t, g, unknown or other
  misc_feature (383)..(383): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctccccctcctctactttctgcacagtctctgaggcctcctatgagctgacacagccaccctcggtctcaggtcgtccccgggaanaaacggccaggactcaccgtgctctggagatcgcattcgaccaaaaagtatatacgttgttggtaccagcagaagtcgaggccacggtccctgtactggtcatccagtgacggccagtcgacgacacgtccgggatcccgtagacgagtattctacgtcgtccctcgacgcctacgagggacncggtcgacctaccttgacttagcgagggtccgggcccgtagggtcggacgtacgtaggaacgtcgtacgtaactacgtttagttacggttaacccgacaacccgaagtaacgtaggttagtcggactaggtcgggtaaggggttcgtcggggacggacgggtaaccgtaggttacgcccggtttcgtcggtaccgaggacccgtacggccgtacccggtccccgttccggtacctaccggttccgttcccggtccccgttaccccccgg

SEQ ID NO: 112319 - DNA, 638 bp, Homo sapiens
  misc_feature: GYAE6OF01BX4Z1.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattgacctaaaaaatttnttgtttttggaccagcagaagtcaggccaggcccctgtgttggtcagtccatgaggacaggagacgacccgtcgggactcccgtgagagacttctctggctccaactcgacgggacggtcggcctacggttgacttctcgaggtcggggcccctagggtcggacgggagtggaacggtcgtacgtaacttacctacgttacgtttactcagactagacagctaggtgtaccgagtcggagggggtctaggttccgggacggacggggaccgtagggttacggacccgttccgtacgggtccacggcccgtaacgggccgtacccggtccccccggtcggttcccgtaccgttccgttacccggtttcccccgtccccgttccccgttcccccg

SEQ ID NO: 112320 - DNA, 613 bp, Homo sapiens
  misc_feature: GYAE6OF01BZPQP.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaatttattgttttttaggtaccagtcagaagtcaggccaggcccctgtgttggtcatccatgaggacaggagaccgacccctccggggactcccgtgagagacttctctggcctaccaactcgaggggacggtggccacggttgacttcgtcaggtcggggcccagggtggaggatgaagctgactacgtactgttactcagcagacagctaggtggtcagtcggagggggtcacggttcgggacggacgggaccgacgggttcgacccggttccgtagggtccgtaacggcccgtaaagggcccttacccggccccccgttgggtaccctaccgtcccgttaccgttcccccctacccgttcccccgttccccg

SEQ ID NO: 112321 - DNA, 647 bp, Homo sapiens
  misc_feature: GYAE6OF01A6CWS.21.30.C08.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (595)..(595): a, c, t, g, unknown or other
  misc_feature (595)..(595): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggactcacctgctctgganatgcattcgaacctaaaaatttnttagtttttcggacagacagaagtcaggccacggccctgtcggttcgtcactccagtgacggacgagggacgaccgacccgtccgggactcccgagagacgtattctcgtggcctaccaacgtcgacggggacggtcggcctacgttagtactttcgtacgtacgggtcggggaccctagggtcggaggactaggaacgtcgtacgacgttacctacgttcgttactacgacgcaacgacgacgcgtaggtcgtactagtaccggaggggtcacgggttaccggacgggacgggtaccgtacggtaccggtaccgtaccggtacggtcgaacggacccgtagggtccncccggtccccgtggaccttacgccgtttacccgtccctcccgttcgtccccg

SEQ ID NO: 112322 - DNA, 749 bp, Homo sapiens
  misc_feature: GYAE6OF01BUXGM.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgacggcctcctatgagctgacacacgcccaccctcggtctcagtcggtccccgggaacaaacggccaggactccacctgctcgtggagatgactattacgaaacctaaaaaatttgtttggttttttacggaaccagacaagtaacgtacaggccaacggccccttgtgttggtcactccagtggaggacgaggacgaccgacccgtccggactcccgtagagagtacttctcgtcggtactaccaacgtcggacggggtacggtcggaccgtacggttagtacttccgtcgtacgggtcggggacccgagggttacgggaaggtagtacggaacgtcgtacgaaccttacgttacgttacgttaacctacgacgcgaacggactacggacgtacggttcggtaccgtaggtaccgggaggggaccgtacgggttccggggacgggtacgggacgtacgggttccgacccggttaccggtacgggttaccgaccggaccccggtaacggtcccgttaccccgggtcccccgttacccgggacctttaccccgttaccggtttaccccgttaccccccgttaccccgtttccccgtttacccccgg

SEQ ID NO: 112323 - DNA, 953 bp, Homo sapiens
  misc_feature: GYAE6OF01DVJI7.21.30.C08.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccacccgtcggtntcagtcgtccccgaggaaccaaacggccaggactccacctgctcgtggatattcattacgaaccaaaaagtaattaacttacgttttggtttcggttaccagtacgaaggtaaacggtccgtacgggcccgtaaccgggtcccccgtttaggttaaccgttcgggttacctaacgttaccccgtaagttacgggaccggggtaccccgtaacgggttacccggaaacccggtaaaccgtaaccccggttaccccgggggtaacctttcccccggtagggtaaacggtaacggttaacctttttccgttccgttccggtacccccttacccggaacggtacccgttaccggggaaacgggggtaacccgtacggggttacccgggtaacccccgttaacccggttttacggtaaaccgttaacggttaccgggtaaccggggggtcccgggggtaccccggtaagggggttaccggggaacggtaacggttaacggaaacgtccgttaaggttaaacccgtttaacgtttacgttttaccggtaacccgtaccgtaaaccggaacggtaacgtaacgggttacggttcggtaaccgtacgggttaccgggggtaaggggtttaccggtacggggacgggtaacgggtaacgttacggttacggtacccggtttcggttacgggtcccgaacgggaccccggtacggtccccgttacccggccccccggtttcggtaccctaccgtttcccgttcccggttcccccgtacccccg

SEQ ID NO: 112324 - DNA, 613 bp, Homo sapiens
  misc_feature: GYAE6OF01DC1AV.21.30.C08.1.454.CMB.1.raw
  modified_base (244)..(244): a, c, t, g, unknown or other
  misc_feature (244)..(244): n is a, c, g, or t
  modified_base (377)..(377): a, c, t, g, unknown or other
  misc_feature (377)..(377): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaatttnttgtttttggaccagcaagaagtcaggccaaggcccctgtgttggtcatccatgaggacaggagacgaccctccgggactccctgagagtattctctggctccaactcgagggacggtggccagttgattcgnacggtggggccctaggtggaggagtgagctgactactctagttactcgagcagacagctagtgtcagtcgagggggtcagttcgggacggtacgggaaccgtagggttacgtaccggttacccgacgggttacgaccggtacccgaagggtccgtcccgggaccccccttccggggtaccctaccgttcccgttaccggtttacccccccgtaccccgttccccgtaacccccggg

SEQ ID NO: 112325 - DNA, 546 bp, Homo sapiens
  misc_feature: GYAE6OF01E3SXY.21.30.C08.1.454.CMB.1.raw
  modified_base (243)..(243): a, c, t, g, unknown or other
  misc_feature (243)..(243): n is a, c, g, or t
  modified_base (328)..(328): a, c, t, g, unknown or other
  misc_feature (328)..(328): n is a, c, g, or t
  modified_base (394)..(394): a, c, t, g, unknown or other
  misc_feature (394)..(394): n is a, c, g, or t
  modified_base (536)..(536): a, c, t, g, unknown or other
  misc_feature (536)..(536): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacagacggccaggatcacctgctctgcagatggactgacaaagaaatntgtactttattggtaaccaacaagaacgccgaggccacggcccctgtgttagtgatataataaagacactggaacgacggccctnagagactcccgtgagcgtattctcgtcggctcacgtctacgacgggacacgcagtcgtacggttanactatacgtagtagacgtccgagcgaggaggacgaggctagactatactagtaacaacgagtaagacgtagtacgtagtactagtagttgggtggtcggacggacggacgagtcgtacgccgtcgtagcacgaccaggtccncgtcccgtcg

SEQ ID NO: 112326 - DNA, 873 bp, Homo sapiens
  misc_feature: GYAE6OF01D93YE.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctcccccctcctcactttctgcacagtctctgacggcctcctatgagctgacacacgggcccaccctcggtctcagtccggtacccgggaacgaaaccggccaggactcgacctgctcgtggagatgactattacgaaaccttaaaaaatttgtttaggtttttacggacctagacgaaggaacgtcgaacggtcccgaccggtccccgttggttcggttcggtacctacgtaccgtagtacgggaacgggaaccggaaggggtaccggaaccccggtaccccggtaccggggtaccttcccggtaaggaacggtacgtacgtttccgtacgtcggtccctaaccgtaacgtcgggacgggggtacggtcggaccttaacggttcgtaacgttcggtacggtcggggttaccggggacccgtaggggtacgggtaagggtaacgttacggtaacgtaccgttacggtaacctttaaccggttaacgttacggtttaaccaacggtacggaccgtaagaacccggtagtaccggtagggttaccgaggacggttaccgggggtaggggtccgtacgggggttccggggaaccggggacgggtaaccggtacggggttacccgtaacccgggtccgttaacgggtaccggaacccggtacccgggtaggtaccccgttccccgggtacccccgttaccgggttacccgttcccgtttcccggttacccccgttcccccgtcccccgttcccgttacccccg

SEQ ID NO: 112327 - DNA, 684 bp, Homo sapiens
  misc_feature: GYAE6OF01CC0TB.21.30.C08.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctcgtggagatgacattacgaacctaaaaaatttntttggtttttacggaccagacgagaagtcacggccacggtccccttggtcgttcggtcactccgagtggaaggacgagggacgaccggacccgtccgggtactcccgagtacgagtacttcgtcgtcggtctaccgaacgtcgacggggtaccggtcggaccgtacggttggactttcgcgtagggtccggggacccgtaggggtaggacggtagtagaacgtcgtaggtaacttacgttacgttcgttaacgtcgagacgagacgagcgtaaggtcgtacgtagtcgggaagggtcgtacgggttcggggacgggtacggtaccgtaggttaccggaccgttcgtaaggtccgacggtaacccgaggtcccgtcccgacccccggttcggtccgtaccgttccgttacccgtcccctacccgttcccttcccg

SEQ ID NO: 112328 - DNA, 706 bp, Homo sapiens
  misc_feature: GYAE6OF01BED4P.21.30.C08.1.454.CMB.1.raw
  modified_base (251)..(251): a, c, t, g, unknown or other
  misc_feature (251)..(251): n is a, c, g, or t
  modified_base (355)..(355): a, c, t, g, unknown or other
  misc_feature (355)..(355): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtcgtccccgggacaaacggccaggatcacctgctcgtggagatgctatttcgaacctaaaaaaatttnttggttttttacggacccaggcaaggaacgtcgacggccacggcccctgttagttggtcactccataggaggacgaggacgaccgacccgtccgggactcccgngagagtacttcgtcgtcggcctaccgacgtcgagggtacggtcggcctaggttcgtacttcgtacgtagggtccgggccggagggtgggaacggtagtacggaacgtcgttagtaacccgttaacgttaccgttacgttaccgtacgacgtacgaaggtacgacgtacgtacgggtagtacaagtcggaggggtctacggttcggggtacgggacgggtaccgtaggttaccggtaccggttaccgtacgggtccgtaaccggacccggtaacggccgtacccggtcccccgtacggtccctaaccgttcccgttaccgtttcccccaccccgttccgtcccggttacccg

SEQ ID NO: 112329 - DNA, 753 bp, Homo sapiens
  misc_feature: GYAE6OF01AE4UW.21.30.C08.1.454.CMB.1.raw
tcagtcgtcgctcgcacgaccggtgctcgatttagtctgacgtcaaagggaaagggggtgggcgtcaggaggcagagctctgggaatctcaccatggcctggaccctctcctgctcccccttcctcactttctgcacagtctctgaggcctctatgagctgacacagccaccctcggtctcagtcgtcccggacaacgccaggatccactgctctggagatgcattgacctaaaaaatttcttgttttttcggaccagcagtaacgtcacggtcccaggtccccttggtgttgctagtccagtgaggacaggacgaccgtcccgtcggtacttccctagacgtagtactttccgtcgttacggacctaccgaaccttcgggaacggggtaccggtcggacccgtacggttacgtacttccgttccgacgggttaccgggggcctaaggggttggaaggtacgtacggaacgtacttacggacttaacgttacgttacttaaccgttacacggtacgaacggtaccgacggcgttacggtacggtacgtacggttaccggagggggtacttacgggttaccgggacgggtacgggtaaccggtacgggtttaccggaccggttaccggttaacggtacccggaccggtaaccccgggtaaggttcccggtccgttacccccccgggttagggtaccccttaccggttcccggttaccccgtttaaccccgtcccccgttacccggtttaccccg

SEQ ID NO: 112330 - DNA, 582 bp, Homo sapiens
  misc_feature: GYAE6OF01D39YD.21.30.C08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtcccgggacaaacggccaggatcacctgctctgganatgcattgaccaaaagatatacttgttggtccagcagaagtcaggccaggccctgtactggtcatccatgaggccagtcgacgacacgtccgggactcccgtgagagtacttctctcgccctcgagcctcgagggacacggtcggccctacgttgactatcgaggtcggggacccagggtcggacgtagtaggaacgtctaggtactacgttagttcgttaccgcaccgagacgtagttagtggtacagtcggtaggggttactcgggacggacgggacgtaggttacgaccgttcgtcggcacgcccgaacggcctccgccccgttcggtaccaccttccgttccgttcccctaccccg

SEQ ID NO: 112331 - DNA, 874 bp, Homo sapiens
  misc_feature: GYAE6OF01C55EE.21.30.C08.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacacgccaccctcggtctcagtcgtcccgggacaaacggccaggactcactgctcgtaggagatgcattacgaacctaaaaaatttntttggtttttacggaaccagtaccgaagtaacggtcgaacggccgtacggtccccgtggttcgtttcggtactacgtccgtaagtacgggaacggaacgacgggtacggaacccggtacccccgtaccggggtaacttccccgtaggtaacggtaacggtactttcgtaccgttcggaccgttaccgaaacgtaccggtaacgggggtacgggttcggacccgtaacggttacgtaacgttccgttacgtacggggtacggggtaccccgtaggggtagggaacggtagtacggaacggtcgtacgtaaccgttacgttaacggttacgttaaccgtacgacgtaacgagaaccgacgtaacggtacggtacggtaccgtacggttacgggaacggggggtaccgtaacgggttaccggggaaccggggtaacgggtaacccggttaacggggttacccgggtaacccggtttaccgggtaaaccgggtacccggtaacccgggtaaccccgggtaaccgggttaccccgtccccggggttaccccccttcccggggtttaacccgacccgtttacccgttaccccggtttacccccccgtaccccgttccccgtttcccccgg

SEQ ID NO: 112332 - DNA, 615 bp, Homo sapiens
  misc_feature: GYAE6OF01AWKPZ.21.30.C08.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaatttnttgttttttggaccagcagaagtcaggccaggcccctgtgttggtcatccatgaggacaggagaccgaccctccgggatcccgtgagagattctcgtggctccgaactcgacggggacggtggcccacgtttgatttcgtcgaggtcggggcccagggtgggaggtagtggaacgtcgtacgacttactacgtgtttacctcgacgcgagacgacgcgaggttggtcagttcggaagggggtcctaggttcgggacgggaggggaccgtagggttcgacccggttcgtagggtccgacggcccgaaggcctccggccccccgtcggtcccaccgttccgtaccggttcccccgccccttcccgtaccccgg

SEQ ID NO: 112333 - DNA, 702 bp, Homo sapiens
  misc_feature: GYAE6OF01DEK31.21.30.C08.1.454.CMB.1.raw
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctctctactttctgcacagtctctgacggtcctcctatgagctgacacagcccaccctcggtctcagtcggtcccggaacaaacggccaggatcacctgctcnggagntgctattagaacctaaaaaatttnttagtttttacaaccagacaagtaagtcgacggaccgacggtcccttggttcgttggtactactcctaagtggaaggacgaggacgaccgacccgtcgggactccgtaggagatacttctacgtcggactacgaacctggacggggtaccgtggtaccgtacgttgtacgtttcgtacgacgggttcggggaccctggggtaggacgggtagtagggacgtaccgttacgaaccgttacgttactttgttaaccgcgaacgctaacgacgaaggtcggtaaggtcggtacacggtcggggtaacggggcctacggggtttccgggaacgggtaccgggtacgggttacggtaccgggtccgttaccggacgggtaccacgacccgggtacgccggtcccgaccccggtgttaccgtacctccggttacccgtccccgtaccctcggtacccgg

SEQ ID NO: 112334 - DNA, 629 bp, Homo sapiens
  misc_feature: GYAE6OF01BGO1G.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccgggacaaacggccaggactcacctgctctggagatgcattgacctaaaaattnttgtttttaggaccagcagaagtcaggccaggcccctgtgttggtcatccatgaggacaggagacgaccctccgggatccctaggagagacttctacgtggctaccaacgtcgagggacggtggcctacggttgtacttcgtacaggtcggggcccgtagggtcgggaggtagtaggaacgtcgtagtacgttacttacgtacgttacttacgaagtccaagaccaggtactaggtacgggtactacgtacggaaggggggtcctaggttccgggacgggtaacgggaccgtacgggtcgaccggtccgtaggtccgacgacccgtaggccgtccgcccccgtggtcccaccgttccgtacgttcccccgccttcccgtcctcccg

SEQ ID NO: 112335 - DNA, 772 bp, Homo sapiens
  misc_feature: GYAE6OF01BXTGN.21.30.C08.1.454.CMB.1.raw
  modified_base (752)..(752): a, c, t, g, unknown or other
  misc_feature (752)..(752): n is a, c, g, or t
tcagtcgtcgctcgcacgaccggtgctcgatttagtctgacgtcaaagggaaagggggtgggctcaggaggcagagctctgggaatctaaccatggcctggacccctctcctgcctcccctcctcactttctgcacagtctctgaggcctcctatgagctgacacagccaccctcggtctcagtcgtccccggaacaaacggcaggatcacctgctcgtggagatgactagttacgaaaccttaaaaaatttgttttacggttttttacggacctagtacgaaggtaacgttccgaacggcccgaccggtccccgttggttacggttacggtctaacgtccgtaagtacgggaacggacgaacgggaaccgtaacccggaccccggtaccgggtacctcccgaggtaacgtacgtacttccgtacgtcggtaccctaccgtaaccgttacggaacgggggtacggttacggacccgttacggttacgtacgtttccgtacgggtacgggtccggggacccggtagggtacgggaggtacgtaggacgtcgtacgtaactacgttactacgttacacgtacgacgaacgactggtacgagtcggtacacgggttcggacggggtacgtaacggtcgggaacgggtacggtacgtacggtacggtacccgtacggtacgtaccgaccggaccgtaccggtcccgtacccggtcccgtaccggtacctaccggttccgttaccccgttacccccncccgttcccgtcccttcccg

SEQ ID NO: 112336 - DNA, 832 bp, Homo sapiens
  misc_feature: GYAE6OF01CNV7J.21.30.C08.1.454.CMB.1.raw
  modified_base (263)..(263): a, c, t, g, unknown or other
  misc_feature (263)..(263): n is a, c, g, or t
tcagtcgtcgctcgcacgaccggtgctcgatttagtctgacgtcaaagggaaagggggtgggctcaggaggcagagctctgggaatctcaccatggcctcggaccctctcctgcctcccctcctcactttctcgcacagtctctgacggcctcctatgagcctgacacacgcctaccctcggtctcacgtcgtaccccgggacaaacggccaaggactccacctgctctgggacgatcgctagttacgaacctaaaaaatttnttaggttttttacggaacctagacgtaaggaacgttcgacggaccgtacggtccccgttaggttcggtttcggtactacgttacccgtagtaggaacggaactagggaacgacccgaccccgtcgggactcccgtaggaacgtacgtacgtccgtacggttacggacctaccgaacgtccgggaacgggtacggggtaccgtacccggttaacggttcggtaacgtttcccgttaacggacgggggttacgggaccgtacgggtacgggtacggagtacggtaacgtcgtacgtaaacgttactttaacgtacggtttaccacgtaacgtagaaccacggtactaaccggtagttaccggacttaaacgggttcggggaaacgggggttcttaaccgggtcggggaaccggggtaacgggacccgtttaaggggtaccctaacccggggtacgttaaccggggtcccaacccgggtacgtaacccgggtccgtacccccggccccggttacgggtcccttacccgttacccggttacccgttcccccgtacccgttcccggtacccggg

SEQ ID NO: 112337 - DNA, 711 bp, Homo sapiens
  misc_feature: GYAE6OF01CWSMN.21.30.C08.1.454.CMB.1.raw
  modified_base (249)..(249): a, c, t, g, unknown or other
  misc_feature (249)..(249): n is a, c, g, or t
  modified_base (376)..(376): a, c, t, g, unknown or other
  misc_feature (376)..(376): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtcccgggacaaaccggccaggactcacctgctctggagatgctattagaacctaaaaaatttnttggtttttacggaccagacaagtaacgtcgacggccgtacggtccccttggttggttcggtactactccgagtaggacggacaggacgaccgtaccccgtccgggactcccgtagagagtacttcncgtcggcctaccacgtcggaacgggtacggtacggtacctacggttgtacgttcgtcgtagggtccggggacccgtagggtaggaggtacgtaggaacggtcgtaggtaaccttaacgttaccgttaggttaacctcgacgaccgtaacggacacggtagtacgggttcggtaaccgtaacggttaccggggaagggggttcctaggggttaccggggacggggtaacgggtaccgtagggttaccgacccggtacgtacggcgaccggacccgaggtccgtcccgcccccgtcggtctacccgttcgttcccgttccccgccccttccgtcccg

SEQ ID NO: 112338 - DNA, 535 bp, Homo sapiens
  misc_feature: GYAE6OF01DCB0G.21.30.C08.1.454.CMB.1.raw
  modified_base (286)..(286): a, c, t, g, unknown or other
  misc_feature (286)..(286): n is a, c, g, or t
tcagtcgtcgctcgcacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatatgtcttattggtaccaacagaagccaggccaggccctgtgtagngatatataaagcactgagacggccctagaagagactcccgtagagcgtattctcgtggccttccgagtctcgaacgggacagcagtctacgttagactatcagtagaacgtccaggcaaggagacgagctgactatactgacaagtagacacgagtagtacgtactagtagttgggtgtcggaggacggtacgaacgcgtcgaccggttccgaggtcacggtccaacggcctacccgcccgtggtaccc

SEQ ID NO: 112339 - DNA, 588 bp, Homo sapiens
  misc_feature: GYAE6OF01DRPAS.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaaatttnttgttttttacggaccagacagaagtcaaggccaggccccctgtgttggtcatccatgaggacaggagacgacccgtccgggatccctgagagattctctggctccaactcgagggacggtggccgtaagttgattctcgaggtcggggcccagggtcgggaggagtggaagtctagacctacttacgtcgttactcgagcaagacagcagtggtcagtcgacgggggtctacgtccgggacgggtacgggaccgtagggttcgaccggtccgtacggtcgacggcccgaaggctccggcccccgtcgtcctcctccttccgtccccgccctccgtaccccgg

SEQ ID NO: 112340 - DNA, 656 bp, Homo sapiens
  misc_feature: GYAE6OF01ED9Q7.21.30.C08.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtcccgggacaaacggccaggatcacctgctctggagatgcattgacctaaaaaatttnttgttttttaggaccagcagaagtcaggccaggccctgtgttggtcatccatgaggacaggagaccgacccgtccgggactcccgtgagagtattctctggctccaactcgagggacgtggccacgttgattcacgaggtcggggacccgtagggtagggacggagtagaacggtcgtacgtaacgttaactacgtagtttaactcacgacagacgagcgaggtggtcacgtcggtagggggctaagggttccgggacgggacgggtaccgtacgggtttacggacccggttaccgttacgggtaccgaaccggtacccgaaacgggtcccggttcccggacccccccgttgggtaccccttaccgttcccgtttaccccggttcccccggttccccttccccgttcccccg

SEQ ID NO: 112341 - DNA, 819 bp, Homo sapiens
  misc_feature: GYAE6OF01CRVCE.21.30.C08.1.454.CMB.1.raw
tcagtcgtcgctcgcacgaccggtgctcgatttagtctgacgtcaaagggaaagggggtgggctcaggaggcagagctctgggtgtctcaccatggcctggatccctctacttcctcccctcctcactctctgcacaggctctgaggcctcctatgagctgacacacgccacccgtcggtgtcagtcgtccccgaggacaggacggccgaggactccgacctgctctgacagagtcggactagaaccaaaagaactatgttactttaagttacggtaaccaaacgaaggaacgtaccgacggacccgtaacggtccccgttgttacggttagtagtaacttaaataaacgtaaacgactaacgtacggaacggtaccggtaccctagaacgacgtaacgtccccggtagaccggtacttaacgttcgttcccgtacggtcctacccgtaggtccgtacggaaccgggaacgacgacgttacggttaccccgtaggttacgtaaccgttagtacgtaacggtaacggaaacccggttccgaaagggacgaggggaacgggtaggtaacggttacgtaacggttaacttttacgtacctaaaggttaaccgaaagtacggtaaacgtaacgttagggtaacggttaaacggtacccgtttaggtacgggtttaagggggtaccgggttacggggacccgggggtaaaggtaaaccccggtaccgggttacggtaaccccgggttaacggttacccgggtaacgaaccggtaaaccccgggtaccggtaaacccggtccccgttaccccgggttacccccgg

SEQ ID NO: 112342 - DNA, 726 bp, Homo sapiens
  misc_feature: GYAE6OF01ACJJY.21.30.C08.1.454.CMB.1.raw
  modified_base (249)..(249): a, c, t, g, unknown or other
  misc_feature (249)..(249): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtctcagtcgtccccgggacaaacggccaggactcacctgctctggagatgcattacgacctaaaaaatttnttggttttttacggaccagcagaagtcgaggccacggccctgtgttcggtcatccatggaggacgaggacgaccgacccgtccgggactcccgtagagacgtacttccgtctggaccttaccgaacgtcggaacggggtaccgggtcggacccgtaacggtttcgtaactttccgtacgtaacgggttccgggggacccgtaggggttagggaacgggtagtacggaacgtcgtaggtacttaacgtacgttacgttaacctacgacgacgtaacgacgacgcgtaggtagtacacggtacggacggggctagggttccgggacgggacgggtaccgtagggttccgtaccggtaccggttaacggcccgtaaccggacccggtaacgggtcccgtccccgggtccccccgttccgggttaccctaccgtttcccggttaccccgttccccccttccccgttccccgtttacccccg

SEQ ID NO: 112343 - DNA, 765 bp, Homo sapiens
  misc_feature: GYAE6OF01DTVBQ.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacacgcccaccctcggtctcgagtcggtccccgggacaaaccggccaggactcacctgctcgtggatatgctagttacgaaacctaaaaaatttcgtttgtttttacggaaccagacaagaagtcgacggccacggccccttggtcgttggtacatccgagtggaggtacgaggacgaccgacccgtcggactccgagagatacgttctacgtcggtacctaccgaacgtccggacgggtaccggtacggtacccgttagttacgtacgtttcccgtacggtacggggtaccgggggacccgtaggggtacgggtaacggtaggtacggaaacgtccgtacgtaacctttacgtacgttaccgttactaccgtagaccgtagaacgtcggtacgtacggttacgtacgtaacggtaccgggaacggggtacgttaccggttaccggggaccggtaacggggtaccgtaccgggttaccggtaccgttaccggttacggaccgacccggtacccggtaagacccgttcccggacccccgttcggacccgttacccgttccccggtttcccggttaccccccgtcccgttccccgttaccccgg

SEQ ID NO: 112344 - DNA, 572 bp, Homo sapiens
  misc_feature: GYAE6OF01EFKZY.21.30.C08.1.454.CMB.1.raw
  modified_base (242)..(242): a, c, t, g, unknown or other
  misc_feature (242)..(242): n is a, c, g, or t
  modified_base (455)..(455): a, c, t, g, unknown or other
  misc_feature (455)..(455): n is a, c, g, or t
  modified_base (559)..(559): a, c, t, g, unknown or other
  misc_feature (559)..(559): n is a, c, g, or t
tcagtcgtcgctcgcacgaccggtgctcgatttagtctgacgtcaaagggaaagggggtgggctcaggaggcagagctctgggaatctcaccatggcctggaccctctcctgctccccctcctcactttctgcacagtctctgaggcctcctatgagctgacacagccaccctcggtctcagtcgtcccgggacaaacggccaggatcacctgctctggagatgcattgacctaaaaaattnttgttttttggaccagcagaagtcaggccaggcccctgtgttggtcatccatgaggacaggagaccgacccgtccgggatcccgtgacgagtattctcgtggcctccaacgtcgacgggacggtcggccacggtttgaacttcgtcgaggtcggggcccgagggtcggaggagtaggaagcgtagaacttactacgttgttactcagcagacngcagtgtcgagcggaggggctaggttcggagggacggacgagggtcgaccgtcgtagtcgacggcccaagggcctcgcccccgtcgcctacttctccgttcccnccctcccgtcccg

SEQ ID NO: 112345 - DNA, 783 bp, Homo sapiens
  misc_feature: GYAE6OF01AC5I3.21.30.C08.1.454.CMB.1.raw
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgaggcctcctatgagctgacacagccaccctcggtctcagtcgtcccggganaaacggccaggatcacctgctctggagatgcattgaacctaaaaaatttnttgtttttggaccagcagaagtcaggccacggccctgtgttggtcatccatggaggacaggacaccgacccgtcgggactcccgtgacgagtacttcgtacgtcggcctacctaacgtcgaaggggaccgggtcggtacccgtacggttggtaactttccgtacggtacggggttaccggggcccgtaggggttcgggaagggtagtacgggaacgtccgttaggtaaccttaaccgttaacggtttcgtttaaccgtacgtaacgtaccaacggacgtaacgtccgtaaagggttcgggtaacctaacggttccggggaaacggggggtccttaagggtttacccgggggacggggtaacggggaacccggttaaggggttaccggtaaccccggttccggttaaccgggtaccgaacccgggtaccccggaaaggggttcccggtaccccggtacccccccgggttcgggttaacccttaccggttaccccgttacccgtttacccccccgtaccccgtttccccgtttacccccgg

SEQ ID NO: 112346 - DNA, 735 bp, Homo sapiens
  misc_feature: GYAE6OF01C7YQ7.21.30.C08.1.454.CMB.1.raw
  modified_base (231)..(231): a, c, t, g, unknown or other
  misc_feature (231)..(231): n is a, c, g, or t
  modified_base (396)..(396): a, c, t, g, unknown or other
  misc_feature (396)..(396): n is a, c, g, or t
  modified_base (714)..(714): a, c, t, g, unknown or other
  misc_feature (714)..(714): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctcccccctcctcctactttctgcacagtctctgaggccctcctatgagctgacacagcccaccctcggtctcagtcgtccccgggacaaacggccaggactcacctgctcgtgganatgactagttacgaaaccttaaaaaatttgttttggtttttacggacctagacaagtacgtacgacggaccgaccggtcccgttggttggtttggtagtaaattaagtaaacgtaaaacgaccgtacgtaggaacggaccggtcccagagagactcccgtggacncgtacttcgtcgtgcctcgagtcctacggaacggactacgacgtacgtccgtaacggttactacgttaacacgtagggtacgaaaccggtcccggaagggtaccgaaggggtaccgggacggaacggtctaacggtaacctttaacgttcgtaacgtaacaaacgttaggtaaccgtaaggtacggttaaagggtaccggttaacttcgggtttaaggggttcgggtttacgggtcggggaacgggacggtaaccgaggtccgtaacggtcccgtacgtacgccggaccacgggtaccgtcccgtccccggtcccgtntaccctccgtccgttcccccg

SEQ ID NO: 112347 - DNA, 766 bp, Homo sapiens
  misc_feature: GYAE6OF01BTJVT.21.30.C08.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagtctgacgtcaaagggaaagggggtgggctcaggaggcagagctctgggaatctaaccatggcctggacccctctcctgctcccctcctcactttctgcacagtctctgaggcctcctatgagctgacacagccaccctcggtctcagtcgtccccgggacaaacggccaggatcacctgctcgtggagatgcattcgacctaaaaaatttnttggtttttggaccagcaagaagtcaggccacggcccctgttgttggtcatccagtgaggacaggacgaccgacccgtccgggactcccgtagacgagtacttctcgtcggacctaccgaacgtcgaggggtacggtcgggaccgtacggtttcgtaactttccgtacgtacgggttcggggaccccggtaaggggttacggggaacggtagtaggaacggtcgttacgggtaaaccttaccgttaacgttacggtttaaccgtacgaacggtacgtaacggaacgaacgtacgtaacggttcggtaccgtacgttaccggaaggggggtacctaacgggttcgggggtaacggacggggtaccgtaggggttccgtaacccgggttccgttaacggtaccgaccggaccccggaacgggtcccgttaccccggtcccccggttacccggttaccctacccgtttaccccggttcccgttacccccctaaccccgtttcccccgttacccgttaccccgg

SEQ ID NO: 112348 - DNA, 814 bp, Homo sapiens
  misc_feature: GYAE6OF01CG5DS.21.30.C08.1.454.CMB.1.raw
tcagtcgtcgctcgcacgaccggtgctcgatttagtctgacgtcaaaagggaaagggggggggctcaggaggcagagctctgggaatctcaccatggcctcggacccctcctcctcgcctccccctcctcctactttctcgcacagtctctgacggcctcctatgagctagacacacgcccaccctccggtctcacgtccggtacccgggaaccgaaaccggaccgaggactaccacctcgtctcgtaggagagtgactattaacgtaaacctaaaaaatttaagttttacggtttttacggttaaccgtacgtacgtaacgtaacgtacgacggaccgaccggtacccgttcggttacggttacggtactactacctagtaggaacggaacggaacggaaccggaacccggtaaccccggtaccgggtaccgtacccgtacggaacgtacgtacgttacgtacgtcgtaccgtaccgtaaccgtaccggtacggggtacgggtacggtaccgtacgttacgttacgttacgtacggtacgggtacggggtaccggtacgggtagggtagggtaggtaggtacgtacgtacgtaacgtaacgtacgttacgttaacgtacgacgacgaacgaacgacgacgtaggtacggtacgtacgtacgggtacggggtacggtacgggtacgggtacgggtacgggtaacggtacgggtacggtaccggtaccgtacggtaccgaccggaccgtacggaccgtcccgtcccgtccggtaccgtaccgtaccgttcccgttccccgtcccgtcccgtcccg

SEQ ID NO: 112349 - DNA, 716 bp, Homo sapiens
  misc_feature: GYAE6OF01EGL41.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggactcacctgctcgtggagatgcattacgaacctaaaaaatttgtttgttttttacggaccagacgaagtaagtcacggacccgacggtccccttggttcgttcggtcactccagtgaggacgaggacgaccgacccgtccggactacccgtgacgagtacttctacgtcggtaccctaccgaacgtacggacggggtacggtaccggtaccgtacggttacgtaacgttcgtacggtacgggttccggggacccgtaggggtacgggaaggtagtaggtaacgtacgtacggtaacttacgtacttagttacctacgacgtacgaagacgacgactaggtcgactagtacgggacgggtacgtacgggtacgggacgggacggtaccggtacggttaccgaccggttaccgtgggtaaccgaccggtacccggaacggtcccgtaccccggtcccccgtggtacccctacgttcccgtacccgtttcccctacccgttccggaacccgg

SEQ ID NO: 112350 - DNA, 581 bp, Homo sapiens
  misc_feature: GYAE6OF01B13UB.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagattcattgaccaaaagatatacttgtggttcaagcagaagtcaggccaggccctgtactggtcatccatgaggccagtcgacgacacgtccgggatcccgtgagagtattctctcgcctccgagtctcgagggacagtcggccacgttgactagtcgacggtcgggacccgagggtcggacgtagtgaacgcgtagtactacgttagtttcgtacgcaaccgagactagttagtggtacagtcggaggggttacttcgggacggtacgggacctaaggttcggaccgttcgttcggccaggacccgaggccgtaccgcccccgtcggtcctaccgttccgtccgttccccctaccccg

SEQ ID NO: 112351 - DNA, 772 bp, Homo sapiens
  misc_feature: GYAE6OF01D3C2P.21.30.C08.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagtctgacgtcaaagggaaagggggtgggctcaggaggcagagctctgggaatctcaccatggcctggaccctctcctgctccccctcctcactttctgcacagtctctgaggcctcctatgagctgacacacgcccaccctcggtctcagtcgtcccggaacaaacggccaggactcacctgctcgtggagatgctattcgaacctaaaaaatttnttgttttttacggaccagcaagaagtcgacggcctacggcccttaggttcggttcggtctactccagtggaacggacgagggaacgacccggacccggtccggggtactccccgtaggacgtagtacgtttcctcgtcggacctaccgtaacgtcggaacggggtaccggcggtaccgtacggtttagtacgtttcgtacggtacgggtcggggacccgtagggggtacgggtaacgggtacgtacggtaaacggttccgttacgttaaaccgtttaacccgttaacgtttacggtttacctacggacgtacgtaacgacgtaccgacgtacgggttcggtacgtaacggtccggggaacggggtaccttacgggttccggggaacgggtaccgggtaccggttacgggttaccggtacccggtcggttaccggacgtaccggacccgtacgggcccttccccggccccgttacggtccgtacgttcccgttacccggtcccccgttcctccccgtttcccg

SEQ ID NO: 112352 - DNA, 588 bp, Homo sapiens
  misc_feature: GYAE6OF01EUK9Q.21.30.C08.1.454.CMB.1.raw
  modified_base (243)..(243): a, c, t, g, unknown or other
  misc_feature (243)..(243): n is a, c, g, or t
  modified_base (327)..(327): a, c, t, g, unknown or other
  misc_feature (327)..(327): n is a, c, g, or t
  modified_base (431)..(431): a, c, t, g, unknown or other
  misc_feature (431)..(431): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattgacctaaaaattnttgtttttggaccagcagaagtcaggccaggcccctgtgttggtcatccatgaggacaggacgacgacccgtccgggatcccgngacgagtattctctggctccaactcgagggacggtcgccacgttgacttctcgaggtcgggcccagggtcggaggatggaagctcgacttactacgttgttacncgagtacacgacgtacgcgtagtcggtactacgtcggagggggtactagggttccgggacgggacgggtaccgtagggttcgacccggtcgtacggtcacggcccgaaggcctccgccccgtgccgtacctcgtccgtccccgtccctcccttcccg

SEQ ID NO: 112353 - DNA, 535 bp, Homo sapiens
  misc_feature: GYAE6OF01EWPVH.21.30.C08.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
tcagtcgtcgctcgcacgaccggtgctcgatttagtctgacgtcaaaagggaaagggggtgggctcaggaggcagagctctgggaatctcaccatggcctggaccctctcctgctccccctcctcactttctgcacagtctctgaggcctcctatgagctgacacagccaccctcggtctcagtgtccccggganaaacggccaggatcacctgctctggganatgcattgaccaaaaaatttgttttttggaccagcagaagtcaaggccaggcccctgtgttggtcatccatgaggacaggagacgacccgtcgggatccctgangattctcnggtacncaactcgagggcgtggcctagtgnttctcgagtcgggaccaggtggagagtcgaagctgactactactgttacacagcagtacngangtgactgcgaggggctgtcgggcggaggaacgcgttgaccgtcgtaggtcacgcccgaaggtctccggccctacggtcctcgtcttccgtcccncccgttcncccgg

SEQ ID NO: 112354 - DNA, 800 bp, Homo sapiens
  misc_feature: GYAE6OF01COROD.21.30.C08.1.454.CMB.1.raw
  modified_base (133)..(133): a, c, t, g, unknown or other
  misc_feature (133)..(133): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
tcagtcgtcgctcgcacgaccggtgctcgatttagtctgacgtcaaagggaaagggggtgggctcaggaggcagagctctgggaatctaaccatggcctggaccccctctcctgcctcccctcctcactttcngcacagtctctgagcctctatgagctgacacacgccacccgtcggtctcgagtcgtccccggaacaaacggccaggactcactgctcgngganatgctatagaacctaaaaattntttaggttttacgacagtacaagaagtcgaggccgacggtcccgtaggttcgttacgtctactacctagtaggaaggaacgacggacgaccggacccgtaccggactcccgtaggagtacgtattcgtcgtacggtacctaccgtacgtacggaacggggtaccgggtacggacccgtaacggttacgtaccgtttacggtaccggtaacggggtccggggtaacccggtaaggggtaacggggtaagggtaacgtacgggtaaacggtccgttaacggttaaccgttaaaccgttacgtttacggtttaaccgaacgtaacggaccgaacggaaacggtacggtacgtaacggttacgacggtaacggaccgggtaaggggacgttaccgggtacggggaccggggtaacggtacggtaccgggttacgtaacccggttacggaaccggtaccgaaccggtaccggtaaccggtcccggtacccggtcccccggttacggtcctacccgttcccgtaccctaccccctacccgtcccgttcccgttacccg

SEQ ID NO: 112355 - DNA, 597 bp, Homo sapiens
  misc_feature: GYAE6OF01CDUN4.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaacctaaaaaatttnttgttttttaggaccagcagaagtcaggccaggcccctgtgttggtcatccatgaggacaggagaccgacccgtccgggactcccgtgagagtacttctcgtggctaccgactcgagggcgtgccagttgattcgtgtacggtcggggccctagggtggaggagtagaagcgtagactactacgtgttactcagcagtacagcgtagtgtacagtcggacggggctagtccgggacggacgggaccgtagggttacgaccggtaccgtacgggtaccacggacccgaggcccgtccgcccccgttcggtaccgtaccgttccgttccgttcccccgcccttcccgttccccg

SEQ ID NO: 112356 - DNA, 658 bp, Homo sapiens
  misc_feature: GYAE6OF01AHU4L.21.30.C08.1.454.CMB.1.raw
  modified_base (250)..(250): a, c, t, g, unknown or other
  misc_feature (250)..(250): n is a, c, g, or t
  modified_base (357)..(357): a, c, t, g, unknown or other
  misc_feature (357)..(357): n is a, c, g, or t
tcagtcgtcgctcgcacgaccggtgctcgatttagtctgacgtcaaagggaaagggggtgggctcaggaggcagagctctgggaatctcaccatggcctggaccctctcctgctacccctcctcactttctgcacagtctctgaggcctcctatgagctgacacagcccaccctcggtctcagtcgtcccgggacaaacggccaggactccacctgctcgtggacgatgcattcgaacctaaaaaatttnttgttttttacggacctagcaagacgtcacggccgaggtccctggtgttcggtcagtccagtcggaggacgaggacgaccgacccgtccggactcccgagacgagtnttacctcgtcggtcctaccgaacgtcgacggggtacggtcggtaccgtacgttcgactttcgtacgacgggttcggggaccgtagggtcgggaagtagtacggaacgtcgtaacgtaccgttaacgtacgttacggttaacctacgagtacaacggtacacggtctaaggttcgacgtagtacgggacggggactacgggttcgggacgggacggaccgtagggtccgtaccgtcgtacgcgacgccgaggccgtcccgcccgtcgtcctaccgttctcccggtacccctcctcccgtccg

SEQ ID NO: 112357 - DNA, 777 bp, Homo sapiens
  misc_feature: GYAE6OF01EQ43S.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtcccgggacaaacggccaggatcacctgctctggagatgactattgaacctaaaaaatttgttgttttttacggaaccagctagaagtcaggccacggtcccctgtgttggtcactccagtgaggacgaggacgaccgaccgtccgggactcccgtagagagtattcgtcgttcggcctaccgaacgtcgaacggggtacggtcggccgtaacggttgtaactttcgtacgtagggttcggggaccccgtagggtacgggaacgggtagttacggaacggtcgtacgtaaccgttaacgttacgttacgtttacgtacgtagaccaaggaacgacggacgtaaggttcggtaccaacggttccgggaacgggggtactaacggggtttaccgggacggggtacgggtaaccgggtacggggtttaccggtacccggttacccggttaaccgggtaccgaacccggggtaaccccgtaaacggggtccccgttaccccgggtaccccccggttacgggtaccccgttaacccgttacccggtttacccccggtttaccccccctacccccgtttccccgtttaccccccggg

SEQ ID NO: 112358 - DNA, 946 bp, Homo sapiens
  misc_feature: GYAE6OF01C1I85.21.30.C08.1.454.CMB.1.raw
  modified_base (259)..(259): a, c, t, g, unknown or other
  misc_feature (259)..(259): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccccctcctcactttctgcacagtctctgaggcctcctatgagctgacacagcccaccctcggtctcagtcgtccccgggaacaaccggccaaggatccacctgctcgtggagtatcgactattacgaaacctaaaaaatttnttttcggtttttacggaacctagactaagtaacgtacgtaccggacccgaaccgggtcccccgtttaggttacggttttccggtacctaacgttccccgtaaggttacgggaaacgggtaaccggtaaacggggaaccgggtaaccccgggtaacccccccggtacccgggggtaaccttacccccgggtaagggtaaacggtaacggttaactttcccgtaccggtttaccgggacccttaaacccccgtaaaccggttaccgggtaaaccgggggggttaacccggggttaccgggtacccccgtttaaacgggttttacggttaacccgttttacccgtaccggggtaaccgggggttaccccgggggtaaccccggttaagggggtaccgggggtaaggggttaacgtaaacggggtaacggttaccgttaacggtaaacccgtttaaaccgtttacgtttacgttaacccgtcggaacgtacgaacggtacgtacgtacgtagggttccgtaacgtacggtacgggtacggggacgttaacgggtccggggacggggtaacgggtaccgtacgggttacccggtaccgtaacggtacggaccgacggtacccgaggtcccgtcccggtaccccgtcgtccctacccgttccgtcccggttccccctcccgttccgttccccg

SEQ ID NO: 112359 - DNA, 780 bp, Homo sapiens
  misc_feature: GYAE6OF01D13UV.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgacggcctcctatgagctgacacagcccacccgtcggtctcacgtcgtcccggacaaacggccaggactccacctgcctcgtggacgtatgactattacgaaacctaaaaaatttcgtttaggttttttacggacctagaccgtaaggtaacgtacgacggtaccgacggtccccgttggttcggtttcggtactactccgagtacggaggacgaggacgaccgacccgtccggactccgtagagtacgtacttcgtcgtcggcctaccgacgtcggaggtacggtcgccgtacgttcgtacttcgtacgtacgggtccggggaccgtaggggtgggaggtacgtacggaacgtcgttaacggtaccttaacgttaccgttaggtttaccacggtaacgaccgtaagacgtacggtaccgtaacgggttcggtaccgacggtacgggtacggggtctacggggttaccgggcggggtaaccgggaaccggttacgggttcccgtaaccggtttacccgtacgggaccgtaaccccgggccggtaacgggttccccgtcccccgggacccccgtttacggaccccgttacccgttcccggttacccgttcccccccgtacccgttcccggtaccccggg

SEQ ID NO: 112360 - DNA, 895 bp, Homo sapiens
  misc_feature: GYAE6OF01DJHCX.21.30.C08.1.454.CMB.1.raw
  modified_base (133)..(133): a, c, t, g, unknown or other
  misc_feature (133)..(133): n is a, c, g, or t
  modified_base (237)..(237): a, c, t, g, unknown or other
  misc_feature (237)..(237): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctccccctcctcactttcngcacagtctctgaggcctcctatgagctgacacacgcccacccgtcggtcctcgagtcggtcccccgggaacaaaccggccaggactccacctgctcgtggganatgctattcgaaccaaaagtattattacgttggttcgtaccagacgaagtacgtcacggccgacggtccctgtactggtacacgttccagtcggacggaccgtaacggtaccggaaccgaccgtaccggtacccgggaccttaccccgtaggaacgtaggtacctttccgtaccgtccgccccgttaccgacgttacccgtacggtaacgggtaacgtacggtcccggtaccccgtaacgtttaccggtaaacctttaggtaacccggtaacgggggttacccggggaccccggtaagggggttaccgggtaacgggtacggtaacggtaaacggttaccggttaacggtaaccttttaaccggtttaacgttttaccggttaaaccgtaccgacccgtaacggtaaccgtagggttacggtacggtaccgtaacggtttacgggggtaacgggggtttacgggtaccggggaccggggtaacgggtaaccggtaacgggttacccggtaccccggggttttaccggttacccgggtaccgtaacccgggaccccggttaaaccgggccccggtttaccccgggaccccccggtttaccggttaccccggttacccgtttcccggtttaccccgggtttccccccgttcccccccggg

SEQ ID NO: 112361 - DNA, 764 bp, Homo sapiens
  misc_feature: GYAE6OF01A6UI0.21.30.C08.1.454.CMB.1.raw
  modified_base (194)..(194): a, c, t, g, unknown or other
  misc_feature (194)..(194): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtcccgganaaacggccagactcacctgctctggagatgcattgaacctaaaaaattgttgtttttacggaccagacagaagtcaggccacggccctgtgttcggtcatccatgagacgaggacgaccgacccgtcggactccctagacgacgtacttctcgtcggcctacccgtaactcgaacggggtaccggtcgggaccctacgggtttcgtacttccgtacggtacgggttcgggggaccccgtaggggttacggaacgggtagtacggaaacggttccgtacggtaaccttaaccgttacgttacggttacctacgtacgtacgacgtaacgagtacccgtaggttacggtactaacggtccgggtaagggggtacctacgggtttacggggacccgggtaggggaacccggttacgggttaccggaacccgttcccggtttaaacgggtaccggtaaccggtccccggtaaacgggtccccggttacccccgggaccccccggtttccgtaccccgttacccgtttccgggttaaccccggtttccccccgtaccccgttcccgttcccccgg

SEQ ID NO: 112362 - DNA, 654 bp, Homo sapiens
  misc_feature: GYAE6OF01BKV90.21.30.C08.1.454.CMB.1.raw
  modified_base (108)..(108): a, c, t, g, unknown or other
  misc_feature (108)..(108): n is a, c, g, or t
  modified_base (249)..(249): a, c, t, g, unknown or other
  misc_feature (249)..(249): n is a, c, g, or t
tcagtcgtcgctcgcacgaccggtgctcgatttagtctgacgtcaaagggaaagggggtgggctcaggaggcagagctctgggaatctaaccatggcctggacccctntcctgctccccctcctcactttctgcacagtctctgaggcctcctatgagctgacacagccaccctcggtctcagtcgtccccgggacaaacggccaggatcacctgctcgtggagatgcattacgaacctaaaaaatttnttgttttttacggaccagacagaagtcaaggccaggcccctggttagttggtctatccgatgaggacaggagaccgacccgtcgggactcccgtgacgagattctacgtcggctaccacgtcgacgggtacggtcggccgtacgttcgtattcgacgtaggtcgggcccgagggtcgggagtacgtagaacgcgtgtaaccgtacttacgtgttacctacgtacgactaggactagcgtaggtacggtcaacggttcggaggggtactacggttccgggacgggtaggacccgtagggttccgaccgttaccgtagggacaccggtacccgaggcctaccggtcccctaccgggtcctaccgttccgttacccgttcccccaccccttcccgttcccgttacccg

SEQ ID NO: 112363 - DNA, 739 bp, Homo sapiens
  misc_feature: GYAE6OF01CAJ24.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggaccctctcctgctcccctcctcactttctgcacagtctctgaggcctcctatgagctgacacacgccaccctcggtctcagtcgtcccggacaaacggccaggactcacctgctcgtggagatgacagttacgaacctaaaaaatttcgtttggttttttacggaccaggacaaggtaagtcgacggaccgacggtccccttggtcgttggtcactccagtcggaacggacgaggacgaccggacccgtcgggactccgtacggaagtacggtactttcctacgtcgggtacctaccgtaacgtcgggaacggggtaccgggtccggaccgttacggttcgtaacgtttccgacgtacgggtcggggacccgtaggggttgggaacggtagacggaagtcgtagtaacgttacgttacgttcggttaacgcaaccgtaagacttaggtacgttggtacaggttaccggaagggggtttcgtacgggacgggaacggtaaccgtaaggttcgtacccgttccgtttaggccgtaacggacccgtaacggccgttcccggtaccccttcggtcccaccgtttcccgttaccgtttcccccgggtacccttccccgtttccgtccggttcccgttacccgg

SEQ ID NO: 112364 - DNA, 661 bp, Homo sapiens
  misc_feature: GYAE6OF01APMP7.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctcgtggagatgctattgaccaaaaagtatacttactttgttcggttccagcaagaagtcaggccacggccctgtactggtcactccagtgaggccagtcgacgacacgtccgggatcccgtagagagtacttctctcgcctccagctcgagggacagtcggacctaccgttgactagtacgacgggtcgggtaccgtagggtcggaacgtagtacggaagtcgtacgtaaccttaattacgtttacgtaccgacgaaccgtagtaacgtagtacggtcggtacgtagtacgggtaagggggttacgttcggggtaacgggtacgggtaaccgtaacgggttcgtacccggttaccgttcggttaccgaccggtacccgtaacggtcccgtaccccggtcccccggtcggtacccgtaccgttccgtcccgttccccgtccccccg

SEQ ID NO: 112365 - DNA, 779 bp, Homo sapiens
  misc_feature: GYAE6OF01C8L2K.21.30.C08.1.454.CMB.1.raw
tcagtcgtcgctcgcacgaccggtgctcgatttagtctgacgtcaaagggaaagggggtgggctcaggaggcagagctctgggtgtctcaccatggcctggatccctctacttctccccctcctcactctctgcacaggctctgaggcctcctatgagctgacacagccaccctcggtgtcagtcgcccaggacagaccgcaggatcacctgctctgacagatggactagaaccaaaagaatagtgtacttagttacggtaaccaacaaggaacgaccgacggccgaacggccctagttaggtagtagatataagtaaacgacaacgtggacgacggtcctacgacgtagacctacccgtaggacgacgtacgttcctcgtcggccttccgaagtcctacggaacgggacgaacggacgtaacggttaccgtaagtttacggtaacctagttaacgaacggttacgaaccggttaccgaaggaccgaaggaacggtaaggacggtactaacgtaacgtttaacttacgtaacgtaaccgaaaacgtaacggttaacggaaccgttaaagggtaaacggttaacggttaaccgtaacgggtttaaggggttaccgggtttacgggggtacccggggtaaccggggtaacggggtaaacccgaaaccgggttcccgggttaacccggtaacccccggggtttacggtaaaccgggttcccggttaaacccgggaaccccggttaacccggggtcccgttccccccgggttacccccccggg

SEQ ID NO: 112366 - DNA, 979 bp, Homo sapiens
  misc_feature: GYAE6OF01DTNSE.21.30.C08.1.454.CMB.1.raw
  modified_base (252)..(252): a, c, t, g, unknown or other
  misc_feature (252)..(252): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacagcccaccctcggtctcagtcgtccccgggacaaacggccaggtactccacctgctacgtgagatgactatcgaacctaaaaattnttgtttttacgacctagacgaagagtacgacggccgaacggtcccccgtggttgttcggtactactcccgtaagttcgggtaacgggaaccgtaacggggaacggaccccggtaacccccggttaccccggggtaaccgttaccccgtagggtaaacggtaacgtttaaccgtttccgttacccggtaccgggtacccgttaaccccgtaaaccgttacccggggtaaacggggggttacccggggttaccgggtaccccgttaaaccggtttcggttaaccgtttacgttacccgggtacgggtaccggggggttaccccgtaagggggttaccgggaaggggtaacgtacgggtaaacgtaccggttaccggttaaccgttaacggtttaccggttaacgtttaacccgtccggtaacgaccggtaacggtaacccgtaggtaaccgttaacgggttacgggtaccctaacggggttaccggggaacgggggtaccctaaggggttttaccgggggaccggggttaaccgggtaccgggtaaccggggttttaccggaaccccgggtttacggtacccgggttaccgtaaacccgggacccggtaaccgggttcccgttccccccgggtaccccccggtttaccggtaccccggttaacccctttcccggtttaccccgggtttccccccccggttcccccgtttcccccggttttaacccccgg

SEQ ID NO: 112367 - DNA, 748 bp, Homo sapiens
  misc_feature: GYAE6OF01C4G7B.21.30.C08.1.454.CMB.1.raw
tcagtcgtcgctcgcacgaccggtgctcgatttagtctgacgtcaaagggaaagggggtgggctcaggaggcagagctctgggaatctcaccatggcctcggacccctctcctgcctccccctcctctactttctgcacagtctctgaggcctctatgagctgacacacgcccaccgtcggtctcgagtcgtccccgggaacaaacggccaggtactcaccgtgctcgaggagatgactattacgaacctaaaaaattttgtttagtttttacggaaccagacaagaacgtcgacggtccaacggtcccgttggtcgttcggtacactcctagtacgaggacgacggaacgaccgtacccgtaccgacgtccagagtagtcttcgcgtcgacacctaaaccgtcggaagggtcggtacgaccgtacgttagtacttcgtagagggttaccgggaccgtagggtggaaggagtaggaacgtcgtacgtaactacttacgttacgttactaccgagacgaagacaacggcgtagtcggtagtacggtcgggaaggggtacgtaacggggttccgggaacggggtaccgggtaaccgtacgggttaaccgtaccggttaccggtaccgggtaaccgaacccggtaaccccggtaagggtcccccgttccgggaccccccggttaccggtaccttaccccgtacccgtttaccccgtaccccccccgttaccggtcccccggtaaacccggg

SEQ ID NO: 112368 - DNA, 698 bp, Homo sapiens
  misc_feature: GYAE6OF01BS9NI.21.30.C08.1.454.CMB.1.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagcccaccctcggtctcagtcgtccccgggacaaacggccaggatcacctgctctgganatgacattgaacctaaaaattnttagtttttaggaccagacagaacgtcgacggccacggtccctgtgttggtcatccagtggaaggacgaggacgaccgacccgtccgggactcccgtagaagagtacttctcgtcggcctacgaacgtcgaggggtacggtcggaccctacgttgacttccgtcgacgggtcggggaccctaggggttgggaaggtagtacggaaagtcgtacggtaacttaaccgttaacgttaggttaccctacgagtaaccgaacgaacgacgtacggtaaggttcggtacaacggttacgggaacgggggttcctaagggtttcccggggaacgggtacggggacccgtaggggttaccgaacccggttcgtaagggtaccaccggtacccgaaggtcccgaccccgtccccgtcggtacctacccgttcccgtcccttcccccgacccgtttccccg

SEQ ID NO: 112369 - DNA, 702 bp, Homo sapiens
  misc_feature: GYAE6OF01BLKKJ.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggatcacctgctctggagattcattgaccaaaagatatacttgttggttccagcagaagtcaggccaggccctgtactggtcatccatggaggccagtcgacgacacgtccgggactcccgtagagacgtacttctctcgccctcgagtcctcgaagggacaggtcggaccctacgttcgaactagtccgagggtcggggaccctagggtcggacgagtaggaacgtcgtaggtaaccttacgtaacgtttacggttaacccgacctaacccaacggaacgttaggttaaggtcggtacgtacggtacgggtacgggggggtttaacttccggggacggggtaacgggaacccgttaagggttccggtacccgggttccgtttacgggtaccgaaccggtaccccggtaaacgggtcccgttacccgggtacccccccggttacgggtaccccgttacccgtttcccggttccccggtttccccccggttccccccg

SEQ ID NO: 112370 - DNA, 853 bp, Homo sapiens
  misc_feature: GYAE6OF01CH0X1.21.30.C08.1.454.CMB.1.raw
  modified_base (134)..(134): a, c, t, g, unknown or other
  misc_feature (134)..(134): n is a, c, g, or t
  modified_base (250)..(250): a, c, t, g, unknown or other
  misc_feature (250)..(250): n is a, c, g, or t
  modified_base (685)..(685): a, c, t, g, unknown or other
  misc_feature (685)..(685): n is a, c, g, or t
tcagtcgtcgctcgcacgaccggtgctcgatttagtctgacgtcaaaggggaaagggggtggctcaggaggcagagctcgtgggaatctaaccatggcctggacccctctcctgcctcccctctctatttttcncgcaacgtgttcctctaggacggtcccttccgttattgacgcttaggaacacacgtccctacccgtggtgtcacgtccgtacccgaggaacaacggtcaggactccactgcttcgnggagtacttcagtacgaacctaaagtacttacgttcgtttggttccggttaccaaggtacgtaacggaacgttaccgaacggtcccgtaaccgtccccgtaggttacgttacggttacaccgttccgaagtacgggaccggtacctaacgggtaccggaaaccgtccgtaccggttcccggaccttaccgtagggtaactagttaccgttccgtacgttaccgaccttaccgaagtcccgaggaacgggtacgacgggttccggtaccctacctttagaccttacgtcggacgggtacgggaccgtaagggtacgaacgtaacgtacggtaaactcgttaacgtaacctttagttaccgtttaaggaaccgtaccaaccgtaaggtctaagggttacggtaccgtaccgaagggttaccggtaaccgggggtttntaccgggggacggtaaccgggtaacgttaacgggttcccggtaccgttaccgggtttcgaaacccggtcccggtaaccggtacccggttcggaccccccggttaaccccgtttcgggaccctttacccgtcccgggtttaaccccgtccccgtcccccggtttacccg

SEQ ID NO: 112371 - DNA, 769 bp, Homo sapiens
  misc_feature: GYAE6OF01DFBTN.21.30.C08.1.454.CMB.1.raw
  modified_base (574)..(574): a, c, t, g, unknown or other
  misc_feature (574)..(574): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgagcctcctatgagctgacacagccaccctcggtctcagtcgtcccggacaacggccaggactcacctgctctggagatgctattacgaacctaaaaaatttgtttgtttttacggacctagactaagtaacggttcacgggccctaacgggcccccttggttcggtttcgggtacctacttcccgaagttggaacggggaactaacgggacggtaaccggacccccggtaccggggaccttcccgtaggaacgtacgtaacgtttcctcgtacgggtccctaccgtaacgttacgggaacggggtaacccggggttcggtacccgttacggtttcggtaactttccgtcgtaagggtccggggtaccgtagggtgggacggtaagttagaacggtcgtacggtaaccttacgttacgttacgtttaaccncgtacgacgaacggtacaggtcgtaaggtcggttacgacggtcgggaaggggtcctagggttccgggacgggtacggtaaccgtcgggttcgacccggttacgtcggtaccaccggtaccgtacgggtcctccggacccccgttcggtaccctacgttcccttaccggtacccccctccgttcccgtaacccggg

SEQ ID NO: 112372 - DNA, 894 bp, Homo sapiens
  misc_feature: GYAE6OF01CPKC3.21.30.C08.1.454.CMB.1.raw
  modified_base (175)..(175): a, c, t, g, unknown or other
  misc_feature (175)..(175): n is a, c, g, or t
tcagtcgtcgctcgcacgaccggtgctcgatttagtctgacgtcaaaggggaaagggggtgggctcaggaggcagagctctgggaatctcaccatggcctcggacccctctcctgcctccccctcctctactttctgcacacgtctcgtgacggcctcctatggacgctgacacncgccctacctcggtctcgagtccggtacccgggaacgaaccggcgaggtactcaccgtgcctcgtaggacgtatcgtactacgttaaccgaaaaccttaaaaagttttgttttacgggtttttacggaccgaacggtaacgtaaggtaacgtacggaccgggaccgtacccgggtccgttggttcgggttcggtaccaacgttccgaaggtcgggaacgggtaaccgaacgggaaccgggtaaccccggtacccggtacccgggtaaccgttaccggagggtaccgtaacgtttccgttccgtccgggttaccggaccttacccggtaacggtaccggggaacggggggttaccggtaccggttaccgtaaccgggtttacgtacggttacccggtacgggtaccgggggtccggggtaaccgggtggggtacgggtacgtaacgggtacggtaacggttcgttaacgtaaaccttacggttaccggtttaacgttaaccggtagaacgggtaacaacggtacggaacgtacggtacgggtagtacccggtagggtaacgggcggggtttacggcgggggtacgggaaccggggtacgggtaaccggttggtaacccggtcggtaccggtacggtaccgaccggacccgagggtccctccgggtccccgtcgttaccttaccggtcccttaacccgtccctacccggtcccgtaccggg

SEQ ID NO: 112373 - DNA, 712 bp, Homo sapiens
  misc_feature: GYAE6OF01ESODK.21.30.C08.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctggacggccttcctatgagctgacacagcccaccctcggtctcagtcgtcccggacaacggcagactcacctgctctgganatgctattacgaacctaaaaatttntttgttttttaggaccagacagaacgtcgacggccacggtcccttggtgttgtacactcatggaggtacgaggacgaccggacccgtcggactcccgtagaagacgtacttcgtcgtggtccctaccgtaacgtcggacggggtacggtccggaccgtacggttgtacttccgttacgacggggttccggggaccgtagggtacggaagtacggtacggtaacgtcgtacgtaaccttacgttaacgttacgttaccacgtacgacaacggtacgaaggtcgtagggttacgtacgacggtacgggtacggggtactagggtaccgggacgggtaccggtacggtacgggttaccgaccggttacgacggtaccgaaccgggacccgtaacgggtcccgtacccggtccccgtacggtacccttaccgtcccgttccccgtaccccctcccgttcccttcccgg

SEQ ID NO: 112374 - DNA, 687 bp, Homo sapiens
  misc_feature: GYAE6OF01EI0KO.21.30.C08.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccacccgtcggtctcagtcgtccccggaacaaacggccaggatcacctgctcgtggagatgctaattgaacctaaaaaatttnttagttttttcggacagcagacgtcgacggccacggtcccttggtgttcgtcatccgagtggaggacgaggacgaccggacccgtccgggactcccgtagagacgtattccgtcgtggtaccctaccgaacctcgggaacggggaccggtacggcccgttaacggtttcgtaacgtttccgacggtacgggtccgggggacccgtaggggtacgggaggtaagtaggtaacgtcgtacgtaacgttacgtaacgttcgttaactacgagacagtacagtacgtagtgtacgagtcggagggtcgtacggtcgggagggacggtcgtacggtccgtaccggtacgtcgtacgaccggacccgaggcccgtcccggtcccccgtggtaccccgttacgttacccgttaccccgttcccctaccccgttccgttcccccg

SEQ ID NO: 112375 - DNA, 764 bp, Homo sapiens
  misc_feature: GYAE6OF01BT6ZD.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacacgcccaccctcggtgtcagtcgtccccaggacagacggccaggctcacctgctctgcagatggactgaccaaagaatntgtactttattaggtaaccaacaagaacgccgaaggccacggcccctgtagttacgtgattagtaataaagacacgtggacgacggtcccctagagacgtactcccgtaggacgcgtatttcctacgtacgggcctccgaacgtcctacggaacggggtaaccaggtccagtacccgtacggtttacggaacttaacgtaccgtaagggtacgtaaacgggttaccccgaaggggtaccgaaggggtaaacgggaaccgggtaagggtccttaaccgggttaaccttaaacgttttaccgttaacggtaacccgaaaaacgttcgggttaaacggaaaccgtagggttaacggttaaacgggttaaccttacggtaagggttttcggggttacgggttaccggggtacggggaaacgggtaacccgaacgggttaccttacggggtaaccccgttaccggtacggtacccgacggtaaccccgaagggtcccgttaacccggccccccgtttaaccggg

SEQ ID NO: 112376 - DNA, 802 bp, Homo sapiens
  misc_feature: GYAE6OF01DL5N6.21.30.C08.1.454.CMB.1.raw
  modified_base (425)..(425): a, c, t, g, unknown or other
  misc_feature (425)..(425): n is a, c, g, or t
  modified_base (768)..(768): a, c, t, g, unknown or other
  misc_feature (768)..(768): n is a, c, g, or t
tcagtcgtcgctcgcacgaccggtgctcgatttagtctgacgtcaaagggaaagggggtgggctcaggaggcagagctctgggaatctaaccatggcctggacccctctcctgcctcccctcctcactttctgcacagtctctgacgcctcctatgagctgacacacgccaccctcggtctcgagtcgtccccgggaacaaacggccaggactcgacctgctcgtggagatgactaagttacgaaacctaaaaaagtttgtttaggttttttacgaaccgtagaccgtaaggtaacgtcgaacgggaccctaccggtccccttggttacgttacggtaccaacgttaccgtagttacggaacggtaacaagggacgacccggtaccccgtaccggggtactcccggtagacgtagtacgtttccncgtcgcctacgaacgtcggaagggacgtcggaccgtaacgttgtaacgttcgtaccggtacgggtcggggtacccggtagggtacgggtaacggagttacgggaacgtccgtaacggttaaccgttaacgttaaggtttacgttaaccggacgtaaccgaacgtaacggtaacggttaacggttcgtaaccgtaaggttaccgggttagggggttaacgttacggggaccgggtaaacgggtaccgttaaaggttcccggtacccgtttacggtcggtaccgaccgtaccgacggtccgtaccccggtacccgtgtaccttaccgttccgtacctttcccccncgttaccccgttccgtacgttccgcgttaccggg

SEQ ID NO: 112377 - DNA, 729 bp, Homo sapiens
  misc_feature: GYAE6OF01A04SS.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggatattcattgaccaaaaagaatatacttgttggttccagcagaagtcaggccacggccctgtactggtcatccatggaggccagtcgacgaccgacgtcccgggactcccgtagagacgtattcctctcgcctccagtctcgaggactaggtcggccctaccgttggaccttagcgtagggtccgggggaccctaggggtgggaacgtagtacggaaacgtcgtacggtaaccttaacgttagttacgttaccgcccgtaaccgtaagaacctaagggttaggttcggtaccgtaacggtcgggggttaacggggttcggtttaccgggggacgggaaccgggtaacccggtaaagggttcccgggtaacccgggtttcccggtttaggggtacccaaccggggtacccccgtaaaggggtcccccgtaccccgggttcccccccggttaccgggttccccgtaaccgtttcccccggtttcccggttttccccccccgggtccccc

SEQ ID NO: 112378 - DNA, 829 bp, Homo sapiens
  misc_feature: GYAE6OF01BJFWH.21.30.C08.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaattnttgtttttggtaccagcaagatcgaggccaggcccctgtgttggtcagtccagtgaggacaggagaccgtacccgtccgggactcccgtagagagtacttctcgtggacctaccgaaacgttcggaaggggacccgggtggtaccctaacgggtttcgtaacgtttccgtacggtacggggtcgggggtacccccgtagggggttacggtaacgggggtaacgtcgggtaaacgggtccgttaacggtaacccgtttaaacgtttaaccgtttacgggttttaaaccgttaccggaacgggtacctaaacgggtaacctacgggtaccggtaacgggtttacgggtaccgtaggttaacccggggaaggggggtacctaacggggtttaccggggccggggtaacgggtaccggtaacgggggtttaccgaacccgggttacccggttagggttaaccccgaaccgggtaccccggtaagggtccccggtacccggtaccccccgggtacccggtttacccgtacccgtttaccccggttaaccccggtttcccccctaaacccccggtttcccccgttacccccgg

SEQ ID NO: 112379 - DNA, 912 bp, Homo sapiens
  misc_feature: GYAE6OF01CWC0B.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacagccaccctcggtctcagtcgtcccggacaaacggccaggactcacctgctcgtggagatgctattacgaacctaaaaaatttgtttgtttttaggacctagcaaggtaacgtcgacggccgacggtccccgttaggttcggttcggtacctaacgttcccgtaaggttcgggaacggggaaccgtaaggggaaccgtaaccccggtaccccgttacccgggggtaccttacccggttaggaacggttacgtaactttcccgtaccggttccggtaccttacccgaacgttaccgggaacgggggtaccgggtcggtaccccgtttaacggtttcggaaccttttccggtaccggtaacggggttcccggggggtaaccccgttaagggggtaggggtaacggggtaacgttaacgggaaacggtccgttaaccgggtaaaccttaaaccggtttaccgtttaacggttttaaccgccggttaacggaccgaaacggacgtaacggtaccgttaagggtaccggttaacgtaacgggttccggggaagggggtacccttacggggttcccgggggtaacgggaacggggtaccgttacggggttcccgtaaccccggttaccggtacgggttaccgaacccggtacccggagggttccccgtccccgggtaccccccgtttcggtaccctaccggtttcccgttaccccggtttcccccggtaccccttcccccgggtaacccggg

SEQ ID NO: 112380 - DNA, 758 bp, Homo sapiens
  misc_feature: GYAE6OF01B5BOD.21.30.C08.1.454.CMB.1.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctgganatgctattacgaacctaaaaaatttntttggttttttacggaccagcaagaagtcgacggccacggccctgtgttgtcactccagtggaggacgaggacgaccgacccgtcgggactcccgtagagtacgtactttccgtcgtcggtacctacctaacgtccggaacggggtaccggtccggaccgttacggttcgtacgtttccgtacgggtacgggttcccgggggacccgtaaggggttacgggaacgggtaagtacggaacggttcgtacgtaacctttacgttaaccgttacggttacctacgacgacgacgaaccgagtacgtagtcggtacgtacgtcgggacgggtcgtaggttaccggggacgggaacgggtaccgtacgggttaccgtacccgggttacgtaccgggtacccgaaccggtacccggtaacggtcccggttcccggtcccccccggttacggttaccccgtacccgtttcccgttaaccccggttccccccttccccgttcccccgtttaccccgg

SEQ ID NO: 112381 - DNA, 931 bp, Homo sapiens
  misc_feature: GYAE6OF01DZN0O.21.30.C08.1.454.CMB.1.raw
  modified_base (194)..(194): a, c, t, g, unknown or other
  misc_feature (194)..(194): n is a, c, g, or t
tcagtcgtcgctcgcacgaccggtgctcgatttagtctgacgtcaaagggaaagggggtgggctcaggaggcagagctctgggaatctaaccatggcctggacccctctcctgctcccctcctcactttctgcacagtctctgaggcctcctatgagctgacacagccaccctcggtctcagtcgtcccggaanaaacggccaggactcacgtgctctggagatgctattacgaacctaaaaaatttcgtttaggtttttacggaacctagacaaggtaacgtcgtaacggccgtaacgggtccccgttggttcggttacggtacctacgtacccgtaagtacgggtaacggaacgaaggaaccgggtaacccgtaccccggtaccggggtaaccttcccgtaaggtaacggtaacgttaacttccgttacgttacggcccgttaaccgtaaaccgtacggaacgggtacggttcggacccgttaggtttacgactttcgtacggtacgggttcggggacccgtaagggtacgggaacgtaagtacggtaacgtaccgttacggtaacctttaaccgttaacgttaccggtttaaacctaggtaaccggttaaccgtaaacggaacgtaccggtaacgggtaacggttccgggttaacaacgggggtacccggtaacggggggtaacgttaccggggtttaccgggggaaccgggggttacgggtaaacccggtacgggggttttacgaaacccccgggtttcgttaaaccggggtaccggtaaaccgggtaacccccggtaaaccggggtaccccgttccccggggttaaccccccgttacccggggttaaccttaaccccgtttcccgggtttaccccggtttaaccccccgtaccccctttaccccggttacccgttttacccccggg

SEQ ID NO: 112382 - DNA, 784 bp, Homo sapiens
  misc_feature: GYAE6OF01ACYOJ.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggaccctctcctgctcccctcctcactttctgcacagtctctgaggcctcctatgagctgacacagccaccctcggtctcagtcgtccccgggacaaacggccaggatcacctgctctggagatgcattcgaacctaaaaaatttgttgtttttacggaccagacaagaagtcgacggccacggcccttggtgttggtcactccatgaggacgaggacgaccgacccgtcgggactcccgtgaacgagtacttctcgtcggtccctaccaaccgtcggaacggggtaccgggtcggtaccgtaacggtttcgtaactttccggtacgtacggggtccggggtacccgtaggggtcgggaaggtacgtaacggaaacggtcgttacggtaaccttaaccgttaaccgtttacggtttaacccgtacgaacggaccgtaaacgaccgtaacggtaccgtagggttaccggtactaacgggtaccggggaacggggggtaccttacggggttccgggggtaaccgggtaacggggtacccggttaagggttcccggtaacccgtcgggttaccggaccggtacccggacccggtaacggtcccgtccccgggtcccccggttacggttcccgtaaccccgtttccgttacccccgttaccccccgtccccgtttccccgttaccccgg

SEQ ID NO: 112383 - DNA, 717 bp, Homo sapiens
  misc_feature: GYAE6OF01EKN3A.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggaccctctcctgctccccctcctcactttctgcacagtctctgaggcctcctatgagctgacacagccaccctcggtctcagtcgtccccgggacaaacggccaggatccactgctcgtggagatgctaattgaacctaaaaaatttgttggttttttaggaccagacaaggtaagtcacggtccgacggtccccgttgtcgttagtcatcatggaggacgaggacgaccgaccgtaccggactccctggacgtagtacttccgtcgtcggacctacctaacgtcggaagggtacggtcggaccgtagttacgtattccgtacgtacgggttcggggacccggtagggtacgggaagggtagtaggaacgacgttagtaacttaacgttaccgtacgttaacgtcacggtacgaagacgtacgactaggtaccggtagtacgtcgggtaagggggtctacgggttcggggaacgggtacgggaccggtacgggttacggaacccggttccgtacgggtacgaaccggaccggtaacggtcccgtacccggtcccccgtcggtttaccctaacccgttcccgttacccgtttaccccctcccgttcccgttaccccgg

SEQ ID NO: 112384 - DNA, 746 bp, Homo sapiens
  misc_feature: GYAE6OF01B1UYT.21.30.C08.1.454.CMB.1.raw
  modified_base (650)..(650): a, c, t, g, unknown or other
  misc_feature (650)..(650): n is a, c, g, or t
tcagtcgtcgctcgcacgaccggtgctcgatttagtctgacgtcaaagggaagggggtgggctcaggaggcagagctctgggaatctcaccatggcctggacccctctcctcgcctccccctctcacctctctcgcacaggctctggacggccctacctagtgacgctacgaccacgacgcccacccgtggtctcacgtccgtacccgaggaccgaacggcctaaggactccaccgtcggacttcggtaggaactcttcgaagttacgaaactaaaagtattacgtttacgtttggtacgttaccgagacaaggtacgcacggaccgcggtccctagtaccgttcggacctacgtaccgtagtacggaccggaccgtacgtaccggaaacccggtaccgtacccgggtaccgggtaccctaccggtggaacggtaacggttactttcccggtcgtaccacccgttaccgtacggtacctaccgggtaaagggacccgtaacgggtcccggtacccttaccgtttaaacgtaccggttaccggtaacgggtccggggtaccgggtacccgtaggggtacggaacggtacgtacgggaacgtcgtagtaacttacgttacgtacgtacgacctaacgagtacgagtcgttanacgtagtacgggagttcgacggtcggaacgtcgtagtaccgtccgtacgtgaccgacgcgacgtcccgtcgcccgttcgactccgtgtcccgtccc

SEQ ID NO: 112385 - DNA, 808 bp, Homo sapiens
  misc_feature: GYAE6OF01CI01J.21.30.C08.1.454.CMB.1.raw
  modified_base (255)..(255): a, c, t, g, unknown or other
  misc_feature (255)..(255): n is a, c, g, or t
tcagtcgtcgctcgcacgaccggtgctcgatttagtctgacgtcaaagggaaaggggggtgggctcaggaggcagagctctgggaatctcaccatggcctggacccctctcctgctccccctcctcactttctgcacagtctctgaggcctcctatgagctgacacagccacccgtcggtctcagtcggtccccgggaacaacggccaggactcacctgctctggagatcgactatacgaacctaaaaaaatttntttggtttttacggtacagtacaagtaacggtacacggaccgacggtcccgtggttgttggtacatccgatggaagacgaggacgaccgacccgtaccgggctccgtaggaacgtatacgttccgtcgtcggtacctaaccgaacgtcggaacggggtacggggaccgtacccgttacgggttactacgtttacctcgggtacgggtccgggggacccgtaggggtacgggagggtacgtaacggaacggtcgtaacggtaaccgtttaacgttaccgtacgtttaccgtacgtaacgacgtaaacggacgtacgcgtaacgggttagtaccgtaaggtacgggacgggggtacgtaccgggtacgggggaccggggtaacgggtaaccggttacgggttaaccggttccggttaaaccgacgggttaccgaccgggaaccccgtaacggggtcccggttccccggtaccccggtttaacccgggtaccccgttacccggtttcccccggttaccccggtttacccccccgttcccccgttcccggttccccg

SEQ ID NO: 112386 - DNA, 1000 bp, Homo sapiens
  misc_feature: GYAE6OF01EJXNG.21.30.C08.1.454.CMB.1.raw
tcagtcgtcgctcgcacgaccggtgctcgatttagtctgacgtcaaaaggggaaagggggtgggctcaggaggcagagctctgggaatctcaccatggcctggacccctctcctgcctccccctcctctactttctgcacagtctctggacgtcctctatgacgctgacacgacgccctacccgtcgtctcgtacggtccggtaccccgggaacaaaccggccgaacggtactaccgtaccgtcgtccgtcggtaggagtacgtcgacttaagttaaccgtaaaaacctttaaaaaagttttcggtttttacgggttttttaacggaacccgtaaggtaacgtaaaacggtaaccggttaccggaaccgggtaccccgtacccgggttcccgtttaggttacggtttacgtacctaccgtaccgaaggtacggaacggaacggacggaaccgtacccggacccgtaccggactccggtagtacgtagttccgttcgtacggtccgtaaccaccggtaaacggtcggggtaaccggggtaccggtcgtaacccgtttacggttagttaccgttacggtaaccgggtccgggggtaaccggtaccgggtagggtaacggggaagttaacggtacggtaacggtacgttaaccggttaaacctttaaccggttacgttaacgttaaccacgggtaacctacggtaaacgtcccgtaaggtacccggttaggtaccggtaccgtaacggggtaccggggtaacggggtccgttaccgggggtaccgggggtaaccggggttaaacgggttcccgggttaacggggttacccgggtaaacccgggttaccggtaccgggtaaccgggtaaacccccggggtaccccgttacccggggtaccccttacccccggggttaccccggttacccggttacccggttaccccgtttccccccgggttaccccggttcccccccgtacccggtccccgggtaaacccgggg

SEQ ID NO: 112387 - DNA, 741 bp, Homo sapiens
  misc_feature: GYAE6OF01D3RNP.21.30.C08.1.454.CMB.1.raw
  modified_base (130)..(130): a, c, t, g, unknown or other
  misc_feature (130)..(130): n is a, c, g, or t
  modified_base (197)..(197): a, c, t, g, unknown or other
  misc_feature (197)..(197): n is a, c, g, or t
  modified_base (475)..(475): a, c, t, g, unknown or other
  misc_feature (475)..(475): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctctctactttcngcacgagtctctgacggtcctctatgagctgacacagcccaccgtggtctcaggtcgtacccggaanaacggccaaggatccactgctctaggagtatcgctaattacgaaccaaaaaggtatacgtatttcggttacggtaccaagcgaagaacggttcacggtaccgacggtaccctaggtaaccgttggccaattccgatcggacggtccagtcgaaccgtagaccgttaccggatcccgtagacgacggtaacttcgttaccgtcgaccgttacgaaacggtccctaaggaccggggaaactcggtcggtaaccctaaccgtttaggaacctacggttaanccggtaaccggtacggggtacccggtaacgggtacggtaacggtaaacgtacggtaacggtaccgttacgtaacgttaacgttaacgttacgttaaccgtaccgtaaccgtaacgtaacgtacggttacgtacggtacgtagggtacgtacggggtacggtacgggacggacggtacgtaacggtacgtaccggtaccgtacggtacgacgaccgacggtcccgtaccgtacccgtaccggtaccgtaccgttccgtccgtacccg

SEQ ID NO: 112388 - DNA, 925 bp, Homo sapiens
  misc_feature: GYAE6OF01EEESD.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggaccctctcctgcctccccctcctcactttctgcacagtctctgacgcctcctatgagctagacacacgcccacccgtcgtctcagtccgtaccccggacaacggccaggatcctactgctcgtaggacagttgactagttaccgaaaaccttaaaaaagttttgttttacggttttttacggaaccgaggtaccgtaaggtaacgtaccgaccgggacccgtaccggttcccccggttggtttcggttcggtactaacgttccgaggttacggaacggaacggacgggtaacggtaccccggacccggttaccgggaccttcccggtagaaggtaacgtcctttcgtccggtacgacccgtaaccgtaacggtcgggtaacgggtacggtacggtacccttacgggtttatacccgttacgaccgggtaacggggtccggggtaacggtacggggtaggtaacggttaacgtacgggaactacggttaacccgtaaccgtttaacgttaaccgtttacgttacctaacgggaacgtaccggtaacgacggtaacgttaccggtacgggttaccggttaacggtacggtaccgggggttaacgggcgttaaccggggtaccggggggtaaccgggtaaccgggttaccgggtaaccggtttaccggaaccccggggttagttacccgggacccgggtaaacccggtcccgggtaaacgggttcccccggttacccgggtaccccccggttagtacccccggttcccgtttaccccgtttaacccccggttaccccccttacccccggttcccgtttaacccccgg

SEQ ID NO: 112389 - DNA, 712 bp, Homo sapiens
  misc_feature: GYAE6OF01AGQ4V.21.30.C08.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccacctcggtctcagtgtccccggganaaacggccaggatcactgctctgganatgcattgacctaaaaaattnttgttttttggaccagcagaagtcaggccaggccctgtgttgtcatccatgaggacaggagacgacccgtcgggactcccgtgacgagtattcgtcgtcggcctaccaaccgttcgaacggggacggtcggacccgtaacgttgaacgtttcgtacgaacgggtcggggtaccccgtagggtacgggaaggtacgtagggaacgtccgtacggtaaccttaaccgttaacgttacgtttaaccgtacgtacgacaacggaccgagaccgtaggtacggtaccgaacgtacggaacgggggtcgtaacgttacggggaccgggtaacgggtaaccgtaacgggttaaacccgtccggttaacgggtaccaacggtacccgtaaacggtccgtacccggtccccccggtacggtacccgtaccgttcccgttacttacccccccgtacccttcccccgttcccgtttaccccg

SEQ ID NO: 112390 - DNA, 966 bp, Homo sapiens
  misc_feature: GYAE6OF01APJEI.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggaccctctcctgctccccctcctcactttctgcacagtctctgaggcctcctatgagctgacacacgcccacccgtcggtcctcaggtccggtaccccgggaacgaaaccggccaggactacacctcgctcgtggagtagtcgacgtaattacgaaaaccttaaaaaagtttacgtttacggttttttaacgtaccgaggtacgtaaggtaacgtaccgacggacccgaccggtccccgttaggttcggtttacggtactaaccgttaccgtaacggtaacggagggaaaccgaacgggtaacccggaacccggttaacccccggttcccgggtaacccgtaccccggttaagggaacgtttaacgtaacgttttccgtaccgggtccgtacccgtaacccgtaacgtccgggaacggggtaccgggtcggtacccgtaacggttcgttacttccgtaacgggtcgggtacggggtacccgtaggggtacggtaacgggtagtacggtaacggtacgtaaccggtaacttaacccggttacgttacggttaacgtaaccggtacgacgtaaacgggaaccgtacggtaacgtacgggttactaccgtaggggtaccggggtaacgggtacggttaaccggggttaccgggggtaaccggggtaacggggtacccggtttaacgggtaacccggggtaccccgttaccgggttaaaccggtacccgggaaccgggttaaacccccgggtaacccggtacccggttccccccgaacccccgggtttaccggtacccgtttaacccccgggttacccggtttccccccgtttaaccccccggtcccccgttacccccggtttccccggg

SEQ ID NO: 112391 - DNA, 751 bp, Homo sapiens
  misc_feature: GYAE6OF01CZ4Q7.21.30.C08.1.454.CMB.1.raw
  modified_base (262)..(262): a, c, t, g, unknown or other
  misc_feature (262)..(262): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctctactttctgcacagtctctgaggcctcctatgagctgacacacgccaccctcggtctcaggtcgtccccgggaacaaaccggccaaggactccacctgctcgtggacgtatcgacaattacgaacctaaaaaaatttntttggtttttacgaccagtacaagaacgtcgacggccaacggtcccttggtcgtttcggtactactaccagtggaacggtacgaagggaccgaccggaccccggtaccgggtactacccgtaggaacgtacgtacttccgtacgtcggtacctacctaaccgttaccggacggggtaaccggtcggtaccgtacggtttagtacgtttcgtacgggtagggttcccgggggaccgtaaggggtacgggaggtaacgtacggaacgtacgtacgtaaccttaacgttacgttacgttacctacgagtacgacgactaagcgtaaggtcgtacacgtcggacggggtactagggttccgggcgggtaacggaccggtaggttccggtacccgttacgtacggttaccgaccggaccgtaacggtcccgtacccgtccccgtcggtacccttaccgtacttcccgttacccctaccccggtcccttacccgg

SEQ ID NO: 112392 - DNA, 927 bp, Homo sapiens
  misc_feature: GYAE6OF01BZCF4.21.30.C08.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctcctctactttctgcacagtctctgacggcctcctatgagctgacacagccaccgtcggtctcagtcggtacccgggaanaaccggccaggactcacctgctcgtaggactagtgtactagttacgaaacctaaaaaatttcgttttaggtttttacggacctaaggtacaaggtaaacgttcgaacggaccccgtaacggtcccccgtttaggttcggtttacggtacctacgttacccgtagttacgggaaacggacggtaacggggaccgtacccggtacccccggtacgggtaccttcccggtaagtacgtaacggtactttccgtccgtcgggacctaacccgtacgtacggtaacggggtcgggtaccgtaccggttacgttacggtacgtttccgtacggtacggggttacccggggacccgtaaggggtcggggtaaaggtaaccgttaagggaaccggttaccgttacggtaaacccgtttaacgtaaaccggtttcgttaaaccgtaccgggaacgttaccgaacgggttaaacgacgggttacgtacgggttacggtaacgtacgttaaccgggggaacgggggtaacttacggggtacccggggtaaccgggtacgggttaacccgttacggggttaacccgggtaaccccgggtttaccgtaaaccgggtaccggtaaacccggtacccggtaaaccggggttcccgtaaccccccgggtcccccggtttaggtaccccgttaaccggtttcccgttacccccggtccccgtttcccccgtacccggtaacccggg

SEQ ID NO: 112393 - DNA, 913 bp, Homo sapiens
  misc_feature: GYAE6OF01C22QL.21.30.C08.1.454.CMB.1.raw
tcagtcgtcgctcgcacgaccggtgctcgatttagtctgacgtcaaagggaagggggtgggctcaggaggcagagctctgggaatctcaccatggcctcggaccctctcctgcctcccctctctactttctgcacagtctcgtgacggcctcctagtgagctgacacacgccctaccgtcggtctcgtacggtccggtaccccgggaacgaaaccggcctaaggactaccgaccgtcgtccgtggtacggaacgtagcgtacgtaactttaacggaaaaccttaaaaaagttttcgttttaggtttttaaccggaaacctaaggtaccgaaagggttaaccgtacggaacggttcccgaccggttcccggtttaggttcggttacggtactacgttaccgaaggtgggaacggaacgacgggtaaccgtaccccggtacccggtaccgggtacctccggtaagtacgtacgttacttccggtacgtaccggtacctaccgtacggcgggtaacggggtcggtaccgtacgttacggttacgttacgttccgggacgggtaccgggtacggggtacccggtaaggggtacggggtaacgaggtttaaacggacggttaccgtaggtttaaacccttaacgttcggttaaacgtccgaaggaccagggttaacgaacggacgtttacgggacgggttgaacggttacggggagggtaccgggtacggtacgggggttaccgggaacgggggttaccggtaaccgggttacgggttaaaccccgggtcggtaccgggtaaacggggtaccccaaaccgggttaccggtaccgtccccgggttacccctaccggttccggttaacccttcccggtacccgttccccggttaccccctcccggaacccggtacccggg

SEQ ID NO: 112394 - DNA, 744 bp, Homo sapiens
  misc_feature: GYAE6OF01A0T7U.21.30.C08.1.454.CMB.1.raw
  modified_base (192)..(192): a, c, t, g, unknown or other
  misc_feature (192)..(192): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgaggcctctatgagctgacacagccacctcggtctcagtgtccccggganaaacggccaggactcacctgctctgagatgcatgaccaaaaattntgtttttgacagcanagtcaggccaggccctgtgtcggtcatccatgtaggacgtaggagaccgacccgtccgggaactccccgtaggacggtacgtaacttcgttcctagggtcccttacccaacgttccgaacgggggtaacgtcggtaccgtaacggttcgtaactttcgtccgtaagggttccggggaccccgagggttacgggtacggaacggtacggtaagccgttacgaacttacccgttacgttacggtttaacctaccgtaacggtccgaaacggtaccgtaacgggacctaaaggttcgggtaacctaacggtacgggtaaccggggggtacttacgggttcccggggaacgggtcggaaccggtcggggtttacgacccgggtttaccgtacggggtaccaacgggtacccgaacggggttccgtcccgggacccccttcgggttacctaccttcccggttaccgtttcccccggaccccgttcccgtaacccggg

SEQ ID NO: 112395 - DNA, 860 bp, Homo sapiens
  misc_feature: GYAE6OF01A7V2U.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgctattgaccaaaaaattattgtttttgaccagcagaagtcaggccaggccctgtgtggtctatccagtgaggacaggacgaccgacccgtccgggactcccgtgagagtacttctacgtggcctaccgtaacgtcgtacggggtaccggtcgggaccgttaacggtttcggtaacgtttccgtaccgtacggggttaccggggggtaccccgtagggggtacggggtaacgggtaacggtacgggtaaaacggccggtttaacggtaacccgtttaaccccgtttaaccggtttacggttttaaacccgttaccggaacggttaacccgaacgggtaaccgaacgggtacccgttaaggggttacgggttaacccgtacggtaaccgggggtaaccggggggtaccgtaacggggtttccggggggaaccggggtaacgggggtacccggttacgggttaccgggtaacccgggtttacccgggttacgggtaaccccggaaccggtaccccgtaaacggggtccccgtacccccggggttaccccccgttacccgggttaccccgtacccggtttaccccggtttaccccggtttcccccccgggttccccgttcccccggttaacccccgggg

SEQ ID NO: 112396 - DNA, 850 bp, Homo sapiens
  misc_feature: GYAE6OF01AZWF2.21.30.C08.1.454.CMB.1.raw
  modified_base (159)..(159): a, c, t, g, unknown or other
  misc_feature (159)..(159): n is a, c, g, or t
  modified_base (232)..(232): a, c, t, g, unknown or other
  misc_feature (232)..(232): n is a, c, g, or t
  modified_base (588)..(588): a, c, t, g, unknown or other
  misc_feature (588)..(588): n is a, c, g, or t
  modified_base (595)..(595): a, c, t, g, unknown or other
  misc_feature (595)..(595): n is a, c, g, or t
tcagtcgtcgctcgcacgaccggtgctcgatttagtctgacgtcaaagggaaagggggtgggctcaggaggcagagctctgggaatctcaccatggcctggaccctctcctgcctccccctcctcactttctgcacagtctctgacggcctcctatganctgacacacgcccacccgtcggtctcagtccggtcccgggacaaacggccaggactcaccgtgctcgtggagntgactatacgaaacttaaaaagtttgttttacggtttttacggacctagtacgaaggtaacgtccgacggtccgacgggtccccttagggttcggttacggttaccaacgtaccggtaagtacgggaacgggtaacgaacggggtaaccgacccggtacccggtaccgggtacttcccggtggaacgtacggttacttcccgtacggtaccggcctaaccgtaccgtcgggacggggtacccggtacggtccgtaacgttcgtacgttacgtacgtacgggtccggggaccgtaggggtacggaagtcgtaacggaacgttaccgtagaaccctttacgtaaccggttaccgttanaccgganacccggttagaccgtaggtacggacgttacggacgtacggtacgggacgggttccgtacggggttaccggggacggtaaccggggttaccgtacgggttacccggttaccgtaacccgggttacggacccggttaaccggacccccgggtttaaaggcccccggtaccccgtccccgggtttaccgttaaccccgttacccggggtttcctaccccccggttcccccggggtaccccttcccggtaaaccccggg

SEQ ID NO: 112397 - DNA, 758 bp, Homo sapiens
  misc_feature: GYAE6OF01DX0L6.21.30.C08.1.454.CMB.1.raw
tcagtcgtcgctcgcacgaccggtgctcgatttagtctgacgtcaaagggaaagggggtgggctcaggaggcagagctctgggaatctaaccatggcctggaccccctctcctgcctccccctcctcactttctgcacagtctctgaggcctctatgagctgacacacgccaccctcggtctcgagtcgtcccggacaaacggccaggactcacctgctcgtggagatcgctattacgaaacctaaaaaatttgtttggtttttacggaccagacgtaagtaacgtcgaacggcccacggtcccctggttgttacggtactacttaccagtcggacggaacgtacggaacgtacccggaccccgtaccgggtacctcccgaggtaacgtacgtacttccgtcgtcggtacctaccgtaacgtcggaacggggcggtaccgtaccgtagtttacgtaacgtccgtacgtacggggtccggggtacctaaggggtaggacggtagtacggaacgtctaagtaccttaacgttacgtttcgtaactacgacgacgtaagaccgacggtacgtacggtttacggctaccgggtaggtacgggggtccttacgggtaccgggggacggtaacggggtcgttaaccgggttaccgaccggttcgaccgggttacgacccgtaaccggtccggtccccgtacccggtccccgttcggtacccctacgtcccttaccccggtcccctcccttccgttcccgttccc

SEQ ID NO: 112398 - DNA, 848 bp, Homo sapiens
  misc_feature: GYAE6OF01DC8LN.21.30.C08.1.454.CMB.1.raw
tcagtcgtcgctcgcacgaccggtgctcgatttagtctgacgtcaaagggaaagggggtgggctcaggaggcagagctctgggaatctaaccatggcctggacccctctcctgcctccccctcctcactttctgcacagtctctgacggcctcctatgagctgacacacgccacccgtcggtctcagtccgtaccccgggacaaacggccaggactccacctgctcgtggagatgctagttacgaaacctaaaaaattttgtttacggttttttacggaaccgagtaccgaaggtaacgtccggacggacccgtacgggtcccccgttggtttcggttcggtacctacgttccgaggttacggaacgggtaaccgacggggaaccgtaccccggtaccccggtaccgggtaacctcccggtaggacgtacgttactttccgtcgtaccggtacccttaccgaaccgttaccggaacggggtaccgggtaccggtacccgttaacggtttacgttacgttccgtacggtacggggttaccgggacccggttaagggtacgggaacggtagtaaggtaacgtccgtaacgttaccgttaacgtttaaccgttcgttaaccgtacgtaccggacgacgtaccgacgtacgtacggtttcggacctaggtaccgggagggtccgtaggttccggggacgggtaccggtacggttacgggttccggtaacccggttccgtacgggtacccgacggacccggtaaccggtcccggtaccccggttcccccgtaccggtacctcccgttacccgttcccgttaccccccgtacccttcccgttcccgttaccccg

SEQ ID NO: 112399 - DNA, 776 bp, Homo sapiens
  misc_feature: GYAE6OF01D45OC.21.30.C08.1.454.CMB.1.raw
  modified_base (193)..(193): a, c, t, g, unknown or other
  misc_feature (193)..(193): n is a, c, g, or t
  modified_base (239)..(239): a, c, t, g, unknown or other
  misc_feature (239)..(239): n is a, c, g, or t
tcagtcgtcgctcgcacgaccggtgctcgatttagtctgacgtcaaagggaaagggggtgggctcaggaggcagaactctgggtgtctcaccatggcctggacccctctcctgctccccctcctcactttctgcacagtctctgaggcctcctatgagctgacacagccaccctggtctcagtgtccccgganaaacggccaggatcacctgctctggagatgcattgaccaaaaattntgtttttgaccagcagaatcagccagccctgtgtgtcatcatgagcagtcgacgacacgtccggatcccgagagacgtatctcgtgcctcgagtctcgaggacagtcggaccacgttgaacgtactacgacggttcgggaccctagggtcggaaccgtattacggaacgtacgtacgtaaccttaacgttaacgtttaaccggttaccgtaccgtaaccctaaggtaaaccgtaagggttaaccgttacgggttactaaccggtttaacgggtaaccggggggtttaacggtttacccgggggaaccgggttaaaccggggttaaaccccgtaaacgggttttacccgggaacccggttttacccgtttaacgggggttacccctaaccgggtaacccccggtaaaacggggttccccttaacccggttaccccccccggtttaccgggttaaaccctaccccgggttttacccgtttacccgggtttaaccccccccggtaacccctttcccccgtttacccccggtttaccccgg

SEQ ID NO: 112400 - DNA, 926 bp, Homo sapiens
  misc_feature: GYAE6OF01DNJAC.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctccccctcctctactttctgcacagtctctgacggtcctcctatgagctgacacacgcccacccgtcggtctcgacggtccggtaccccgggaacaaaccggcccgaaggtactaccgacccgttcggccttccgtagggaacgtagtcgaccgttaagttaacggaaaacccttaaaaaaagtttttgtttacgggtttttttaccggaacctaacggtacgtaaaggtaacggttaccggaaccgggtacccgtaaccgggttccccgttagggttacggtttcggtacctacgttaccgtaggttaacgggaaggtaacgaacgggaaccgtacccggtaccccggtccgggtaaccgtcccggtaagaacggtacgtacgtttccgacggtaccggtacctaccgtaaccgtacggggtaacggggtaccggtccggtacccgttacggtttaacgtaccgtttaaccgggtacggtaccgggggtaccggtacccgggtaaggggtagggtaacggtacggtaacggaacgtaccgtacggttaaccttaaccgtttacgttaccggttaccgtaaccgtaacggaaccgtaaggaccgtaacgacggttacgggtagtacggtaacgggttacgggaaccgggggtactaacgggggtaccggaccggggtaacggtaaccggtacgggttacggacccgttaccggtacgtaccgaccgggtaccgtacggcccgttcccggccccgttacgtacccgttaccgttcccgtccccggtttcccccgcccgtttcccgtaccccg

SEQ ID NO: 112401 - DNA, 849 bp, Homo sapiens
  misc_feature: GYAE6OF01CXWVD.21.30.C08.1.454.CMB.1.raw
tcagtcgtcgctcgcacgaccggtgctcgatttagtctgacgtcaaagggaaagggggtgggctcaggaggcagagctctgggaatctaaccatggcctggacccctctcctgcctcccctcctctactttctcgcacagtctctgacggtcctctatgacgctgacacacgcccaccgtcgtctacgacggttccggaccccgggaacaaaccggccgaggtactccaccgttcgcctcggtggaagtactcgactagttaacgtaaaaacttaaaaattttcggttttacggtttttaacggaccgagtaacgtaaggtaacgtcgaccggtaccgaccggtcccgttaggttcggttacggtactactaccgtaggtacggacgaacggacggaccgacccgtccgtaccggactcgagactacgttactcgtacgtcgtaccctcggacgtcgacggaacggtacacggtccgtactacgtataccgtagggtacgtaccggggacgtaccggtagggaaccgtagtacgggtaacgtaaccggtctaaaccgttgtttaaacgttcgttaacggtaaccgtacctaacggtacgtacggtaacggttacggttacggtaacgttacgggttacggggtaacggggttaaccggtaccgggggaacgggtaccgggtaaaccggttttacggacccggtttacccggtttcggtaaacgggtccccaccgggttaaccggcccggtaccgttcccccggtacggttacccgttccccgtacccggtttacccgttcccccgggttacccccaccccggttttaccccgtccgtttccgtacccgg

SEQ ID NO: 112402 - DNA, 789 bp, Homo sapiens
  misc_feature: GYAE6OF01DRWKX.21.30.C08.1.454.CMB.1.raw
  modified_base (252)..(252): a, c, t, g, unknown or other
  misc_feature (252)..(252): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacacgccaccctcggtctcagtcgtccccgggacaaacggccaggatcacctgcctctggagatcgctattacgaacctaaaaaatttntttaggttttttacggaaccagacaagtaaacgtctaacggcccgaacggtcccccgtggttcggttacggtccaacttccaagttcggacggaacgtaggacgaccggaccccgtaccggggtactacccgtggagtacggtaacctttccgtacgtccggtacctacccgaaaccgttcggaacgggggttccgggtaccggtacccgttacggtttagttaacccgttcgtacccgtcgggggtttaccggggaccccgtagggggttacgggaaacggttaggtaacggtaacgtccgttaacggtaaccttaccgttacgttacgtttaaccgaacgacgtaaccgacgtaacgcgtaccgtaggttcgtacgacgtacgggaacgggtctaacgggttcgggaccgggtacgggaactacgggtaccgtccggtaccgtacgtccgaaccgaccgtaaccggtcgttccccggaccccgttgtacccgtccttaccggttccccgtcccgtcccccttcgtcccgttcccg

SEQ ID NO: 112403 - DNA, 714 bp, Homo sapiens
  misc_feature: GYAE6OF01A3TXP.21.30.C08.1.454.CMB.1.raw
  modified_base (254)..(254): a, c, t, g, unknown or other
  misc_feature (254)..(254): n is a, c, g, or t
  modified_base (429)..(429): a, c, t, g, unknown or other
  misc_feature (429)..(429): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacacgcccaccctcggtctcgacggtcgtccccgggacaaaccggccaggactcacctgctctggagatgacattcgaacctaaaaatttnttgtttttaggaccagcagtaagtcacggccgacggtccccgttgtcgttggtactacgtaccgtagtggaacggacgaggacgaccgtacccgtcgggactccgtagagtacgtacttcgtcgtcggtacctaccgaacgtccggaaggggaccgggttcgaccgttacggttntaacgttccgtacggtaacgggtccgggaccgtaggggtcgggaacgggtagtacggtaacgtcgtacgtaacgttacgttaacgttcgttaactacgtaacgcgtaacgacgtagacgtaggttacgtctaacgtcgggtaggggtccttagggtacgggcggacgggtaccgtacggttcgacccgttccgtaacggtccgaccggtaccggtacggccgtccccggtccccgtagtacccgtaccttcccgttacccgttccccctccgttcccccgtaccg

SEQ ID NO: 112404 - DNA, 701 bp, Homo sapiens
  misc_feature: GYAE6OF01BQNXX.21.30.C08.1.454.CMB.1.raw
  modified_base (179)..(179): a, c, t, g, unknown or other
  misc_feature (179)..(179): n is a, c, g, or t
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagaactctgggtgtctcaccatggcctggatccctctacttctccccctcctcactctctgcacaggctctgacggcctcctatgagctgacacagccaccctggtntcagtcgtcccaggacagacggccaggactccacctgctctgcagatggactcgaacaaagtaatntagtctttatacggtaaccaactacggaacgaccgaggtaccgacggtacccccttgttacggttagtagtaattaataagtaaagtaacgtacgtaggaacgaccgggtaccctacgaacgtaagaccttaccgtaggacgtacgttaaccgtttctccgtacggtacccttccgaggtccgtacgtaacgggacctacggtaccgtacgttacctaacggtacgtacctagtcggtaagtacggtaacgttacggaacggacgtaagggacgggacggagtacgtacgtactaactttacggtataacgtaaacgaagtaacgtacgtaggtaacgtaagttctacggtaggttaggttcggtaggtacggaacggtacgaaccgttgaaccggtccgttacgtaccggtaccgtaggaacccggtaccgtaccgccccgtacccggttcccgg

SEQ ID NO: 112405 - DNA, 811 bp, Homo sapiens
  misc_feature: GYAE6OF01B23LL.21.30.C08.1.454.CMB.1.raw
tcagtcgtcgctcgcacgaccggtgctcgatttagtctgacgtcaaagggaaagggggtgggctcaggaggcagagctctgggaatctaaccatggcctggacccctctcctgcctcccctcctctactttctgcacagtctctgacgcctcctatgagtctgacacacgcccacccgtcggtcctctacgtcggtaccccgggaacaaaccggccaggactccgacctcgcctcgtggacgtatgactagttacgtaaacctaaaaaagtttgtttacgtttttacggaacctagtaaccgaagtaacgtcgacggtccgacggtcccgttaggttcggttcgtactacgtccgagttagggacggtacgtaacggacgtaaccgtacccggtaccggtactacccgtaggtaacgtacgttacgttcgtacgtacggaccttaaccgaaacgttcggaacgggtaccggtacgccgtacgttacgtaacgttcgacggtaacggtccggggtaccgtaaggggttggaaacgggtacgttaacggacggttacgtacgttaacccgttacgttaccgttaacgttaccgacgtaaacgccgtaaacggaacgttacgacgttacgggtacgtacggtacggtacggggaacggtccgttacgggtccgggaacgggtaaccgggtcgttacgggttaccgaccggtaacgttcggacccgtaagtccccgttaacggccctcccggttaccggtaccgttccaccggttacccttcccggtacccctacccgttccgtcccgttacccg

SEQ ID NO: 112406 - DNA, 928 bp, Homo sapiens
  misc_feature: GYAE6OF01BZPJZ.21.30.C08.1.454.CMB.1.raw
  modified_base (154)..(154): a, c, t, g, unknown or other
  misc_feature (154)..(154): n is a, c, g, or t
  modified_base (156)..(156): a, c, t, g, unknown or other
  misc_feature (156)..(156): n is a, c, g, or t
tcagtcgtcgctcgcacgaccggtgctcgatttagtctgacgtcaaagggaaagggggtgggctcaggaggcagagctctgggaatctcaccatggccctggaccctctcctgcctcccctcctctactttctgcacagtctctgcgcctctangntctgacacgacgcccaccgtcggtgtcacggttccgacccgaggaaccgaaacggcgaaggtactcgaccgtcggtctacgagggatacgttactaacgtacgaaaccgtaaaaagtattacgttaaccgtttggtttaccggtacctaacggacgaaggtaacgtccgtaaccgggcccgtaaccggtccccgttaggtacccgtcgggttaccaccgttacgacggtacggaccggtacccgtaggtacccggaaccgtaccgaacccggtaccgggtaaccttcccggtagaccggtagtaaccgtttccgtaccgttcctccgtaacccggactacccggtaggaccgggaacgttaccggtaccggtacccctacggttaacgaacccttacggtacgggtaccggggttaccggggtccggtaaaccggggttcgggaaacggtacggttaaaccggtacgggttaccgtaacggtttaaccgtttacgttaacggttttaacccggtaaccgtaacccgaaccggttaacgggtaacccgttaagggtttacccggtcggttaacggttaaccggtaacgggggtttacggggtaccggttcgggggtaacgggaccgggtaaccggtacggttaccggggtacccgttacgggttaccgtaccggtaccggtaccggtacccggtccgggttcccccggaaccccggttcccggttaccttaaccccggttcccggtttccccggttcccccgttacccccggg

SEQ ID NO: 112407 - DNA, 849 bp, Homo sapiens
  misc_feature: GYAE6OF01C5MSD.21.30.C08.1.454.CMB.1.raw
  modified_base (135)..(135): a, c, t, g, unknown or other
  misc_feature (135)..(135): n is a, c, g, or t
  modified_base (139)..(139): a, c, t, g, unknown or other
  misc_feature (139)..(139): n is a, c, g, or t
  modified_base (787)..(787): a, c, t, g, unknown or other
  misc_feature (787)..(787): n is a, c, g, or t
tcagtcgtcgctcgcacgaccggtgctcgatttagtctgacgtcaaagggaaagggggtgggctcaggaggcagagctctgggaatctcaccatggcctcggacccctctcctcgcctcccctcctctactttcngcancgtctcgtgacgtcctctatgacgcgtcgacacacgcccacccgtcgtctacgcggttccggacccggtaacgaaccggccgacggactaccgaccgtcgtcgtcgtaggagacgtacgactataacgaaacttaaaaagttttcgtttacggtttacgtaaccgagtaacgtaacggtaacgtacggacggtacccgtacggtccgttggttacggtacgtacgtaccgtaccgtaggtagggaaccggtacggtaacgggtacccgtaacccggtaccccggtacggtaccgtaccggtaaggtacgtacctagttccgtacggttccgtaaccgtaccgtaacggtcggggacgggtccggtaccgtacgttacggtacgtacgttcggacggtacggggtaccggacgtacgggacgtacgtaacggtacacgggttccgtaactaaccgttacgttaaccgttcggaaacccgtcggtaaaccgtagttaaaccggtaggtttcgtaaccggtttaccgaaggggttaccgggtaacggggttaccgggccggggtacggtaaacgttaccgtaacgggttcccttaaccgggcgttaccgacgtacccggtacccgcgttaccggtaccccttccggtaacncccgtttccccgtaccgtcccccggtaccttacccgtccgttcccttagtccgttacccggg

SEQ ID NO: 112408 - DNA, 760 bp, Homo sapiens
  misc_feature: GYAE6OF01BF71F.21.30.C08.1.454.CMB.1.raw
  modified_base (528)..(528): a, c, t, g, unknown or other
  misc_feature (528)..(528): n is a, c, g, or t
tcagtcgtcgctcgcacgaccggtgctcgatttagtctgacgtcaaagggaaagggggtgggctcaggaggcagagctctgggaatctcaccatggcctcggaccctctcctgcctccccctcctctactttctgcacagtctcctggacggccttacctatgagctgacacagcccaccgtcggtgtcaggtcgtcccaaggacaaacggccaggactcacctgcgtctagagtcttacattcgaacctaaaagtattacgttacgttttggttacgttaccaagtacgtaaggtaacggtaccgacggtaccccacggttcccgttagttaactcggttaccacttccgagtcggaacggtccgacgttcgaacgtaccaccggttaccggactttccgacgtagacgttacttcctacgtccgtaccgacgtacgttccgacgtaacggggacgtaggttcccgggaccctaacgtttcgaaccgttaagtcggtaacgggtcgggaccgtagggtacgtaacgngtaagaacgctaacggtacttacgttacttacgtaccgtacaacgtacgacgtagtaggtcgtaacgtacggtacgggtacgggggtacgttaccggggtacggacgggtaaccgttacgggttaacggtacccgttccggtacgggtacccgtacggaaccgtacggcccgttacccgacccccggttacggtacccgttccgttacccgttccccgtcccccgtaccccg

SEQ ID NO: 112409 - DNA, 708 bp, Homo sapiens
  misc_feature: GYAE6OF01DHQ3P.21.30.C08.1.454.CMB.1.raw
  modified_base (135)..(135): a, c, t, g, unknown or other
  misc_feature (135)..(135): n is a, c, g, or t
  modified_base (140)..(140): a, c, t, g, unknown or other
  misc_feature (140)..(140): n is a, c, g, or t
tcagtcgtcgctcgcacgaccggtgctcgatttagtctgacgtcaaagggaaagggggtgggctcaggaggcagagctctgggaatctaaccatggcctggacccctcgtcctgcctcccctcctctacttttcngcacngtctcgtgacgcctctatgagctgacacacgcctaccgtgtgtcacgtccgtacccgaggacacggtacggaccaggacttccgaccgtcgctcgtgacaagtgtacggactacggaaactaaaagtatacgtcgttacgttagtacggtaaccaacgacgaacgaccgtacggaccgtaccggtaccgttggttacgttacgtaacgtaattaacgtaaacgtaaatacgtaacgtacggacggtaccgacctaagacgtaactcgtacgagacgtacgttacttccgtcgtacggtacctacgacggtaccacggtaacggcgtacgacgtacgttacgtacgtcgtacgtacgtagtaacgtacacggtacggaggtacgaaggacggagtcgtacgttagacttacggtaactacgaactaagaacggtcaacgtaggttacgtaacgtctaggtcgggttacggacggttcggaaacggacgtacggtacggtccgttaagggtaccctaggtccgaacctccgggtaacgccggttaccctcccgtacgtccgttaacccgg

SEQ ID NO: 112410 - DNA, 893 bp, Homo sapiens
  misc_feature: GYAE6OF01CSRTS.21.30.C08.1.454.CMB.1.raw
  modified_base (157)..(157): a, c, t, g, unknown or other
  misc_feature (157)..(157): n is a, c, g, or t
  modified_base (185)..(185): a, c, t, g, unknown or other
  misc_feature (185)..(185): n is a, c, g, or t
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (492)..(492): a, c, t, g, unknown or other
  misc_feature (492)..(492): n is a, c, g, or t
tcagtcgtcgctcgcacgaccggtgctcgatttagtctgacgtcaaagggaaagggggtgggctcaggaggcagagctctgggaatctcaccatggcctggaccctctcctgcctcccctcctctactttctgcacagtctctgacgcctcctatgntctagacactcgcccacccgtcggtctncgttcggaccccgggacaaacggccgaaggtctcaccgtnccgtcgtggaagntcgaccttatacgaaaaccttaaaaagtttcgtttagttttacggacagagtaacgtaacgtcgaccggtacctccggtcccttggttacgtcggtactacttccggataacgggacggaaccgaaggtaacccgtaccgaccccggtggtaaccgttccgacggtaataccggtttaacttcgtaccgggtacgtaccgaacccgtaggttaccgggaaccgggggtcgttaccgtaaccggtggtttaaccngttttaccccggacggtttaaggggccggggaaccgttagggcgggtaaagtacgtacggtaactaccggtaagttaaccgtaacgtttacggttacccgttaactacggtaccgtaaacgacgggtaaccgaccggttagtaacgggttaccggtaacgaccgggtttacggggaaccgggttacggtacgggggttacccgggaacggggtaccgggttaaaccggtccgggttaaccggtcccgggtttaaccggaccggtacccgggttacccggtaccgggacccggtttaacccggttccccgttacccccgggttcggttaccccctaaaccgggttttccccgttcccccggtttaaccccccgggttcccctttccccgggttttcccccgg

SEQ ID NO: 112411 - DNA, 635 bp, Homo sapiens
  misc_feature: GYAE6OF01C5UXW.21.30.C08.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (329)..(329): a, c, t, g, unknown or other
  misc_feature (329)..(329): n is a, c, g, or t
  modified_base (615)..(615): a, c, t, g, unknown or other
  misc_feature (615)..(615): n is a, c, g, or t
tcagtcgtcgctcgcacgaccggtgctcgatttagtctgacgtcaaagggaaagggggtgggcgtcaggaggcagagctctgggaatctcaccatggcctggacccctctcctgctccccctcctcactttctgcacagtctctgaggcctcctatgagctgacacagccaccctcggtctcagtgtccccgggacaaacggccaggatcgacctgctctgganatgcattgaccaaaaaattntgtttttaggaccagcaagaagtcaggcctaggcccctagtgttggcatccatgaggacaggagacgaccctacgggactcccgngtaagagtacttctactggctaccaacgtcaagggacggtgccgtaacgttgaattcacgtaggtcggggacccaagggtcggagggaagtaggaagcgtagaactacttactcgttaactcgagtacagacagctagtggtacagtcgaaggggtacagttcgggacgggacgggaccgtagggttacgacccgttaccggtacgttcgaacggtaccccgaagggtccgtccggtaccccccgttgggttaccctaccgttacccgtttccggtttaccccccnccccgttccccgttaccccg

SEQ ID NO: 112412 - DNA, 923 bp, Homo sapiens
  misc_feature: GYAE6OF01BUJKN.21.30.C08.1.454.CMB.1.raw
  modified_base (132)..(132): a, c, t, g, unknown or other
  misc_feature (132)..(132): n is a, c, g, or t
tcagtcgtcgctcgcacgaccggtgctcgatttagtctgacgtcaaagggaaaggggtgggctcaggaggcagagctctgggaatctcaccatggcctggacccctctcctgcctccccctcctcactttcngcacagtctctgacggcctcctatgagctagacacacgcccaccctcggtctcgagtcgtacccggacaacggccaggactccgaccgtgctcgtggacgtactgactaatttacgaaaacccttaaaaaagtttcgttttacggtttttttaacggaaccgagtacgtaaaggtaaccgttaccgacggtcccgaaccggttcccccgttagtttacggtttacggtacctaacgtttaccccaaggttaggggaacggaaccggtaacggggtaaccggtaaccccggtacccccggttaccggggaaccttcccccggtaagggacgtaaccggttacgtttcccgaccggtttcgacccgttacccaaaccggtcggaacgggggttaccggtcggtacccgttacggttacgttaacgtccgttacggacggggttccgggaccccgtaggggtacggagtaacgtaggtaaccgtcgtacgtaacctttacgttaaacggttacgttaaccgcgtaacggtacccgtaagacgtaacgtcggttaaggttaacgtaccggtaagtccggggtaacggggcctttacgggggtaccggggtacgggggtaaccggtaaccgggttacgggttaccggttaccccgggttagttaacccggtaccgtaaccggtaccccgggtacggttccccgtacccgggttacccccccgttggggttaaccccttacccggttcccggttaccccgggtttccccctacccccgggttccggtaacccccggg

SEQ ID NO: 112413 - DNA, 837 bp, Homo sapiens
  misc_feature: GYAE6OF01DRHRC.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgacggcctcctatgacgctgacacacgccctaccctcggtctcctacggtccggtaccccgggaacaaaccggccaggtactcctacccgtgcgttccgtagggagtacgtgacttacgttaacgaaaccttaaaaaagttttgttttacggtttttacggaaccgaagtaccgtaaggtaaggttccgaccggtacccgtaccggttcccgttggttcggtcgtactacgtaccgtagtacggacgggaacacggggtaaccgacccggtaccccggtaccgggtaccttcccggaaggtaacggtaccgtacgttttcctaggtcccggtaccttaccgaaacggttcgggaacggggttaccgggccggtaacccggtttagttacggtttaccgttcgtaccgggtaccgggttacggggacgggttacggagggtaggtacgacgggtacgtaccgtacggtaactttacggtacttccggtactacgacgacgtacgacaggtcctaggtagtacacgggtccgggaagggttactaccggggttaccgggacgggttacggaacgtttaccgggtacgtaccgttaccgggtacggaacgccccgggtcgaaccgttcccgtcccgggtcccctagtccccgtaccgtttaccgaccccgtttacccctccccgtttcgtaccccg

SEQ ID NO: 112414 - DNA, 839 bp, Homo sapiens
  misc_feature: GYAE6OF01DXFM6.21.30.C08.1.454.CMB.1.raw
  modified_base (505)..(505): a, c, t, g, unknown or other
  misc_feature (505)..(505): n is a, c, g, or t
tcagtcgtcgctcgcacgaccggtgctcgatttagtctgacgtcaaagggaaagggggtgggctcaggaggcagagctctgggaatctcaccatggcctcggacccctctcctcgcctccccctcctctactttctgcaactgtctcgtggacgcctacctagtagacgtctagacaactaccgccctacccgttcggtcctcgtacggtcccggtacccgggaaacgaaaccggccgtaaggtacctaccgcctcgtccgtagtagggtactgcgtacgtacgttaaccgtaaaaactttaaaaagttttcgtttttaggttttacggaacctacggaagtaacggtacggttaacgacccggaccgtacccggtccgttaggttccgtgtacctacgtactagtacggacgaacggaacggaccgtacccggtccggttaacccgcgtacgtgtaacggtaacttctacggtcgtccgtaccttaaaccgaacggttaccggngggtacccgtcggtttaacgttcgtacgttcgttaccgggcggggttacggccgggttaaagggtcggtaggtaacggtacgttaacgtacgtaacgttacctaacgtttaccggttactacgtacgacgtaccgaagtaccgtaagccggttagtacgtagtaaccggtacgggtaacggacggttacggtacgggtacgggaaccgggttacggtacgttaccgggccgttaaacggtccgtaaccggtcccgaaccggtccggtacccggtcccttaacccggccgtttaaccgccttacgtcccccgttacacccggtcttacccggacg

SEQ ID NO: 112415 - DNA, 742 bp, Homo sapiens
  misc_feature: GYAE6OF01ANH1B.21.30.C08.1.454.CMB.1.raw
  modified_base (133)..(133): a, c, t, g, unknown or other
  misc_feature (133)..(133): n is a, c, g, or t
  modified_base (240)..(240): a, c, t, g, unknown or other
  misc_feature (240)..(240): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctccccctcctcactttcngcacagtctctggaggcctcctatgagctgacacacgccacccgtcggtctcgaggtccggtaccccgggaacgaaaccggccaaggactccgacctgctcgtgganatgcattacgaacctaaaaaatttgttaggtttttacgaccagtcaagagtcgacggccgacgtccctgtgtcggacatcgataggacgacgagacggaccgacccggtcggactccgagacgagtactcgtcgtcggtcctaccgaacgtcggacggggtacggtcgaccgtacgttggtacttccggtacgtacgggtccggggaccgtagggtagggaagggtacgtacgaacgtcgtacgtaaccgttaacgtacgttacgttaccgacgaaccgtaggacgaacgtagacgtaggttacgaccgtaaggtcgggtaacggggtcgttaacgggtacggggtaacgggaccgggttaaccggtagggtccggtacccggttacggtaccgggtacgacccggtaaccggaccgggttccctaaccccggtaccccgtcgggtacccttaccccgttacgttaccccccggtacccctccccgtttcccggtaccccgg

SEQ ID NO: 112416 - DNA, 737 bp, Homo sapiens
  misc_feature: GYAE6OF01D8DMO.21.30.C08.1.454.CMB.1.raw
  modified_base (720)..(720): a, c, t, g, unknown or other
  misc_feature (720)..(720): n is a, c, g, or t
tcagtcgtcgctcgcacgaccggtgctcgatttagtctgacgtcaaagggaaagggggtgggctcaggaggcagagctctgggaatctaaccatggcctggacccctctcctgcctccccctcctcactttctgcacagtctctgacggcctcctatgagctgacacacgcccacccgtcggtctcgagtccggtaccccggaacaaacggccaggactaccacctgccttcgtaggatactgactattacgaaaccttaaaaaagtttgtttagtttttacggaccgaagacctaaggaacgtcgaacgtcccgtaccggtcccgttggttcggttacgcgtatacccgtagtacggaacggacgacggaccggtacccgtaccccggtaccggtacctcccggtagtacgtaagtacttcgtacgtcgtacccaccgtaacgtacggtacgggacggttcgaccgttacgtacgttacgttccgacggtaaccgggtccgggaccgtaggggtacgtacgggtagtacggaaccgttcgtacgtaacttacgttaccgttacgtacgtcgaacgactaacgtacgacgtcgtaggtcgacgtcggacggtcgggtactcggacgggtacggtacggtcgtacggtctcccggtagtacgacgacggtccgacgtccgtacccgtccggtacctacgtccgttccgtaccccgttaccnccccttcgccgttcccg

SEQ ID NO: 112417 - DNA, 817 bp, Homo sapiens
  misc_feature: GYAE6OF01CNB0H.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgccacagtctcgtgacggtccctcctatgacgtctacgacacacgccctacccgtcggtctcgaggtccggtacccccggggaacgaaaccgggcgaacgggtactaccgaccgtgccgtcgtaggaacgtagtgtacctagttacgaaaaccttaaaaaaagtttgttttaggtttttacggacctaaggtacgaacggtaacggtacgtaccggaccgtaccggtacccgttggttacggtttaagtacgtaattacgtaaaacgtaaacgaaccgtaacgtacggaaggtaccggtaccctacgaacggtaaccgtaccgttccgtaacggacggtacgttacctttcgtacgtccggtccgtaccgtaacggtccgtacgggaacgggaccgtacggtaccgtaaggttcccgtttaaaggtcgttaaaccgtagtacggtaggtaacgtaaccgggtaccggagacggacgggaacggacggtagtacgtagttacttaacgttctacgaacgtaacgtacgacgaaagtacggtaacggtacgtacgttagttaggttcgggtacggtacgggacgggtaacgtacgacgtcgtaccggtccggttaccggtacggacaaccggtaccgaccggttccgtacccggtacccgtacggccccttacggtccttcccccgg

SEQ ID NO: 112418 - DNA, 758 bp, Homo sapiens
  misc_feature: GYAE6OF01B2EVF.21.30.C08.1.454.CMB.1.raw
  modified_base (135)..(135): a, c, t, g, unknown or other
  misc_feature (135)..(135): n is a, c, g, or t
  modified_base (347)..(347): a, c, t, g, unknown or other
  misc_feature (347)..(347): n is a, c, g, or t
tcagtcgtcgctcgcacgaccggtgctcgatttagtctgacgtcaaagggaaagggggtgggctcaggaggcagagctctgggaatctcaccatggcctggacccctctcctcgcctccccctctcctactttcngcacagtcctcttacggcctcctagtgacgctgaccacacgcccacctcggtctacgtcggtccggtaccccgggaacaaaccggccgaaggtactcctacctgcctctagggatacttcacgttacgaacctaaaaagtaacttacttacgtttcggttacggtccaagacgtaagtaacgtacgacgtacccacggtccctaggttacgnggttacactacctagcggtacgccgtacgcggtaacgacgtaccggtccggtactcgaacgtaagacgtttactcctacgtccgtccgtaactaggtccaaggtaccggaacgtcggtaaccgtaccctaaccgtttggaaccgttacggtacgtacggggtacgggacgtacgggaggtaaccgtaggtacgaacgtacgtaaccgaagttacgttaacgttacgttaactaaccgtaacaacgtaacgtcggtaggtacgtacgtaacgtacgggtaacgggttcgtacgggaacggtacgggtacgtaggttaccggaccgttaccgtcggaccgtaccggtaccgaggcccgttcccgccgtaccgtacccgtacttccggtacccgttcccctcccgtcccgtccg

SEQ ID NO: 112419 - DNA, 870 bp, Homo sapiens
  misc_feature: GYAE6OF01AC87Q.21.30.C08.1.454.CMB.1.raw
  modified_base (139)..(139): a, c, t, g, unknown or other
  misc_feature (139)..(139): n is a, c, g, or t
  modified_base (302)..(302): a, c, t, g, unknown or other
  misc_feature (302)..(302): n is a, c, g, or t
  modified_base (695)..(695): a, c, t, g, unknown or other
  misc_feature (695)..(695): n is a, c, g, or t
  modified_base (702)..(702): a, c, t, g, unknown or other
  misc_feature (702)..(702): n is a, c, g, or t
tcagtcgtcgctcgcacgaccggtgctcgatttagtctgacgtcaaagggaaagggggtgggctcaggaggcagagctcgtgggaatctcaccagtcggcctcggacccctctcctcgcctccccctcctctactttcngccactgtcctcgtcggacgtccctaccttgtcggacgctacgaaccaccgacgaccccgtacccgttcggtcctaccggtacggttccccggtaacccccgggaaacgaaacccgggccgaacggtaaccttccgacccgtgtccgtaggtaggacgtacgngtaacttacgttaacgaaaactttaaagtttgttttacggtttacgacagacgtacgtacgcggacgtcccgtacgtcgtggttcgtaccgtcacgtacgtaggtacgaaccgggacgaacggtacccggaccccggttacccgacggtacccgtaccggtacgggtaacgtaacggtttccttaacccggtcggtaacgtaccccgttaaccggtacggttaccggggtacggtacgggtaccccgttacccgtgggtttaacctaccggtttacccggcgggttacggggtaccggaaccgggttaggtaccgggaggtacgttaggacgtacgtacgtaccgttacgtacgtacgactacgacgagacgtacgcgtacgtacggacggtntacgggnggtaccgggtaggtaaccgggtcgggaaccgggtcgggttaaccgtccgggttactaccggtacggtaccgaccggaaccgtccgttacccggtacccgtcccgttacccgttccgtacccggttccctacccgtttaccccgtcccgttccccgttcccgttacccg

SEQ ID NO: 112420 - DNA, 920 bp, Homo sapiens
  misc_feature: GYAE6OF01C2FWJ.21.30.C08.1.454.CMB.1.raw
tcagtcgtcgctcgcacgaccggtgctcgatttagtctgacgtcaaagggaaaggggtgggctcaggaggcagagctctgggaatctcaccatggcctggacccctctcctgcctcccccctcctctactttctgcacagtctctgacggtccctacctatgagctgacacacgcccacccgtcggtctacgtagtccggtaccccgggaacgaaaccggtccgaaggactaccctaccgtcgtaccgtcgtagggaacgtatcggacctaagttaccggtaaaacctttaaaaaagttttcgtttttacggttttttacggaaccgtaagtaacgtaaaggtaacgtacgtaccgggaccgtaccgggtcccgttaggttacggtttacggtactacgtcctagtagggaacggtaacgacgggacgtacccggtaccccggtaccgggtaccgtaccgtaggaagtaacgttacgttcgtaccggtccggacctaaccgacggttaccggaacggggtacgggtccggtaaccgttaggttaccgtaacgttccggggttccggggaccggggtaccggtaaggggttaggacggttaggtaacgggaacgttaccgtacgtaacgttaaccgtacggttttacgtaaccggtaacgtaccgtaacggtacaaccggtacgtacgggtacgttacggtaccgggtacgtcggggtaacggggtacgttcggtacggggacggggtaaccggttacggtacggttacggtacccgggttaaccgttacggaacccggtcggtaaaccccggtcggtcccgttaacccccggggttccccgtaacccggtttaccgtaccccgtttccccggtaccccggtttttcccccaccccgtttcccccgttcctttacccccgg

SEQ ID NO: 112421 - DNA, 920 bp, Homo sapiens
  misc_feature: GYAE6OF01AUGIV.21.30.C08.1.454.CMB.1.raw
  modified_base (668)..(668): a, c, t, g, unknown or other
  misc_feature (668)..(668): n is a, c, g, or t
  modified_base (851)..(851): a, c, t, g, unknown or other
  misc_feature (851)..(851): n is a, c, g, or t
tcagtcgtcgctcgcacgaccggtgctcgatttagtctgacgtcaaagggaaagggggtgggctcaggaggcagagctctgggaatctaaccatggcctggacccctctcctgcctccccctcctcactttctgcacagtctctgagcctcctatgagctgacacacgccaccctcggtctcagtcgtccccgggaacaaaccggccaggaactccacctggctacgtggagagtcactacttacgaaaccttaaaaaactttgtttacggtttttttacgggaaccctaaggtacctaaacggtaaacggtccggaacgggttccctaaccgggtacccccgttagggtttacggtttcggggtaccctaaaccgtttccccgtaaggttaccgggtaacgggaaccggtaaccggggaaccggtaaaccccggtaaacccccgggttcccggggtaacctttcccccggtaagggtaaccggtacggttactttaaccgttccgtacgggttcccctaacccggtaaaccggtttaccgggacggggttacccgggtacgggtacccgttaacggtttacgtaaccggtttccgtacgggttacggggtacccggggaccccggttaagggggtcgggaacgggtacggtaaggtaacccgggttntaaccggttaacttaaccggtttacgtaccggtttacaccgttacggaaccgtaacacggtacgtacgtaacggtcgttacgaaccggtgggaacggggtcctaacgggcgggtacccggggaagttacccgtggggtaccctccggtaacgggttcgacgtaccccgggactaccgggtccncccgttccccggtacgcccttaacgttcccccgggtacccttcccccgtccctcccgtttcccggttcc

SEQ ID NO: 112422 - DNA, 915 bp, Homo sapiens
  misc_feature: GYAE6OF01CR19O.21.30.C08.1.454.CMB.1.raw
  modified_base (108)..(108): a, c, t, g, unknown or other
  misc_feature (108)..(108): n is a, c, g, or t
  modified_base (657)..(657): a, c, t, g, unknown or other
  misc_feature (657)..(657): n is a, c, g, or t
tcagtcgtcgctcgcacgaccggtgctcgatttagtctgacgtcaaagggaaagggggtgggctcaggaggcagagctctgggaatctcaccgatggcctggaccctntcctgctcccctctctacttctgcacacgtctactgaggccttacctatgagctagacacgacgccctaacccgttcggtctcacggttaccggtaccccggggaacaaaccgggccgaaggacttccgacctcgacttcgtagggagaacttgacctaagtttacgaaaaccgttaaaaaaagtttttcgtttttacgggtttttttaccgggtaaccgaacgggtactaacggtaacggtaccggtaaccgggtaccgtaaccggggtcccccgtttagggtttaccggttttaggggtaaccttacgttacccgtaaggttacgggaacggaaacggttacgggaacccggtaaccggttacccccgggtaccggtaccggttacccggtacggtaggtaacgttaccgttacgtccggtaccgttacctaccgttaacgtaccgggtaacgggtccgggttaccggtaccgttaggtttacgtacggttacttacgggtacgggtccgggggaccggttagggacgggtacggtaagttaacggngtaaccgtacggtaccttaacgttacgttaacgtacgtaacgggctaacggaacgtccggtaagtaccggtaagtacggtaaccgttggacgggtacggtaccggaacggttcggggtaacgggacgttaccgggacggttaccggacgttaccgggtaacgttccggacggtaccccggacggttacccgccccgggttaccctacggttcccgtacgtttacccctacccgttacccctcgtacccggtacccggg

SEQ ID NO: 112423 - DNA, 895 bp, Homo sapiens
  misc_feature: GYAE6OF01DVCDM.21.30.C08.1.454.CMB.1.raw
  modified_base (436)..(436): a, c, t, g, unknown or other
  misc_feature (436)..(436): n is a, c, g, or t
tcagtcgtcgctcgcacgaccggtgctcgatttagtctgacgtcaaagggaaagggggtgggctcaggaggcagagctctgggaatctcaccatggcctcggacccctctcctgcctcccctctctactttctgcactagtctctgacgtcctctatgagctagaccacgacgccctacccgtcgtctcgacggtccggtacccgggaacgaaccggcgaggactaccaccgtcgtctacggtaggtaacgactcggtactaacgttaacgaaaaccttaaaaagttttcgttttacggtttttacggaaccgagtacgtaaaggtaacgtaccgacggtccgtaaccggtccgttggttaggttacgactacgtcgaggtacggaaggaacgaacggtaccgtaccgcccgtacgggaccttacggagaacggtntacctttcgtacgttacggaccttaaccggaaccgtccgggtaaggggtccgtaccggtaaccgttacggttaccttacggtttcggaccggtacggggttaaccgggccggtaagggttacgggggaactacgggtaagtacggtaccgtaaggttaacctaaacggtttaccgttagttaccgaaccgagggttaaccaacggttaccgtagggtaacggtttacgggacgtttaacgggcgggtacgggtaaaccggggtgttaccggggtaaaccgggaggggtaaaccccgggttaggtacccgggttaacgttacccggggttaacggtaccgtaacccgggtaccgggacccggtttaacggcccccgggttaccccgcccggttaaacccggttaccgtcccgtttacccggtcccccccggttcccgtcccccgttcccgtttaacccgg

SEQ ID NO: 112424 - DNA, 876 bp, Homo sapiens
  misc_feature: GYAE6OF01A6FQY.21.30.C08.1.454.CMB.1.raw
  modified_base (144)..(144): a, c, t, g, unknown or other
  misc_feature (144)..(144): n is a, c, g, or t
  modified_base (670)..(670): a, c, t, g, unknown or other
  misc_feature (670)..(670): n is a, c, g, or t
  modified_base (699)..(699): a, c, t, g, unknown or other
  misc_feature (699)..(699): n is a, c, g, or t
  modified_base (729)..(729): a, c, t, g, unknown or other
  misc_feature (729)..(729): n is a, c, g, or t
tcagtcgtcgctcgcacgaccggtgctcgatttagtctgacgtcaaagggaaagggggtgggctcaggaggcagagctctgggaatctaaccatggcctggacccctctcctgcctccccctcctctactttctgcacagtctntgacggtcctctatgagctagacacacgccctacccgtcggtctcacgtccggtaccccgggaacgaaaccggccgaaggactacctacccgtgccgtcggtagggacgtatcggtaaccttacgttaaccggaaaaacctttaaaaaaagtttttcggtttttacggttttttcgggaaaccttacggaaccgtaaaggtacggtaccggtaaccggaccggtacccggtcccggtttggttacggttcggtactaacgtccgttagtaggggaacggtaggaacggaaccggacccggtaccccggttaccggggaccttaccggtaggacgtacgttacttccggtcgtaccgtccgttaaccacggtacgggtacggggtaccggtcggtaccgtacggtttactcggttaaccggtcgggttacgggacgggggtaccgtaggggtacggagggtacgtaaggaccgtacgtaacgtccgtttaacttcgtaacggttacacgaaccgtacgaagtaccgngtaccgttagggtcgtcggtaaaccgggngggttaacggacggttcgggaacccggggngggaaccgggtttacgccgggtttaacggacccggttacggtacggtccggaaccgttccgggacgtaccccggtacccggtcccggttaccgtcgtaccccttaccggtttccccctcccggttacccttccggttacccctcggg

SEQ ID NO: 112425 - DNA, 796 bp, Homo sapiens
  misc_feature: GYAE6OF01BGOG7.21.30.C08.1.454.CMB.1.raw
  modified_base (489)..(489): a, c, t, g, unknown or other
  misc_feature (489)..(489): n is a, c, g, or t
tcagtcgtcgctcgcacgaccggtgctcgatttagtctgacgtcaaaggggaaagggggtgggctcaggaggcagagctctggggaatctcaccatggcctggaccctctcctgctccccctcctcactttctgcacagtctctgaggtcctcctatgagctagacacagcccacccttcggtactccgtacggtcgggtacccccggggaacgaaaccgggccgaacgggtaactaccctaccgtcgtccttccgaggggaagtaacgtcgctaacgttacgaaacccttaaaaaaagtttttgttttaggttttttacggaaccgtaggaccgtaaggtaacggacctacgggacccgtacgtcccccgtaggttcgtttacgactcttaaccgagcggaacggtacggaacggtacgacccggtacccggttccgggaccttacccggagaggtctacctttcgtacgtcggtcctaccgaaccgngggtaacgggtccggtaccggtccggttagttacggtactttccggacgggtaacggggtcccgggtaccggtaggggtgacggggatacggacgtactaggtacctaccgttagtacgtttacgaactagaccgacggacgtacgtcgtaacggtcggtaccgttagggcgggtacgggtacgtacgggtacgggtcggacgggtacgtccgggttacgtaccgtacggtacgtcgaaccggccggtaaggtcccgcccgtcccggaccgtctcccggtcgtaccccgtccctccccgttctcccg

SEQ ID NO: 112426 - DNA, 842 bp, Homo sapiens
  misc_feature: GYAE6OF01DNUA0.21.30.C08.1.454.CMB.1.raw
  modified_base (144)..(144): a, c, t, g, unknown or other
  misc_feature (144)..(144): n is a, c, g, or t
  modified_base (233)..(233): a, c, t, g, unknown or other
  misc_feature (233)..(233): n is a, c, g, or t
tcagtcgtcgctcgcacgaccggtgctcgatttagtctgacgtcaaagggaaagggagtgggctcaggaggcagagctctgggaatctcaccatggcctggacccctctcctgcctccccctcctcactttctgcacagtcctntgacggcctcctatgagctgacacacgccacccgtcggtactcgagtcggtcccggaacaaccggccaggactcaccgtgctcgtgganactgactaatacgaaacctaaaaatttgtttacggtttttacggaccagtacgtaaggaacgttccggacggtcccgaaccggtcccgttaggtttcggttacggtactacgtaccgtagtacggaacgtaacgacggaccgtacccggtacccgtaccgggtactacccgtaggtaacgtaacgtcgttacgtcgtaccgtcgtaacccgtaacgtacgggtaacgggaccggttacggacccgttaacggttagtaaccgtttcgtacggtaccgggtacggggtacccgtaaggggtgggtaaacgtaagtacggaacgtcggtaacttaacccgtttaacttacgttacgttaaccggtctacgtaacgtaaccgtaacgacggttacgtaacggtaccggtacgtaacggttacgggtaagggtccgtaccgggttaccgggaacggggttaaccggacgggtttacggtacccgggtaccgtaacccgggttacggaccgacccggtaacccggtacggttccccggtaaccccgtccccgggtaacgttccccttaacccgttcccggtttacccctccccggttaaccccgttaccccggg

SEQ ID NO: 112427 - DNA, 792 bp, Homo sapiens
  misc_feature: GYAE6OF01B7CGM.21.30.C08.1.454.CMB.1.raw
  modified_base (131)..(131): a, c, t, g, unknown or other
  misc_feature (131)..(131): n is a, c, g, or t
  modified_base (469)..(469): a, c, t, g, unknown or other
  misc_feature (469)..(469): n is a, c, g, or t
tcagtcgtcgctcgcacgaccggtgctcgatttagtctgacgtcaaagggaaagggggtgggctcaggaggcagagctctgggaatctcaccatggcctggaccctctctgcctcccctcctctactttcngcactagttctctaggacggcctaccgtatgtagtctgaacacacgccctacccgtcggtcctaccgacggttccggtaccccggaaacgaaaccggccgtaaggtactccgtaaccgtcggtacctacggtagggacgtattacggacttaacgttaacggaaaccgtaaaaaggttaacttaacggttaacggtttttacggggttaccggttaccgaacggtacgaacggtaacggtaccgacgggtacccgacggttacccgtagttacggtcgtacctacgtcacggtacgacgtacgacgtacggactaccgacggtaccggactaccgganacgtactacttacgtcctacgtcctacgacgtccgtacgacgggtaactacggtccgtacgtaccgttagaacgtcgtacgggtaccgggtacggacgtaacggtaggtaacgtgtaacgtaacgtcgtaacgttaacgtacgttacgttaaccgtacgtactaaccgtaacgtacgtaagtaggttaccgtaacgtcggtacgggtacggttacgggtaacgggacggtacggtaaccgtacgtacgttccgttaacgtccggacgtaccgacgcggtacctacccggccgtacgtactacccgtcttacccgtcctacccg

SEQ ID NO: 112428 - DNA, 902 bp, Homo sapiens
  misc_feature: GYAE6OF01A943P.21.30.C08.1.454.CMB.1.raw
tcagtcgtcgctcgcacgaccggtgctcgatttagtctgacgtcaaagggaaagggggtggctcaggaggcagagctctgggaatctcaccatggcctgacccctctcctgcctccccctcctctactttctgcacagtctctgacggcctcctatgagtctagaccacacgcccctacccgtcggtctccaggtccggtaccccgggaacgaaacggccaaggactccacctgtcctcgtaggaagtatcggactaagttacggaaaccaaaagtaacttacgttacgtttggtttcgtaccgaagacgaaaggtaacgtccgaaacgggtcccgtaaccgggtcccttaggttacgtcggttacacgttacccgaagtcgggaccggcctaacggtaccgaaccgtactaaccgggtccggtactttcccggaggaacgtaacgttacgtttccgtccgtaccgtccccgtacgtacggccgttacggaaacggggtcctacggtacccggtacccctacggtttacgaaaccgttacggtacgggtaccgggggttaccggggtaacccgggttaaggggtacggaacgttaagggttaaacggaacgttaacgtaacgttaactttaaccggtttacgtttaacggtacccgaaaccgtaacgtaccggagttaacggttacgtacgtacggttaacggtagggttaaccggggtttacgggtacggggtaaccgggtacgggttaaccgtaacggttacccgggttacccgttccgggttaccggtaaccgtacccggaaccccggttacggtaccccggttaccccgggttccccccgttacggttaccccgttacccggttccccggtttcccccggttccccctttcccccggg

SEQ ID NO: 112429 - DNA, 854 bp, Homo sapiens
  misc_feature: GYAE6OF01BG4OL.21.30.C08.1.454.CMB.1.raw
  modified_base (135)..(135): a, c, t, g, unknown or other
  misc_feature (135)..(135): n is a, c, g, or t
  modified_base (547)..(547): a, c, t, g, unknown or other
  misc_feature (547)..(547): n is a, c, g, or t
  modified_base (573)..(573): a, c, t, g, unknown or other
  misc_feature (573)..(573): n is a, c, g, or t
tcagtcgtcgctcgcacgaccggtgctcgatttagtctgacgtcaaaggggaaagggggtgggctcaggaggcagagctctgggaatctcaccatcggcctcggacccctctcctcgcctcccctctctctttcncgcactagtctcgtggacggtcctccttatgacgtctacgacacgacgccctaccgtcggtctcgtacgtccggtacccggaaacgaaccgcgtacggtactccgaccgtcgccgtacggtaggagtacgtcgtactaacgtttaacgtaaaaccgtttaaaaacgttttgttttcggtttttaacggaaccgtaaggtacgtaaacggaaccggttaccggaaccggtacccggtaccgggttacccgtttggttaggttaccgtactaacgttaccggaagttaggggaaccggtaacggacgggtaaccgtaccccgggttaccgacggtacttacccggagtacgtctacggttctacggcggtaccctcgtaaaggcggttacggggtacgccgtacggttacggtntacgtccgtacggaccgggtaccggnggtaaggaggtacggacgtagtacgtacgtacggtaacttacgtacggtttacacggtactacgtacacggtaacgacggttacgtacggtacgtaccgtacgggtacgggtaaccgtcgggtaaccgggtcgggtaaccgggacggggtacccggtagggttcccggtacggtaccggtacggtacccgaccggtaccgtacggttacccgcccgggttaaccgtccgtaacccgtcccgggttcctacccccgggttccctcccgttcccgttacccgg

SEQ ID NO: 112430 - DNA, 685 bp, Homo sapiens
  misc_feature: GYAE6OF01CSD6Q.21.30.C08.1.454.CMB.1.raw
  modified_base (179)..(179): a, c, t, g, unknown or other
  misc_feature (179)..(179): n is a, c, g, or t
  modified_base (330)..(330): a, c, t, g, unknown or other
  misc_feature (330)..(330): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctggtntcagtcgtccccaggacaaacggccaggactcacctgctctggagattcattcgacaaaagatatacttgtggtcagcagatgagccacggccctgtactgtcatccatgagcctagtcgacgacactccgggatcccagagagtacttcncgtcgcctcacgctacgaggactcggtcgacctacgttcgactaagtccgagggtccgggaccgtacgggttacgggaacgtagtaggaaacgtcgtaacggtaccttacgttacgtttacggttaccgtaccgtaaccgtaacggtaacgtaagggttacgggtacgttaccgtagttacgggtaagggggtttacgtacggggtacgggtacgggtacccgtaaggtttaccggtacccggttccggttacgggtacctaccgggaaccccggtaaacggtcccggtacccgtccccccggttacggttaccccgtacccgtttccgtccccgtttcccccgtaaccccccgg

SEQ ID NO: 112431 - DNA, 733 bp, Homo sapiens
  misc_feature: GYAE6OF01A86U7.21.30.C08.1.454.CMB.1.raw
  modified_base (220)..(220): a, c, t, g, unknown or other
  misc_feature (220)..(220): n is a, c, g, or t
  modified_base (516)..(516): a, c, t, g, unknown or other
  misc_feature (516)..(516): n is a, c, g, or t
  modified_base (538)..(538): a, c, t, g, unknown or other
  misc_feature (538)..(538): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagctgacacacgcccacccgtcggtctcagtcgtccccgggacaaacggccaggactcacctnctctggagtatgactattacgaaaccgtaaaaatttgtttgttttttacgaccagtacagacgtacgacggccacggtccccgttggttgttacggtactacttccgagtcggaacggacgtagggaaccgaccgtacccggtaccggactcccgtaggacgagtacgtttctcgtcggccctaccgacgtcggacggggacgtccggaccgtacgttgtacgtcgtacgtacgggtcgggccgtagggtacgggagtagtacgaacgtcgagttacctacgtacgttcgttaacncgacgtacgaacgagtacggtntacggtcgtagacgtacggggacggtacgaccgggttagggcggtaacgggtaccggtacggttaccggtacgtacccggttaggacccgtaccggtaccggaaccggttacccggtccccggttacccccgtacggttacccttacgttccccggtacccctttaccccgtcccccgtttacccttcccccggg

SEQ ID NO: 112432 - DNA, 834 bp, Homo sapiens
  misc_feature: GYAE6OF01BZGIB.21.30.C08.1.454.CMB.1.raw
  modified_base (183)..(183): a, c, t, g, unknown or other
  misc_feature (183)..(183): n is a, c, g, or t
  modified_base (254)..(254): a, c, t, g, unknown or other
  misc_feature (254)..(254): n is a, c, g, or t
tcagtcgtcgctcgcacgaccggtgctcgatttagtctgacgtcaaagggaaagggggtgggtccaggaggcagaactctgggtgtctcaccatggcctggatccctctacttcctccccctcctcactctctgcacaggctctgacgcctcctatgagctgacacacgcccacccgtcggtntcaggtccgtccccgaggacacggaccggccaggactccacctgctctgcagatggactgacaaaagaatntcgtacttattacggtaaccaacaagaacgaccgacggccgacggtcccgttggttacgttacgtagtaacttaagtaaacgtaaacgacgtaacgtacggacgaccggtacctacgagaacgtctaccgtagacggtacgtacttcgtacgtcggtacctacccgacggcccgtaacgggtacggaactacgaccgttaacggttaccgtaacgttcgtaacgttacgtacgtaacggttacggtaaccgtaccggaacggaacggtaacgggtaaacggggaccggtacggtacgttaacggttaaccgttaacgtttaaccgttaacgtaaaccgtaacggttaaagaacggtaaccggtaaacgggtaacgggttaaccggttaccgtttaacggttacggggtttacggggttaaccggttaccgggggtacccgggtaaacgggttaacccggtaacggtaccggttaacccgggtaaccccgttcgggtttaaaccggacccggtaaccccgggtaacccggtaacccgggttaccccgtccccggttacccccggttacccggttaccccgg

SEQ ID NO: 112433 - DNA, 752 bp, Homo sapiens
  misc_feature: GYAE6OF01A6J72.21.30.C08.1.454.CMB.1.raw
  modified_base (108)..(108): a, c, t, g, unknown or other
  misc_feature (108)..(108): n is a, c, g, or t
  modified_base (131)..(131): a, c, t, g, unknown or other
  misc_feature (131)..(131): n is a, c, g, or t
tcagtcgtcgctcgcacgaccggtgctcgatttagtctgacgtcaaagggaaagggggtgggctcaggaggcagagctctgggaatctaaccatggcctggacccctntcctgcctcccctctcactttcngcacagtctcgtgacggtcctcctagtgacgcgtagaacaccgacgccctaccccgtcggtactcgtacgtccggtaccccgggaacaaaccggtccgaggtactccgacctgcctacgtggacgatcgatagtacgaaactaaaattgtttggttttacgaccagcaagtacgtacgacggaccgtacgtcccgtagtcgttcgtacacgtccgagtagacggtacgacggacggaccgtacccggtaccggtactacccgtaggagacgtacgtcctacgtcgtacctaccgacgtacggtaggtccccccccggtagaccgtacgtcgtacgttcgtacggtcgggtaccggtaccggtagggtacggtaggtagtaggacgtacgtacgtaacgttacgttaacgttacgtaccgtacgacgacgaacgacgtacgacgacggtgtacgtacgacgggtacgggtacgtcggtaccgggtacgggtaacggtacggtacggtaccgtacgtcgggtaaccgtcggaccgtacccggacggtcccctcccggtccccggtacccgttacgacccttccggttaccccgtccccgtacccgttcccgtccgttccccgg

SEQ ID NO: 112434 - DNA, 554 bp, Homo sapiens
  misc_feature: GYAE6OF02I1CYC.21.30.C08.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgtttttggaccagcagaagtcaggccaggcccctgtgttggtcatccatgaggacaggagacgacccctccgggatccccgtgagagattctctggctccaactcaggggacggtggccagttgattctcagtggggcccagggtcggaggatgaagctgactactactgttactcagcagacagcagtgtcagtcgagggggcagttcgggcgggagggaccgaggttcgaccgtcgtaggtcagcccgaaggcctcgcccccgtggtccgtacctccgtccgttccccaccccgttccctccgttcccg

SEQ ID NO: 112435 - DNA, 545 bp, Homo sapiens
  misc_feature: GYAE6OF02F5WCM.21.30.C08.1.454.CMB.1.raw
  modified_base (197)..(197): a, c, t, g, unknown or other
  misc_feature (197)..(197): n is a, c, g, or t
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagaggctctgggaatctcaccatggccctggacccctctcctgctccccctcctcactttctgcacagtctctgaggcctcctatgagctgacacagccaccctcggtctcagtgtccccggganaaacggccaggatcacctgctctggagatgcattgaccaaaaaatttntgttttttggaccagcagaagtcaagggccaggcccctgtgttggtcatccatgaggacaggagacgaccctccgggatcccgtgagagacttctcgtggctccgaactcgagggacgtggccacggttgattctcgaggtcggggaccctagggtggaggatgagctgtactactactgttactcagcagacagcagtgtcagtcgaggggcagttcggcggaggacaggttcgaccgtctaggtcacgcccaaggtcctcgccccgtcgtcaccgtctcgttcccaccctccgtaccg

SEQ ID NO: 112436 - DNA, 554 bp, Homo sapiens
  misc_feature: GYAE6OF02GZWUM.21.30.C08.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagccaccctcggtctcagtgtccccgggacaaacggccaggatcacctgctctggagatgcattgaccaaaaaattntgtttttggaccagcagaagtcaggccaggcccctgtgttggtcatccatgaggacaggagacgaccctccgggatcccctgagagattctctggctccaactcagggacggtggccacgttgattctcagtggggcccagggtggaggagtgaagctgactactactgttactcagcagacagcagtggtcagtcgaggggcaggttcggcgggagggaccgtagggttcgaccgtccgtaggtcgacggacccgaaggccgtcgcccccgtcggtcctaccgtccgttccgttcccctaccccttccccg

SEQ ID NO: 112437 - DNA, 918 bp, Homo sapiens
  misc_feature: GYAE6OF02GS8B0.21.30.C08.1.454.CMB.1.raw
  modified_base (129)..(130): a, c, t, g, unknown or other
  misc_feature (129)..(130): n is a, c, g, or t
  modified_base (133)..(133): a, c, t, g, unknown or other
  misc_feature (133)..(133): n is a, c, g, or t
  modified_base (137)..(137): a, c, t, g, unknown or other
  misc_feature (137)..(137): n is a, c, g, or t
  modified_base (151)..(151): a, c, t, g, unknown or other
  misc_feature (151)..(151): n is a, c, g, or t
tcagtcgtcgctcgcacgaccggtgctcgatttagtctgacgtcaaagggaaaggggtgggctcaggaggcagagctctgggaatctcaccatggcctggaccctctcctgctcccctcctcactttcnncantctngcgtcctactatgntctagacacgcgaccctaccgtcgtctacgtgtccggtacccggaacgaaccgcgagtacacctacgtcgtctcgtaggagtagtcgacttagtaccgaaaacgaaaagtaattaacttacgtttggtttccgtacgagtacgaaaggtacgtacggaccggaccgaccccggtccgttagtacggtcgtactacctacctagtacggaccgtaccgtacggtaccgaaccgtaaccgtacccgggtaccggtacccttccggtaaggaacggtaactttaccttccgtcgtacccgtacccctaacgcgtccgtaacggggaacggtacgtacgggtccccgtaaccctttacggtacgtaaccttaccgtacggtaccggggggtccccggaaccggttaaggggtacccggaaacttacgggaaaggtaccgtcggtaaccgttaaacctttaacgtttaaggtttaccggtaacccgaccaaaccggtaacgtaacggttaagggttacgggttaccgtaacttacgggtaacggggggttaacggggttttccgtccggggggaaacggggtaaaccggttaaaaccgttttaggggtaccccgttacccgggttttacgggttaccgggtaaccggaaccccggtaaaccgggtaaccggttccccggttaccccccgggttacccccgggtttaccggtaaaccctttaccccggttttccccggtttaccccccgggttcccccccccgtttaccccgg

SEQ ID NO: 112438 - DNA, 635 bp, Homo sapiens
  misc_feature: GYAE6OF02JJKK8.21.30.C08.1.454.CMB.1.raw
tcagtcgtcgctcgcacgaccggtgctcgatttagtctgacgtcaaagggaaagggggtaggggcgtcaggaggcgagagctctgggaagtctaaccatggcctggacccctctcctcgctcccctcctccactttctgcacagtctctgaggcctcctatgagctgacacagccaccctcggtctcagtgtccccgggacaaacggccaggatcacctgctctggagatgcattgaccaaaaaattattgtttttggtaccagcagaagtcaggccaggcccctgtgttcggcatccatgaggacaggacgacgacccctcggggatccccgtgagagacttctcgtggcctccaactcgaggggacggtcggcctacgttgattctcgaggtcggggcccaggtgggagagtagagctgactactactcgttactcgagcagacagcgagtgtcagtcgagggggcagttcgggcggacgggaccgtagggttacggacccggttaccgtaacgggtcgtaacggaccccgtaacgggtacctccgggtaccccccgttccgggttaacccgtcccgttacccggtttcccggtttacccccgtaacccccttcccgttcccccgtttaccgg

SEQ ID NO: 112439 - DNA, 528 bp, Homo sapiens
  misc_feature: GYAE6OF02H65ZQ.21.30.C08.1.454.CMB.1.raw
  modified_base (195)..(195): a, c, t, g, unknown or other
  misc_feature (195)..(195): n is a, c, g, or t
  modified_base (241)..(241): a, c, t, g, unknown or other
  misc_feature (241)..(241): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgccaaaaaattntgtttttggaccagcagaagtcaggccaggcccctgtgttggtcatccatgaggacaggagacgaccctccgggatcccctgagagattctctggctccaactcaggggacgtggccacgttgattctcagtggggcccagggtggaggatgaagctgactactactgttactcagcagacagcagtggtcatcgagggggcagttcggcggagggaccgaggttgaccgtcctaggtcaggcccaaggctcgcccctggtccactcctcgtcccgccctcctcccg

SEQ ID NO: 112440 - DNA, 535 bp, Homo sapiens
  misc_feature: GYAE6OF02FQGIM.21.30.C08.1.454.CMB.1.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaattnttgtttttggaccagcagaagtcaggccaggcccctgtgttggtcatccatgaggacaggagacgaccctccgggatccctgagagattctctggctccaactcagggacgtggccacgttgattctcagtggggcccagggtggaggatgaagctgactactactgttactcagcagacagcagtggtcatcgaggggcagttcggcggagggaccaggttcgaccgtccgtaggtcacggcccgaaggctccgccccgtcggtccactccgtcgttcccaccctcctcccg

SEQ ID NO: 112441 - DNA, 579 bp, Homo sapiens
  misc_feature: GYAE6OF02I235N.21.30.C08.1.454.CMB.1.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
  modified_base (418)..(418): a, c, t, g, unknown or other
  misc_feature (418)..(418): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaattntgttttttggaccagcagaagtcaggccaggcccctgtgttggtcatccatgaggacaggagacgacccgtccgggatcccctgagagattctctggctcccaatcaggggacgtggccacgttgattctcagtcggggcccagggtggaggatgaagctgactactactgttacncagcagacagccagtggtcagtcgaggggctagttcgggacggagggaccgtaggttcgaccgtaccgttagggtccacggcccgtaacggccgttaccggcccccgttcgggtacccaccgttccgtccggtttccccctaccccgttcccgttaccccg

SEQ ID NO: 112442 - DNA, 653 bp, Homo sapiens
  misc_feature: GYAE6OF02H7BU1.21.30.C08.1.454.CMB.1.raw
  modified_base (196)..(196): a, c, t, g, unknown or other
  misc_feature (196)..(196): n is a, c, g, or t
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccggganaaacggccaggatcacctgctctggagatgcattgaccaaaaaattntagtttttggaccagcagaagtcaggccaggcccctgtgttggtcatccatgaggacaggagaccgacccgtcgggactccccgtagacgagtactttctcgtggcctacccaaacgtccgaggggacgggtcggcctacgttgacttccgtcgtagggtcggggaccctaggggtacggaagggatacggaagtcgtacgtaacttaacgtacgttacgttactcgacgacaggacagactagtggtacagtacggagggggctaacgttcgggacgggtacgggaccgtagggtcgaccggtcgtacgggtactacggacccgtaacggtcccgtccggacccccgttcgggtacctaccggttccgttaccccggtttccccggtacccccgttccctttcccccgg

SEQ ID NO: 112443 - DNA, 561 bp, Homo sapiens
  misc_feature: GYAE6OF02IPZ85.21.30.C08.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggccccctgtactggtcatccatgaggccagtcgacgacacgtcgggatccctgagagattctctgccctccagcctacgagggacaggtcggcccaccttgaccttatcgagggtcggggccccaagggtgggacgagtagaagctagacttactagttgttacgcaccagacngtagtggtacagtcgaaggggttctcgggcggagggaaccgtagttcggaccgtccgttacggcacgccgaaggcctcggccccctcggtccactccgttcgttccccgtcccc

SEQ ID NO: 112444 - DNA, 1108 bp, Homo sapiens
  misc_feature: GYAE6OF02I5TU1.21.30.C08.1.454.CMB.1.raw
tcagtcgtcgctcgcacgaccggtgctcgatttagtctgacgtcaaggtaaggggttggggctcaggaggcgagacgtcgtcctgggaacttcctacgacccttactcggtccgttggaacccctctccctacgcgtcccccgtcctaccacgtttcgtcgccaccagttcgtacttgggacggtcctccgtattggacgttccttggtacgacctagttaccaacccgttcggttcctactaggttcggtaccccgggaactaaaccggaaccgtagggtacgtaccgtacccgttggggaccgttaccgtttgggaccgtaagttccgggggtaccctaaggtttacggaacccttaaaaaacttttccgtttaggttttttaaccggtaacccgtacggtccgttaaggtaaacgtttcccgaaccggtcccgaacgggtccccccttaagtttacggtttcggggtacctacggttaccccgtaggttccggaaccggtaacggtacggtaccggaaccggggtaaccccggggtccgggtacggttaccccggttagggtaacggtaccgtaacgtttaccgttaaccggtccggtaaccgtaccgtaacggtaccggtaacggggtaaacggttaccggtaaccgtacggtttacggtaacgtttcccgttacggtacggggttaacccggggggttaccccggttaacgggttaccgggtaaacgggttaccgttaaccgggtaaacgggttacccgttaaaccggtaaaccgtttaacccggttaaacccgtttaaacggtttaaacccgttacccggtaaacgggtttacccggttttaaacggaaaacccggttaacgggtaacccgttaacgggtttaccggttaacggtaacgggttaaccgggtaacccggggggtaacttaaccgggtttacccggggaaccgggtaacggggttaaccgttaacgggttttaccgtacccgggttacccgttacgggtaccgtaaccggtaaccgtaaccggtacgttaccggtacccccgttacggtaccggttacgtaccgttaccgtacccgttcccgtttccgttcccg

SEQ ID NO: 112445 - DNA, 565 bp, Homo sapiens
  misc_feature: GYAE6OF02JAW3T.21.30.C08.1.454.CMB.1.raw
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgtttttggaccagcagaagtcaggccaggcccctgtgttggtcatccatgaggacagganaccgaccctccgggatccccgtgagagattctctggcctaccaacctcgagggcggtggccacgttgacttctcaggtcggggcccagggtggaaggagtgaagctgactactacttgtactcagcagacagcagtgtacagtcgaggggcagttcgggcgggacgggtaccgagggttcgaccgtccgtaggtcgacgacccgaaggtccgtcgccccgtcggtcctacgtccttccgttcccctaccctccctcctcccg

SEQ ID NO: 112446 - DNA, 562 bp, Homo sapiens
  misc_feature: GYAE6OF02IPZPL.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatccacctgctctggagatgcattgaccaaaaaattntgttttttaggaccagcagaagtcaggccaggcccctgtgttggtcatccatgaggacaggagacgacccgtccgggactccctgagagattctctggctaccaactcgagggacggtcggccagttgaattctcgagtcggggcccagggtcggaggatggaagcgtagactactacgtgttaacctcagcagacagctagtggcagtacgaggggctagttcggcgggaacgggaccgtagggttcgacccgttcgtacggtcgcgacccgaaggccgtcgccccgtcgtccactcctcgttcccgccctcctcccg

SEQ ID NO: 112447 - DNA, 548 bp, Homo sapiens
  misc_feature: GYAE6OF02GQV2S.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagccaccctcggtctcagtgtccccgggacaaacggccaggatcacctgctctggagatgcattgaccaaaaagatatacttgttggttccagcagaagtcaggccaggcccctgtactggtcatccatgaggccagtcgacgacacgtccgggatcccgtgagagattctctgccctccagctcgagggacaggtcggccctaccttgacttatcgaggtcggggcccagggtggacgatgaagctagactacttattgttacgcaccagacagtagtgtcagtcggaggggttatcgggcggagggacctaggttcgaccgttcgttggtccacggcccgaaggccgtccggccccgtggtccacttccgtcgttcccccg

SEQ ID NO: 112448 - DNA, 562 bp, Homo sapiens
  misc_feature: GYAE6OF02IP3WO.21.30.C08.1.454.CMB.1.raw
  modified_base (193)..(193): a, c, t, g, unknown or other
  misc_feature (193)..(193): n is a, c, g, or t
  modified_base (240)..(240): a, c, t, g, unknown or other
  misc_feature (240)..(240): n is a, c, g, or t
tcagtcgtcgctcgcacgaccggtgctcgatttagtctgacgtcaaagggaaagggggtgggctcaggaggcagagctctgggaatctcaccatggcctggaccctctcctgctccccctcctcactttctgcacagtctctgaggcctcctatgagctgacacagccaccctcggtctcagtgtccccgganaaacggccaggatcacctgctctggagatgcattgaccaaaaaattntgtttttggaccagcagaagtcaggccaggcccctgtgttggtcatccatgaggacaggagacgacccgtccgggatccctgagagattctctggctccaactcgagggacggtcggcctacgttgattctcaggtggggcccagggtggaggagtgaagctgactactactgttactcagcagacagcagtggtcagtcgagggggcagttcgggcgggaacggggacctagggttcgaccgtccgtaggtccacggcccgaaggccgtccgcccccgtcggtccaccgttccgtccgtttccccaccccttccttccccg

SEQ ID NO: 112449 - DNA, 523 bp, Homo sapiens
  misc_feature: GYAE6OF02GJKC5.21.30.C08.1.454.CMB.1.raw
  modified_base (242)..(242): a, c, t, g, unknown or other
  misc_feature (242)..(242): n is a, c, g, or t
  modified_base (367)..(367): a, c, t, g, unknown or other
  misc_feature (367)..(367): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgtttttggaccagcagaagtcaggccaggcccctgtgttggtcatccatgaggacaggagacgaccctccgggatccctgacgagattctctggctccaactcagggacgtgccagttgattcncagtgggccaggtgaggatgaagctgactactactgttactcagcagacagcagtgtacagtcgaggggcagttcggcggacggacaactgaccgtcagtcacgccgaaggcctcgccccgtcggtcacgtcgtacgttcccgccctcctcctccg

SEQ ID NO: 112450 - DNA, 625 bp, Homo sapiens
  misc_feature: GYAE6OF02JXZCX.21.30.C08.1.454.CMB.1.raw
  modified_base (200)..(200): a, c, t, g, unknown or other
  misc_feature (200)..(200): n is a, c, g, or t
  modified_base (316)..(316): a, c, t, g, unknown or other
  misc_feature (316)..(316): n is a, c, g, or t
tcagtcgtcgctcgcacgaccggtgctcgatttagtctgacgtcaaagggaaagggggtaggggcgtcaggaggcgagagctctgggaatctaaccatggcctggacccctctcctcgctcccctcctcactttctgcacagtctctgaggcctcctatgagctgacacagccaccctcggtctccagtgtccccggganaaacggccaggatcacctgctctggagatgcattgaccaaaaaatttgtttttggaccagcagaagtcaggccaggcccctgtgttcggtcatccatgaggacaggagaccgaccnccgggatccctggacgagattctctggcgtccaacgcgagggtacgtggccacgtttgaacttctacgagttcggggccctagggtcggaggtagtgaagcgtgactacgttacgtcgttacgtactagcgagaacgacgcggtaagtggtacagtcggtaacgggggctaaggtttccggggacggtacggggtacccaagggggttacgacccggttaccgtagggtactacgggacccgaaacggtcgtcgcccccggttcgaccgtacgtccgtccgttaccccggtccgttccctccgtcccgg

SEQ ID NO: 112451 - DNA, 633 bp, Homo sapiens
  misc_feature: GYAE6OF02HNO67.21.30.C08.1.454.CMB.1.raw
tcagtcgtcgctcgcacgaccggtgctcgatttagtctgacgtcaaagggaagggggtggcgtcaggaggcagagctctgggaatctcaccatggcctggaccctactccttgctccccttccttcactttctgcacagtctctagaggcctccgtattgagcgtgacacgagccaccctacggtactcgagtcgtccccgggacaaacggccaggactcctacctgccttccgtggagtattggacaattacggaaccctaaaaaaaattttgttaggtttttttacggaaccctaggacgaaggtaaacggttcaaggacctaagggcccctgtgttggtcagtccatcgaggacaggagacgacccgtccgggactcccgtgacgagattctctggctccaactcgaggacggtggacctacgttgactttctacgtaggtcggggccccgtagggtcgggaggaagtggaaggtccgtagacttactacgttgttactcgagctagacagcagtgtacagtcgagggcagttcggacggtaggaccgtaggtcgaccgtcgtacggtcgacgccgaagccgtcgtcccctcggtccacgtccttccgttacccacccgttccttccccg

SEQ ID NO: 112452 - DNA, 532 bp, Homo sapiens
  misc_feature: GYAE6OF02IYFYM.21.30.C08.1.454.CMB.1.raw
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
  modified_base (488)..(488): a, c, t, g, unknown or other
  misc_feature (488)..(488): n is a, c, g, or t
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagccaccctcggtctcagtcgtccccgggacaaacggccaggatcacctgctctggagatgcattgaccaaaaaattattgtttttaggaccagtcagaagtcaggccaggcccctgtgtggtcatccatgaggacaggagacgaccctccgggactccctgagagattctctggctccaactcgagggacgtggccacgttgattcncaggtggggcccaggtggaggagtgaagctgactactactgttacncagcagacagcagtggtcatcgaggggacagttcggcgggagggacgtaggtcgaccgtcgtaggtcgngaccaaggctcgccccgtcggcacgtctcgttcccgccctcccg

SEQ ID NO: 112453 - DNA, 599 bp, Homo sapiens
  misc_feature: GYAE6OF02HAQJF.21.30.C08.1.454.CMB.1.raw
  modified_base (195)..(195): a, c, t, g, unknown or other
  misc_feature (195)..(195): n is a, c, g, or t
  modified_base (246)..(246): a, c, t, g, unknown or other
  misc_feature (246)..(246): n is a, c, g, or t
  modified_base (463)..(463): a, c, t, g, unknown or other
  misc_feature (463)..(463): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgaggcctcctatgagctgacacagccaccctcggtctcagtcgtccccggganaaacggccaggatcacctgctctggagatgcattcgaacctaaaaaatttnttgttttttaggaccagcagaagtcaggccaggcccctgtgttggtcatccatgaggacaggagaccgacccgtccgggactccccgtgacgagtattctctggcctccaactcgaggggtcggttcgcctacgttgactttctcgagggtcgggacccgtagggttggaggagttaggaacgtcgtagacttacgtacttgttactcagcaagacngacgagtcggtcagtcggaggggctacggttcgggacgggaggtaccggaggttacgaccgtcgtaggtcacggacccgacggccgtccgccccgtggtcctaccgttccgttccgtcccctaccgttccctcccg

SEQ ID NO: 112454 - DNA, 546 bp, Homo sapiens
  misc_feature: GYAE6OF02FN2ND.21.30.C08.1.454.CMB.1.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaattntgtttttggaccagcagaagtcaggccaggcccctgtgttggtcatccatgaggacaggagacgaccctccgggatccctgagagattctctggctccaactcgagggacggtggcctacgttgattctcaggtcggggccctagggtggaggagtgaagcgtgactactactgttactcagcagacagcagtggtcagtcgaggggctagttcggcgggaggaccgaggttcgaccgtcgtaggcacggcccgaaggcgtcgcccccgtggtccacgtcctcggtccccgtccctcctccccg

SEQ ID NO: 112455 - DNA, 670 bp, Homo sapiens
  misc_feature: GYAE6OF02G0DOY.21.30.C08.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtcgtccccgggacaaacggccaggatcacctgctctggagatgcattgacctaaaaaattnttgtttttggaccagcagaagtcaggccaggcccctgtgttggtcatccatggaggacaggagaccgacccgtccgggatccccgtgagagacttctctggctccaactcgaggggacggtcggcctacgtttgactttctacgacgggtcggggacccgagggtcgggaaggtacgttaggaaagtcgtagaaccttaacgttacgttagtttaacctcgaacgtacaacggactaggacgtaggtcggtacagttacggagggggtactaggttacgggcgggtaacgggaccgtaggggttcgacccggttccgtaacgggttaccgacggtacccggaacggccgtaccggtccccccgttacggtaccctaccgttcccgttaccgttaccccccttaccccgttcccttcccgttacccg

SEQ ID NO: 112456 - DNA, 562 bp, Homo sapiens
  misc_feature: GYAE6OF02ID2JO.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccggacaaacggccaggatcacctgctctggagatgcattgaccaaaaaaattntgttttttggaccagcagaagtcaggccaggcccctgtgttggtcatccatgaggacaggagacgaccctctgggatccctgagagattctctggctaccaactcgagggacggtggcctacgttgattctcaggtggggcccagggtggaggagtgaagctagactactactgttactcagcagacagcagtggtacagtacggaggggctagttcgggacgggagggaccgagggttacgacccgtcgtaggtcgaacggcccgaaggccgtcgcccccgtcggtccaccgtccgttcgttcccccacccttccccg

SEQ ID NO: 112457 - DNA, 530 bp, Homo sapiens
  misc_feature: GYAE6OF02FSH1U.21.30.C08.1.454.CMB.1.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaattnttgttttttggaccagcagaagtcaggccaggcccctgtgttggtcatccatgaggacaggagacgaccctccgggatccctgagagattctctggctccaactcgaggggacggtggacctacgttgattctcaggtcggggcccagggtggaggatgaagctagactactactgttactcagcagacagcagtgtcagtcgaggggcagttcggcggaggacaggtgaccgtcgtagcacggccaggcctacgccccgtcgcacctctcgtccctacctcctcccg

SEQ ID NO: 112458 - DNA, 550 bp, Homo sapiens
  misc_feature: GYAE6OF02H17R3.21.30.C08.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgtttttggaccagcagaagtcaggccaggcccctgtgttggtcatccatgaggacaggagacgacccgtccgggatcccctgagagattctctggctccaacgtcgagggacggtggccacgttgattctcgagtcggggcccagggtggaggagtgaagctgactactactgttactcagcagacagcagtgcagtcgaggggcagttcggcggagggaccgaggttcgaccgtccgtaggtcgacgcccgtaaggcctcgcccccgtcggtccacgttcctcgttccccacccgtccgtacccgg

SEQ ID NO: 112459 - DNA, 571 bp, Homo sapiens
  misc_feature: GYAE6OF02G6VE7.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattgaccaaaaaattnttgttttttaggaccagcagaagtcaggccaggccccctgtgttggtcatccatgaggacaggagacgaccccgtccgggaactccccgtgagagattctctggctccaactcgaggacggtggccacgttgattctcgagtcggggcccagggtggaggagtgaagctgactactactgttactcagcagacagcagtggcatcggaggggcagttcggacgggagggaccgagggttgaccggttccgtacggtcgacggcccgaaggccgtacggcccccgttggtccaccgttcctccggtttccccgcccttcccgttccccg

SEQ ID NO: 112460 - DNA, 585 bp, Homo sapiens
  misc_feature: GYAE6OF02JV6PS.21.30.C08.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgaggcctcctatgagctgacacagccaccctcggtctcagtgtccccgggacaaacggccaggatcacctgctctggagatgcattgaccaaaaaattntgtttttggaccagcagaagtcaggccaggcccctgtgttggtcatccatgaggacaggagaccgaccctccgggatccctgagagattctctcggctaccaactcgaacgggacggtcggccacgttgattctcaggtcggggcccagggtggaggagtaggaacgcgtacggacttaacgtacgttacgttactacgagacgagacgacgcaggtgtacgtagtcggaggggtcaggttcgggacgggtaacgggccgtaggttcgaccgtcgtacggtcgacgcccggaaggccgtccgccccgtggtcctacgtccgtccgtcccgtcctcccgttcccg

SEQ ID NO: 112461 - DNA, 1000 bp, Homo sapiens
  misc_feature: GYAE6OF02G8FVQ.21.30.C08.1.454.CMB.1.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
tcagtcgtcgctcgcacgaccggtgctcgatttagtctgacgtcaaagggtaaagggggttggggctcgaggaggcacgagctcgtgggaatctcaccagtggcctggacccgtcctcctgctcccctcctcgactttctgcacagtctcgtgacggcctcctactagagctgacacagtccaccctcggtctcagtcgtccccgganaacggcacggatcacctgctctgganactgcattgaccgaaaaattgttggtttttaggtacaggcagtaagtctaaggccaggtccctgtgtgtacaagtccgagtcgacggtacaggtacgaccgacccgttcgggtactcccgtgacgtacgtacgtttcgtacgtcggggtaccttacccgaaacgtttccgaacggggggttaccggtacggggtaccccggtaacggttttcgggaacgttttaccgtaccggttaaacggggggttacccggggggtaccccgttaaggggggttttaacggggtaacgggggtaaccggtttaacgggaaaaccgggttaccgttttaacgggtaaacccgtttaaacccggtttaaacccgtttaccggggttttaaacccggtaacccggttaaaccgggtaacccggttaaaacgggtaaacccggttaaacggttaaccggtaaccgggtttaccgggtttaacccgttaaacgggtttacccgggtaacggggggggttaccttaaacggggtttaaccggggttaacccgggggttaaccggggttaacccggtttaacggggtttacccggttaaccccggggtttaccggggttaacccggggttacccgggtaaaccggggtaaccccgggtaaacggggtacccggttaaccccgggtacccccggtttaacccggggttaccggttaacccggtttacccggtttacccggtttaacccccggttacccccgtttaccccggttaaccccggg

SEQ ID NO: 112462 - DNA, 553 bp, Homo sapiens
  misc_feature: GYAE6OF02FKNCW.21.30.C08.1.454.CMB.1.raw
  modified_base (331)..(331): a, c, t, g, unknown or other
  misc_feature (331)..(331): n is a, c, g, or t
  modified_base (463)..(463): a, c, t, g, unknown or other
  misc_feature (463)..(463): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattttgtttttgaccagcagaagtcaggccaggcccctgtgttggtcatccatgaggacaggagacgaccctccgggatccctgagagattcnctggctccaactcaggggcgtggccagttgacttctcgagtggggccccagggtggacggatggaagctgactactatgttactcagcagacagcagtgtcagtcgaggggcagttcgggcgggaggaccgnggttacggaccgtccgtaggtccgaggcccgaaggcctcgcccccgtggtcccacgtccgtccgttcccccgccttcccgtccttcccgg

SEQ ID NO: 112463 - DNA, 605 bp, Homo sapiens
  misc_feature: GYAE6OF02IJ73N.21.30.C08.1.454.CMB.1.raw
  modified_base (244)..(244): a, c, t, g, unknown or other
  misc_feature (244)..(244): n is a, c, g, or t
  modified_base (460)..(460): a, c, t, g, unknown or other
  misc_feature (460)..(460): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattgaccaaaaaatttnttgtttttaggaccagcagaagtcaggccaggcccctgtgttggtcatccatgaggacagggagaccgacccgtccgggactcccgtgacgagatttctcgtggctccaactcgagggacggtgccacgttgattctacgaggtcgggcccgagggtggaggagtggaagcgtagactacgttacttcgttactcgagcagacagcgagtcggtanagtcgacggggactaggttcggacgggacgggaccgtaggttcgaccgttccgtacggtccgaacggcccgaacggcccgtacccggtcccccgtagggttcccacgttcccgttccggttaccccctaccccgtcccttccccg

SEQ ID NO: 112464 - DNA, 580 bp, Homo sapiens
  misc_feature: GYAE6OF02H1RHB.21.30.C08.1.454.CMB.1.raw
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
  modified_base (477)..(477): a, c, t, g, unknown or other
  misc_feature (477)..(477): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaaattnttgttttttggaccagcagaagtcaggccaggcccctgtgttggtcatccatgaggacaggagacgacccgtccgggatcccgtgagagtattctctggcctccaactcgagggacggtcggccacgtttgattcgtcaggtcggggcccagggtggaggagtgaagctgactactactgttactcagcagacagcagtgtcagtcgaggggcagtcgggacggagggtaccgngggttagacccgtcgtaggtcgacgacccgaaggcctccggtcccccgtcggtccctaccgttccgttaccgttcccccgtccccgttccctcccgttcccgg

SEQ ID NO: 112465 - DNA, 606 bp, Homo sapiens
  misc_feature: GYAE6OF02G41CG.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattgacctaaaaaatttnttgttttttggaccagcagaagtcaggccaggcccctgtgttggtcatccatgaggacaggagaccgacccgtccgggactcccgtgagagattctcgtggcctccaactcgagggacggtggcctacgttgacttctcgaggtcggggcccgagggtcggaggtagtggaagtcgtacgtactacttacgtcgttactcgagcagacgagcgagtcgtacagtcggacggggcgtacggttcgggacgggacggaccggtaggttcgaccgttccgtaggtcgacggtcccgaacggtccgtaccggtcccccgttcggtccgtaccgtccgttccggtccccgtccctcccgtacccgg

SEQ ID NO: 112466 - DNA, 738 bp, Homo sapiens
  misc_feature: GYAE6OF02GULCJ.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaattntgttttttggaccagcagaagtcaggccaggcccctgtgttggtcatccatgaggcaggacgacgaccctccgggatcccgtgagagtacttctcgtggcctccaaactcgaggggacggtggcctacggttgatttccacgtaggtcgggggacccctaggggtcgggagggtacgtaggaaacggtcgtaggaccttaaccgttaacgttaccggtttaactccgaagtccgaacgaccgtacggaccgtaacggtgggtaccaacggttaccggaaggggggtaccgtaacggtttccgggggaccggggaacggggtacccggtaacggggtttacggacccgggtttacccgttacgggtaccgtaaccggggaccccggtaaacgggtccccgttacccggtcccccccggttaccgggttacccgttacccggtttcccgtttccccgggtttccccccgttccccccggttaccccgtttcccccgg

SEQ ID NO: 112467 - DNA, 856 bp, Homo sapiens
  misc_feature: GYAE6OF02IN7KP.21.30.C08.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccggacaaacggccaggatcacctgctctggagatgcattgaccaaaaaattnttgttttgtaccagcagaagtcaggccaggcccctgtgttggtcatccatgaggacaggagacgaccctcgggactccctgagagtattctacgtggcctaccaactcgaacggggtaccggttaggccctacggttagtacttccgtcgaacgggttccgggggcccctaaggggtttcgggaagggtaacgttagggaaaacggccgttaacggtaaaccgtttaaccgttaaccgttacgggtttaaacctaccgtaaaggtacccgttaaacggaaaccgtaacgggtacccgtaaagggttacgggttaaccgtaacgggtttacccgggaaacggggggggttaccctaaacggggttttacccgggggaccgggggttaaaccgggggtaaaccccgggttaaagggggtttacccgggttaaaccccgggttaccccgggttaacggggttacccggtaaacccggggtaacccccggtaaacggggttccccggttaccccgggttacccccccgggttacgggttaccccgtaaccccggtttcccggtttacccgggtttacccccccggttacccccgtttccccccgtttaaccccccggg

SEQ ID NO: 112468 - DNA, 556 bp, Homo sapiens
  misc_feature: GYAE6OF02GZNHO.21.30.C08.1.454.CMB.1.raw
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
tcagtcgtcgctcgcacgaccggtgctcgatttagtctgacgtcaaagggaaagggggtgggtccaggaggcagaactctgggtgtctcaccatggcctggacccctctcctgctccccctcctcactttctgcacagtctctgaggcctcctatgagctgacacagccaccctcggtgtcagtgtccccaggacaaacggccaggatcacctgctctggagattcattgaccaaaaagatatacttgttggttccagcagaagtcaggccaggcccctgtactggtcatccatgaggccagtcgacgacacgtccgggatccctgagagattctctgcctcagctcgagggacagtcggcctacgttgactatcgaggtcggggcccagggtggacgagtgaagctagactactattgttacncacagacagtagtgtnagtcgaggggttgtcgggnggacggactagtcgaccgttcgtgtcacggcccgaaggtccgtccgccccgttggtcctaccgttccgttccgttacccctaccccgtccttccccg

SEQ ID NO: 112469 - DNA, 693 bp, Homo sapiens
  misc_feature: GYAE6OF02G79NW.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattgacctaaaaaatttgttgtttttaggaccagcagaagtcaggccaggcccctgtgttggtcatccatgaggacaggagaccgacccgtccgggactcccgtagagagtattcctcgtcggctaccgaactcggacggggacgggtcggaccctacggttgtaacttctacgaggtcggggcccgaggggttcgggaggacgttgaaggtccttaggaaccgttacgtacgttagttacctacgacgtacgaagaccgtacgacgtaggtcggtactacgtacgggacgggggtactaggttccgggacgggacggggtaccgtaagggttaccgtacccggttaccggttacgggtacccgtaacgggaccccgtaacgggtcccgtaccggtccccccggttaggtacccgtacccgttccggttacccggtttaccccctaccccgttccccttaccccgg

SEQ ID NO: 112470 - DNA, 863 bp, Homo sapiens
  misc_feature: GYAE6OF02G6W4X.21.30.C08.1.454.CMB.1.raw
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
tcagtcgtcgctcgcacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcgagatggactgaccaaagaatatgcttatggtaccaanagaanccagcagccctgtgttagngatatataaagacactgagtacggcctcagagatcccgtgagcgattctactaggctccagcttacgaacggggtacacgacgtaacggttcctaaccggtttaggtaaaccttaacgttacccgtaaagggtttaacgggtaaaacccggtttaccccggaaacggggtaacccgtaaaagggggaaccggggtaaaacccgggtaacggggtacccgtttaaacggggtaaaacccttttaaacggttttaaacccgttaacggggtttaaaacccaaaaaaccggttaaacggggtttaaaacggaaaacccgggttaaacggtttaaaacggggtaaacccggggtttaaaccgtttacccgtttaaagggtttttacggggggttttaaccgttttaacccgggggggacccgggggttaaaccgggggttaaccccgtaaaacggggtccgtttaacccgggggtaaacccgtttaccccgggtttaaacggggtacccgtaaccgggtaacccccggtaaaccgggttcccggtttaccccgggtacccccccgtttacggggttaacccccgg

SEQ ID NO: 112471 - DNA, 607 bp, Homo sapiens
  misc_feature: GYAE6OF02G18CB.21.30.C08.1.454.CMB.1.raw
  modified_base (242)..(242): a, c, t, g, unknown or other
  misc_feature (242)..(242): n is a, c, g, or t
  modified_base (434)..(434): a, c, t, g, unknown or other
  misc_feature (434)..(434): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgtttttggaccagcagaagtcaggccaggcccctgtgttggtcatccatgaggacaggagaccgacccgtccgggactcccgtgagagattctcgtggctccaactcgagggacggtcggccgtacgttgattctacgaggtcggggcccgtagggtggaggataggaagctagactactactcggttacncgagcaacgacagcagtggtacagtcggaggggtacaggttcgggcgggacgggtacgtacgggttacgacccgttccgtacggtcgtaacggccccgaagggtcccgtccggtacccccggttcggtaccttaccgtcccgttccggtttcccccgtcccttcccgtccccg

SEQ ID NO: 112472 - DNA, 605 bp, Homo sapiens
  misc_feature: GYAE6OF02GDS1D.21.30.C08.1.454.CMB.1.raw
  modified_base (243)..(243): a, c, t, g, unknown or other
  misc_feature (243)..(243): n is a, c, g, or t
  modified_base (408)..(408): a, c, t, g, unknown or other
  misc_feature (408)..(408): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattcgaccaaaaaattnttgtttttggaccagcagaagtcaggccaggcccctgtgttggtcatccatgaggacgaggagaccgaccctccggggactccccgtgagagattctcgtggcctccaactcgaggggacggtcggcctacgttgacttcgcaggtcggggcccagggtggaggntaggaagctaggactactactgttacctcgagcagacagcagtggtacagtcggaggggtctagtcgggacggacgggaccgtagggttccgacccgttccgtagggttccgaccggcccggtaaggtcccgtcccggcccccgttcggcctaccgttcccgttcccggtccccgtccccgttcccgtttcccccgg

SEQ ID NO: 112473 - DNA, 621 bp, Homo sapiens
  misc_feature: GYAE6OF02G1EAP.21.30.C08.1.454.CMB.1.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaattnttgtttttggaccagcagaagtcaggccaggcccctgtgttggtcatccatgaggacaggagaccgacccgtccgggactccccgtgaagtacgattctctggcctaccaaactcgaaggggaccggtggcctacggttgactttccgtcgagggttcggggcccctaggggttagggaggtagtagggaagccgttagaacctacttacgttagttactcgagactagacagcaggtgtcagtcggaggggactaggttccgggacgggagggaccgtaggttcgaccgttcgtacggtcgacggcccgaacggcctcccggacccccgtggtaccctacgttccgttcccggttcccctaccccgttcccttccccg

SEQ ID NO: 112474 - DNA, 752 bp, Homo sapiens
  misc_feature: GYAE6OF02JFIO0.21.30.C08.1.454.CMB.1.raw
  modified_base (559)..(559): a, c, t, g, unknown or other
  misc_feature (559)..(559): n is a, c, g, or t
tcagtcgtcgctcgcacgaccggtgctcgatttagtctgacgtcaaagggtaagggggttggggctccaggaggcacgagctcgtgggaatctcgacctatggtcctggacccctcctcctgctcccctcgtcacttctgccacacgtcctcctgacggtccttcctactaggagtcctggacacgaggccaccctcggtcctcgagtcgtcccgggacaacggccaggactcgactagctcgtggatatgactattcgacctaaaaagttgttgtttttaggacctagacgagttagtccacggtcctaggccccttggtgttgggtcatcccaagtcgaagggaccgaagggacgtacggacccgttcgggatcccgtagacgagtacttcgtcctggcctccaacttcggaacggggaccggttcggacctaacggttcgacctttcgtaccgagggtcccgggaccctgggtacgggacggagttcggaaagccgttacgaaccttacgtacgttcggttaacctccggtaaccgccgtaacggacgtaaccggngtacggttacggaccgtacgacggggtacggggacccgttaacgttccggggaaccgggtacgggtaaacccgttaggttaccggtaaccgttaccgtacggtaacggaccgaccggtaaggtccgtaccgtcccccgtacggtcccgtacgttccgtcgggtttaccccctacccggtttaccgttccccgg

SEQ ID NO: 112475 - DNA, 610 bp, Homo sapiens
  misc_feature: GYAE6OF02HGLQK.21.30.C08.1.454.CMB.1.raw
  modified_base (190)..(190): a, c, t, g, unknown or other
  misc_feature (190)..(190): n is a, c, g, or t
  modified_base (236)..(236): a, c, t, g, unknown or other
  misc_feature (236)..(236): n is a, c, g, or t
tcagtcgtcgctcgcacgaccggtgctcgatttagtctgacgtcaaagggaaggggtgggctcaggaggcagagctctgggaatctcaccatggcctggaccctctcctgctcccctcctcactttctgcacagtctctgagcctcctatgagctgacacagccaccctggtctcagtcgtccccggganaacggccaggactcacctgctctggagatgcattgaccaaaaattntgtttttgaccagcagaagtcaggccaggcccctgtgttgacattccatgaggacaggagacgcccgttaccgggaacttcccgtaggtaacgtacgtactttcgtcgtggtacctaccgtaaccgtcgacggggtacgtcggcctacggttgacttcgacgtaggtcgggacctagggtcggagtacgtaggtaacgcgtacgtactacgtacttgttactcgacgtcgtacgacacgtcgtagtcgtctagtacgagggtctaggttccggaggtacggaccgtaggtcgtaccgtacgtacgtcgacggtccgaacggtcgtccgtacccgtggtacctcgttccgtacgttacccgtcctccgttacccg

SEQ ID NO: 112476 - DNA, 659 bp, Homo sapiens
  misc_feature: GYAE6OF02IEIR2.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggacaaacggccaggatcacctgctctggagatgcattgacctaaaaaaattnttgtttttggaccagcagaagtcaggccaggcccctgtgttggtcatccatgaggacaggagacgacccgtcgggactccctgagagattctctggctccgaactcgagggacggtggacctacggttgattctcgtaggtcggggccctaaggggtgggaacggtagtaggaacggtcgttaggaaccttaactaacgttacgttaaccttcgaacgcaacggtacacggcgtaaggtcggtacacgtcggaacggggggctaaggtttccgggacgggtagggaccgtagggttacgaaccgggttccgtacggttccgacggtacccggaacggcctacccggtccccccgtacgggtccctaaccgttcccgttacccggtttacccctacccccgttccctttacccccgg

SEQ ID NO: 112477 - DNA, 529 bp, Homo sapiens
  misc_feature: GYAE6OF02IJW1W.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattgaccaaagaatatgcttattggtaccaacagaagccaggccaggcccctgtgttagtgatatataaagacactgagaggcctcagagatccctgagcgattctctggctccagctacgaggacagcagtcacgttgactatcgagtagaacgtcaggcaggaggacgaggctagacttatactgtacaaagagtaagacagtagaaggtactcgtagtttgggtgtcgggacgggaggaccgaagcgtacgaccgtacgtaggtccacgccgtaaggcctaccggcccctcggctaccg

SEQ ID NO: 112478 - DNA, 588 bp, Homo sapiens
  misc_feature: GYAE6OF02HNSU2.21.30.C08.1.454.CMB.1.raw
  modified_base (438)..(438): a, c, t, g, unknown or other
  misc_feature (438)..(438): n is a, c, g, or t
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagccaccctcggtctcagtgtccccgggacaaacggccaggatcacctgctctggagatgcattgaccaaaaaattattgtttttaggtaccaggagaagtcaggccaggcccctgtgttggtcatccatgaggacaggagacgacccgtccgggatccccgtgacgagattctcgtggcctccgaaactcgaggggacggtggcctacgttgattctcgaggttcggggcccagggtggaggagtggaagcgtagaactagtactagttacncagcagacagcaggtgtcaagtcggacggggctaggttcgggacgggagggaccgtagggttcgaccggttccgtagtccgaacggcccgaaggcgtcccgcccccgtaggtccctactccgttaccgtacccccacccttcccttcccg

SEQ ID NO: 112479 - DNA, 564 bp, Homo sapiens
  misc_feature: GYAE6OF02GBQMJ.21.30.C08.1.454.CMB.1.raw
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgttttttggaccagcagaagtcaggccaggcccctgtgttggtcatccatgaggacagganacgaccctccgggatcccctgagagatttcnctggctccaactcagggacggtgccacggttgattcncaggtcggggcccagggtggaggatgaagctgactactacgtgttaactcagcaagacagcagtgcagtcgagggggcagttcgggaggacgggaccagggttcgaccgttccgtaggtccacggacccaacgggctaccgcccccgtcggtccaccgttcctacgttcccccacccttccctccttccccg

SEQ ID NO: 112480 - DNA, 788 bp, Homo sapiens
  misc_feature: GYAE6OF02H3K2P.21.30.C08.1.454.CMB.1.raw
tcagtcgtcgctcgcacgaccggtgctcgatttagtctgacgtcaaagggaaaggggtgggctcaggaggcagagctctgggaatctcaccatggcctggacccctctcctgctccccctcctcactctctgcacaggctctgaggcctcctatgagctgacacacgcccaccctcggtcgtcagtcgtccccaggaccacggacggccaggactccacctgctcgtgcagatcggactgaccaaaagaatagtagtcttagttacggtaaccaaacgaagaacgaccgaacgggcccgaaccggtcccccgttaggttagtttaaggtacgtaaagttaattaaagtaaaaggaactacgtagaacggtaaccgtaccctagaagaacgtacgttacccgtaggaacgtacgtacgtttcgtcgtcggtacctaccgacgccgttacggaacgggtaccaggtacctaaggttaccgtacggtttacggaactttacgtacgtaaggtacggtaaacgtccggaaggtaccgaaggggtaacggaaccggtaacgggtacgttaacgtaaccgtttaacgtttaacggtaacgtaaaccgtaaaacggtaacgttaacggtaaacgtaagggttaaacggtaacggtttacctaacggttaacgggtttaggggttacgggttaccgggggaacgggttaacgggaccggtaaaccgttcgggtaccggtaacccgttcggtaacggccgtaccggaacccggtagtccccgtaccggtacccccgg

SEQ ID NO: 112481 - DNA, 697 bp, Homo sapiens
  misc_feature: GYAE6OF02IYTPZ.21.30.C08.1.454.CMB.1.raw
  modified_base (131)..(131): a, c, t, g, unknown or other
  misc_feature (131)..(131): n is a, c, g, or t
  modified_base (195)..(195): a, c, t, g, unknown or other
  misc_feature (195)..(195): n is a, c, g, or t
  modified_base (244)..(244): a, c, t, g, unknown or other
  misc_feature (244)..(244): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctctcactttcngcacagtctctgaggcctcctatgagctgacacagccaccctggtctcagtcgtccccgggaanaaacggccaggactccacctgctctgcagatggactgaccaaaagaatntgctttagtgtaccaacagaagccaggccacggccctgtcgttagtgaatataataaagactacgtagaagacggacccctgaagtacgacttacccgagacggcgtaactttcgcgtcggtcctaccgacgtcctacggaacgggaccagcgtaaacgtcgtaacgttcgaacctttaactcgaacggttagaaccgggtacccgaaggaccgaaggaacgggaaccggtacggtcgtaaggaacctttaacgttacgtaacggtaacaaaacgtaacggtaacgtaacgtaagtaacggtacgttaacgtaccgttaaggttccggggttagttaccgggagggttaaccgggacctaaacggtccgtacggtaacccggtaccggttaacgtaccgaccggaccccgtaagggcccttaccccgggaccccttccggtacccgttacccg

SEQ ID NO: 112482 - DNA, 526 bp, Homo sapiens
  misc_feature: GYAE6OF02HVM2U.21.30.C08.1.454.CMB.1.raw
  modified_base (240)..(240): a, c, t, g, unknown or other
  misc_feature (240)..(240): n is a, c, g, or t
  modified_base (426)..(426): a, c, t, g, unknown or other
  misc_feature (426)..(426): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgaggcctcctatgagctgacacagccaccctcggtctcagtgtccccgggacaaacggccaggatcacctgctctggagatgcattgccaaaaaattntgttttttggaccagcagaagtcaggccaggcccctgtgttggtcagtccatgagacaggagacgaccctccgggatcccctgagagattctctggctccaactcagggacggtggccacgttgattctcagtgggcccagggtcggaggagtgagcgtagactactactgtactcagcagacagnagtgtcagtcgaggggcagttcggcggagggaccaggttgaccgtctaggtcagcccgaaggctcgccccgtcgtcactctcgtcccgtccctcctcccg

SEQ ID NO: 112483 - DNA, 606 bp, Homo sapiens
  misc_feature: GYAE6OF02IDRLR.21.30.C08.1.454.CMB.1.raw
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (427)..(427): a, c, t, g, unknown or other
  misc_feature (427)..(427): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctcctcactttctgcacagtctctgaggcctccatgagctgacacagccaccctcggtctcagtgtccccgggacaaacggccaggatcacctgctctggagatgcattgaccaaaaaaatttgtcgtttttttggacccagcagaaagtcaggccaggcccctgtgttggtcatcatgagacagganacgaccctccgggatccctgagagattctctggctcaacctnagggcgtggccacgttgacttctcagttcggggcccagggtcggaggtagtgaagcgtgactatacttcggttactcganccgagacgagtccaagttggctactccgaaggggtcaggtttcggcgggtaagggacccgtagggtacgtaccggtaccgtacgggttaccgaggacccgtaacggccgttaccggtcccccgttcccgggttcgaacccgttccgttaccggttccccgtccccggtccctccccggg

SEQ ID NO: 112484 - DNA, 748 bp, Homo sapiens
  misc_feature: GYAE6OF02F25NF.21.30.C08.1.454.CMB.1.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctgganatgcattgacctaaaaaattnttgttttttaggacctagcaagaagtcaggccaggcccctgtgttggtcatccagtgaggacaggagaccgacccgtccgggatccccgtgacgagtattcgtctggctccaactcgacggggtacggtcggaccctacgtttggaatttccgtacgtaacgggttcgggggcccctaggggtacgggagggacgttagggaaacggtcgttaggtaaccgttaacgtaaccgtttaggtttaaccctacgtacgtacctaacggacctaaggccgtaaggttcgggtaccaaggttaccggaggggggacctagggtttccggggacgggtaacggggaacccgttagggttaccgtacccgggttacccgttagggtaccaaccgggtaacccccgtaaggggtccccgttaacccgggtccccccgttaccgggttacccgtacccggttcccgttacccggtttcccccccgttacccggttcccccgttaacccccgggg

SEQ ID NO: 112485 - DNA, 645 bp, Homo sapiens
  misc_feature: GYAE6OF02F0MFZ.21.30.C08.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattcgacctaaaaaatttnttgtttttaggaccagcagaagtcaggccaggcccctgtgttggtcatccatgaggacaggacgaccgaccctccggggactcccgtgagagtattctctggtcctaccaacgtcgaggggaccggtcggcctaacggttgaatttccgtacgtagggtccggggcccgtaggggtcgggaggtagtaggaacgtcgtagtaaccttacttacgttacgttacctcgacgtcgaacgacgagacgtaggtcggtacagtcggaggggctagtcgggcgggaacgggtaccgtaggttcggacccgttacgtacggtacgacggcccgaacggtccgtacccggtccccgttcggtacctaccgttccgttccgttcccccgtacccttcccgttccccg

SEQ ID NO: 112486 - DNA, 560 bp, Homo sapiens
  misc_feature: GYAE6OF02FY5RN.21.30.C08.1.454.CMB.1.raw
  modified_base (196)..(196): a, c, t, g, unknown or other
  misc_feature (196)..(196): n is a, c, g, or t
  modified_base (245)..(245): a, c, t, g, unknown or other
  misc_feature (245)..(245): n is a, c, g, or t
  modified_base (403)..(403): a, c, t, g, unknown or other
  misc_feature (403)..(403): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccccctcctcactttctgcacagtctctgaggcctcctatgagctgacacagccaccctcggtctcagtgtccccggganaaacggccaggatcacctgctctggagatgcattgaccaaaaaaatttntgttttttggaccagcagaagtcaggccaggcccctgtgttggtcatccatgaggacaggagacgaccctccgggatcccctgagagtattctctggctccaactcagggacggtggccagttgattctcagtcggggcccagggtggaggatgaagntgactactactgttactcgagcagacagacagtggtcagtcgaggggcagttcggcggagggaccaggttcgaccgtctaggtcacggcccaaggccgtaccgcccccgttacgggtccacgttccgttcgtaccccggtccccgtcccgttccccg

SEQ ID NO: 112487 - DNA, 591 bp, Homo sapiens
  misc_feature: GYAE6OF02F52PQ.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagccaccctcggtctcagtcgtccccgggacaaacggccaggatcacctgctctggagatgcatgacctaaaaaattttgtttttgaccagcagaagtcaggccaggcccctgtgttggtcatccatgaggacaggagaccgacccgtccggatcccgtgagagattctctggctaccaactcgagggacggtcggccacggttgattcgtcgaggtcgggcccagggtggaggagtgagctgactactacgtgttactcgagctagacagcaggtgactagtcggaggggctagttcgggacgggtacggaccgtagggttacgaccggttccgtacgggtaccgtacggacccgaggtccgttccggcccccgttcgggtacctacccgttccggttcccgttacccccgcccgtttacccccg

SEQ ID NO: 112488 - DNA, 625 bp, Homo sapiens
  misc_feature: GYAE6OF02JFG9B.21.30.C08.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattatgtttttaggtaccagtcagaagtcaggccacggcccctgtgttggtcatccatgaggacaggagaccgacccgtccgggactcccgtgagagtattctctggctaccaactcgaggggacgtcggcctacgttgattctacgaggtcgggccctagggtcggagggataggaacggtctacggacttactaacgttgttaaccncgagtacagaccagcgagtcggtacagtcggagggggtactaggttccgggacgggacggtaaccggtaggtttcgacccggttccgtagggtccgaacggtcccgaaggtcccgtccggcccccgttcggtacctaccgttcccgttacggttcccccgtacccttcccgtacccgg

SEQ ID NO: 112489 - DNA, 544 bp, Homo sapiens
  misc_feature: GYAE6OF02HBWWH.21.30.C08.1.454.CMB.1.raw
  modified_base (242)..(242): a, c, t, g, unknown or other
  misc_feature (242)..(242): n is a, c, g, or t
  modified_base (513)..(513): a, c, t, g, unknown or other
  misc_feature (513)..(513): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgttttttggaccagcagaagtcaggccaggcccctgtgttggtcatccatgaggacaggagacgaccctccgggatcccctgagagattctctgcctccagcctcgagggacaggtggcccaccttgactatcaaggtggggcccaggtggacgatgaagctgactactattgttacgcaccagacagtagtggtcatcgagggggtattcgggcggagggaccaagttgaccgtcgttggtcagcccaaggctacgccccctcggtccncgtctcgttccccacctccctcctcgttccc

SEQ ID NO: 112490 - DNA, 499 bp, Homo sapiens
  misc_feature: GYAE6OF02FVWYO.21.30.C08.1.454.CMB.1.raw
  modified_base (313)..(313): a, c, t, g, unknown or other
  misc_feature (313)..(313): n is a, c, g, or t
  modified_base (454)..(454): a, c, t, g, unknown or other
  misc_feature (454)..(454): n is a, c, g, or t
tcagtcgtcgctcgcacgaccggtgctcgatttagtctgacgtcaaagggaaagggggtgggctcaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctnagagatccctgagcgattctctggctccagctcagggacagcagtcagttgactatcagtgaagtccaggcagaggacgaggctgacttattactgtacaaacagtagacagtagtaggtactctagttgggtgttacggnggaggaccaagctgaccgtctaggcacgccgaggctcgccctcgg

SEQ ID NO: 112491 - DNA, 597 bp, Homo sapiens
  misc_feature: GYAE6OF02HXP02.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaattnttgtttttggaccagcagaagtcagccaggcccctgtgtggtcatccatgaggacaggagaccgacccgtccgggactcccgtgagagattctcgtggctccaactcgaaggggacggtggcctacgttgtaattctcaggtcggggccccagggtcggaggagtaggaagtccgtagaccttacgttacgtcgttactcgagactagacagctagtgacagtcggaggggctagttcgggcggacgggaccgtaggttcgaccgtccgtaggtaccgacggtacccgaaggtccgtccggcccccgtcggtcccacgttccttaccggttccccgtccccttcccgttccccg

SEQ ID NO: 112492 - DNA, 635 bp, Homo sapiens
  misc_feature: GYAE6OF02FOBKV.21.30.C08.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccacctcggtctcagtcgtccccgggacaaacggccaggatcacctgctctggagatgcattgacctaaaaaatttnttgttttttacggtaccagcaagaagtcaggccaggcccctgtgttggtcatccatgaaggcaggagaccgacccgtcgggactccctgagagtattctctggcctccgaactcgaggggtacggtcggacctacgttgtacttctcgaggtcggggaccctagggtggaggagtgaagctgtaacctacgttacttcgttactcgagtcaagacagcgagtggtacagtacggaggggtactaggttcgggacgggaacggggacctagggttcgacccggttccgtacgggtacgaccggacccggtaaggcccgttaccgtccccccggttaggtccccttaccgttcccgttaccggttccccccaccccgtttcccgttacccccg

SEQ ID NO: 112493 - DNA, 775 bp, Homo sapiens
  misc_feature: GYAE6OF02F2ESD.21.30.C08.1.454.CMB.1.raw
  modified_base (195)..(195): a, c, t, g, unknown or other
  misc_feature (195)..(195): n is a, c, g, or t
  modified_base (241)..(241): a, c, t, g, unknown or other
  misc_feature (241)..(241): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaattntgtttttggaccagcagaagtcaggccaggccccctgtgttggtcatccatgaggacaggagaccgacccgtccgggactccctgagagattctcgtggtctaccaactcgagggcggtcggcctacgttgtacttctacgtacggtcggggacccgaggggttcgggaacgggtagtacggaaggtccgttaggtaaccgttaacttaccgttacggtttaacctacgaacggtacgaaggtaaccaggtccgtaagggttcgggtactaacggttccgggaacggggggtactacgggtttaccggggacggggtaaccgggggtaacccgtaacgggggtttaccgtaaccccgggttacccggttaaccggggtaccgtaaccgggtaacccccgggaaacgggttccccggttaaccccgggtccccccccggtttaaccggggttaccccttaacccgggtttccccgtttaccccgggtttacccccccctttaaccccccgtttccccccggttaaccccccgggg

SEQ ID NO: 112494 - DNA, 666 bp, Homo sapiens
  misc_feature: GYAE6OF02JA3VS.21.30.C08.1.454.CMB.1.raw
  modified_base (257)..(257): a, c, t, g, unknown or other
  misc_feature (257)..(257): n is a, c, g, or t
  modified_base (655)..(655): a, c, t, g, unknown or other
  misc_feature (655)..(655): n is a, c, g, or t
tcagtcgtcgctcgcacgaccggtgctcgatttagtctgacgtcaaagggaaagggggtagggcgtcagggaggcagagctctgggaatctcaccatggcctggacccctcctcctgctccccctcctcactttctgcacagtctctgaggcctcctatgagctgacacagcccaccctcggtctccagtcgtccccgggacaaacggccaggatcgacctgcctactgggagatcgcatttcgaccaaaaaaattnttggttttttggaaccagtcagaagtcaggccaggcccctgtagttggcactccgaatcggaggaccaggtacgacgacccgtcgggatccccgtgagagattccgtatcggcttccaacgtcgacgggggacgtcgggaccctacggttggacttcgtacgaaggttcgggggccctaggggtacgggaggacgtagaacggtcgttcggaactaccgttacttacggttacctacgtgaccgtaacgacgaagcgtaaggtggttaccaaggtccgggaagggggtccaaggtttccggggagggaacggggaccgttagggtccgtaaccggtccgtaggtcggacggtaccggacgtcgtccgccccgtaggtctccctacggttcctaccccncccgtctcccg

SEQ ID NO: 112495 - DNA, 675 bp, Homo sapiens
  misc_feature: GYAE6OF02GQ8V9.21.30.C08.1.454.CMB.1.raw
  modified_base (223)..(223): a, c, t, g, unknown or other
  misc_feature (223)..(223): n is a, c, g, or t
  modified_base (323)..(323): a, c, t, g, unknown or other
  misc_feature (323)..(323): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtgtcagtcgtccccaggacaaacggccaggatcacctgctctgganattcattgacaaaagatatacttgttgtcagcagaatcgagccacggccctgtactggtcatccatgaggccagtcgacgacaccgtccgggactcccgngagagtattctctcgccctacgagcctcgaagggacacggtcggcctacgttagactacgtcgagggtcgggacccgtagggtcggaacggagtacggaacgtcgtacgtacttaacttagttacggttaaccgacctaaccgagtaacgtaggttacggtcggttacctaggtaccgggtagggggtttacgtcggggaaccggggtaacgggtaccgtaaacggttccggtacccggtttccgtttacgggtaccgtaacggaccccgtaagggtcccgttacccggtacccccgttacgggttacccttaccgtcccggtttaccggttccccccgtcccttacccccg

SEQ ID NO: 112496 - DNA, 639 bp, Homo sapiens
  misc_feature: GYAE6OF02GYCEV.21.30.C08.1.454.CMB.1.raw
  modified_base (243)..(243): a, c, t, g, unknown or other
  misc_feature (243)..(243): n is a, c, g, or t
  modified_base (334)..(334): a, c, t, g, unknown or other
  misc_feature (334)..(334): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtcgtccccgggacaaacgccaggatcacctgctctggagatgcattgacctaaaaaattnttgtttttaggaccagcagaagtcgagccaggccctgtgttggtcatccatgaggacgaggacgacgacccgtccgggactccctgagagnttctctggcctaccaactcgaggggtacgtcggcctacgttgactttcgcgtacggtcggggcccagggtgggaagtagtagaagctacgactacttacgtagttacncgagacgaagtaccgngaccgtaggtcgtacgagttcggaggggtactacggttcgggacgggcgggtaaccgtgggttaccgccgttaccgtaacgggtcgaccggtacccgtaagggcccgtaccggtccccccgttacggtaccacccgttccgtaccggttcccccgtccccgttacccgttcccgttccccg

SEQ ID NO: 112497 - DNA, 634 bp, Homo sapiens
  misc_feature: GYAE6OF02IOFXG.21.30.C08.1.454.CMB.1.raw
  modified_base (341)..(341): a, c, t, g, unknown or other
  misc_feature (341)..(341): n is a, c, g, or t
tcagtcgtcgctcgcacgaccggtgctcgatttagtctgacgtcaaagggaaagggggtgggctcaggaggcagagctctgggaatctcaccatggcctggaccctctcctgctccccctcctcactttctgcacagtctctgaggcctcctatgagctgacacagccaccctcggtgtcagtcgtcccaggacaaacggccaggatcacctgctcgtggagattcattgaccaaaagaattatactttgttggttccagcagaagtcaggccacggcccctgtactgtcatccatgaggccaggtcgacgacacgtccgggatcccgtgagagtacttcnctcgcctccagtcctacgagggacacggtcggaccctaccgttagacctagtcgtacgggtcggggcccgtagggtcggaacggagtaggaagcgtagtacgttaacgttactttacggtacaccgtaaccgagtacagttagtcgtactagtcggtaaggggttacgtcgggacggaggaaccgtaggttcggtacccgttcggttacgggtccgaacggacccgtaacggtccgtccggtcccccggttacggtccctaacccgttcccgttcccgttaccccttaccccg

SEQ ID NO: 112498 - DNA, 719 bp, Homo sapiens
  misc_feature: GYAE6OF02JD8XF.21.30.C08.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagccaccctcggtctcagtgtccccgggacaaacggccaggatcacctgctcgtggagatgcattcgaccaaaaaattnttgtttttggaccagcagaagtcaggccaggcccctgtgttggtcatccatggacggacaggacgaccggaccctaccggggacttccccgtaggacgacgtacgttcctcgtcgggccttaccaacgtccgaaggggtacggtcggacctacggttcgaatttcctacgtacgggtcggggtacccgaggggtggaacggtagtacggaaacgtcgtacggtaaccttaaccgtacgtttacgtttaacctacggaacgtacggtaacgtaacgaacgccggtaagttccgggtactaacgtccgggaaagggggccttaaggttcccgggacggggtacgggtaccgtaacggggtttcgaacccggttcgttaacgggccctaacgggtaccccgaaggttcccgtaccggtcccccgttcgggtaccctaccgtttcccgttaccgttaccccccgaccctttacccccgg

SEQ ID NO: 112499 - DNA, 633 bp, Homo sapiens
  misc_feature: GYAE6OF02G77KS.21.30.C08.1.454.CMB.1.raw
  modified_base (196)..(196): a, c, t, g, unknown or other
  misc_feature (196)..(196): n is a, c, g, or t
  modified_base (250)..(250): a, c, t, g, unknown or other
  misc_feature (250)..(250): n is a, c, g, or t
  modified_base (431)..(431): a, c, t, g, unknown or other
  misc_feature (431)..(431): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccggganaaaccggccaggatccacctgctctggagatgcattacgaacctaaaaaatttnttgttttttaggaccagcagaagtcaggccaggcccctgtgttggtcatccatggagacaggacgacgacccgtccgggactcccgtgagagtattcctcgtcggtctaccaactcgacggggacggtcggacctacggttcgactttcacgtagggtcggggcccgaggggtaggagggngtaggaagtcgtacgacttaacttacgttcgttaactcgagtcagacaaggcaggttcgtacgagtcgggaggggtcgtagtccgggacgggacggaccgtaggtccgtaccgtccgtacggtcacgggcccgaacggccgtaccgcccccgttacggtccctaccgttccgtacccgtcccccgtccctacccttccccgg

SEQ ID NO: 112500 - DNA, 565 bp, Homo sapiens
  misc_feature: GYAE6OF02FHENQ.21.30.C08.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaattntgttttttggaccagcagaagtcaggccaggcccctgtgttggtcatccatgaggacaggagacgaccctcgggactccctgagagattctctgctccactcgagggacggtggccacgttgattctcagtcggggcccagggtggaggatgagctgactacgtactcgttactcagcagacagcagtcggtactatcgagggggcagttccgggcgggtacgggacgtacggttcgaccggttccgtacggtcgacggtcccgaaggccgtccgcccccgtcggtccaccgttccgtccgttcccctacccctcccttcccg

SEQ ID NO: 112501 - DNA, 535 bp, Homo sapiens
  misc_feature: GYAE6OF02GG4N8.21.30.C08.1.454.CMB.1.raw
  modified_base (179)..(179): a, c, t, g, unknown or other
  misc_feature (179)..(179): n is a, c, g, or t
  modified_base (363)..(363): a, c, t, g, unknown or other
  misc_feature (363)..(363): n is a, c, g, or t
  modified_base (449)..(449): a, c, t, g, unknown or other
  misc_feature (449)..(449): n is a, c, g, or t
  modified_base (503)..(503): a, c, t, g, unknown or other
  misc_feature (503)..(503): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacaggctctgaggcctcctatgagctgacacagccaccctcggtntcagtgtccccaggacagacggccaggatcacctgctctgcagatggactgaccaaaagaaatatgacttaattggtaccaaacagaagccaggccaggccccctgtgttagtgatataataaagacactgagacggcctcagagatccctgagcgattctactggctccagctacagggacancagtcacgttgaactatacagtgaagtcagcagaggacaggctagactattactgtacaaacagtaagactaaggtagagtaactnagttagggtgttacgggcggaaggacgaaggcgtcggacccttacgtaggtacncggtacccgaaggccgtaccgccccttaccgg

SEQ ID NO: 112502 - DNA, 553 bp, Homo sapiens
  misc_feature: GYAE6OF02FP3HY.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggccttcctatgagctgacacagccaccctcggtctcagtgtccccgggacaaacggccaggatcacctgctctggagatgcattgaccaaaaaattnttgtttttgaccagcagaagtcaggccaggcccctgtgttggtcatccatgaggacaggagacgaccctccgggactccccgtgagagtattctctggctccaactcgagggacggtggccacgttgattctcagtcgggcccagggtggaggagtgaagcgtgactactactgttactcagcagacagctagtcgtcagtcgaggggctagttcggcggacgggacaggttcgaccgtccgtaggtcgacggcccgaaggccgtcgccccgtacggtcaccgttcgtcgttcccctaccctccctcccg

SEQ ID NO: 112503 - DNA, 548 bp, Homo sapiens
  misc_feature: GYAE6OF02HNG3T.21.30.C08.1.454.CMB.1.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (416)..(416): a, c, t, g, unknown or other
  misc_feature (416)..(416): n is a, c, g, or t
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagccaccctcggtctcagtgtccccgggacaaacggccaggatcacctgctctgganatgcattgacctaaaaaattntgtttttggaccagcagaagtcaggccaggcccctgtgttggtcatccatgaggacaggagacgaccctccgggatccctgagagattctctggctccaactcagggacggtggccagttgattctcaggtcggggcccagggtggaggatgaagctgactactactgttacntagcagacagcagtcggtacagtacggaggggcaggttcgggacgggagggaccgagggttcgaccgtcgtaggtcgacgcccgaaggcctcggccccgtcggtccacgtccgtcgttccccgccttccccg

SEQ ID NO: 112504 - DNA, 677 bp, Homo sapiens
  misc_feature: GYAE6OF02JX8MY.21.30.C08.1.454.CMB.1.raw
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
tcagtcgtcgctcgcacgaccggtgctcgatttagtctgacgtcaaggaaaggggtaggggcgtcaggaggcagagctctgggaatctcaccatggcctggaccctctcctgctcccctcctcactttctgcacagtctctgaggcctcctatgagctgacacagccaccctcggtctcagtgtccccgggacaaacggccaggatcacctgctctggacatgcattgaccaaaaattntgtttttaggacagntagaagtcaggccaggcccctagtgttggctatccgatcggtaggaccgaggtacgaccgacccgttaccgggactcccgtagacgaagtacttcgtcgtaggtcctaccgaactcggacgggtacggtcggacctacggttgacttcgtcgagggtccgggccaggggtcggaggtagtacggaacgtctaggtaccgtaacttacggttacgttacgtccgaagtcctaacggtacaggtaccgtaggtacggtaacgtacgtcgggaacgggggtctacggtttcggggaccgggtaagggtacccggtagggttaaccggtacccgtacggtaccggtacgaccggtacccggaaggttcccgtcggcccccgttaggtcctacgttccgtcccgtttacccgtccctacccgtcccgg

SEQ ID NO: 112505 - DNA, 638 bp, Homo sapiens
  misc_feature: GYAE6OF02F6UC7.21.30.C08.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctgganatgcattcgaacctaaaaaatttnttgttttttacggaaccagcagaagtcaggccaggcccctgtgttggtcatccatgaggacaggacgaccgacccgtccgggactcccgtgagagtacttctcgtggcctaccaacgtcgaggggacggtcggacctacgttgattctcgaggttcggggaccctagggtggagggataggaagcgtgacttactacgttgttactcgagcagacagactagtcgtacagtcggaggggtctagttcgggacgggtacgggaccgaggttacgtacccgtaccgtacggtaccgacggtacccggaaggtcccgtacccggtccccccgttagggttccctaccgtttcccgttcccgtttaccccctaccccgtttaccccgttcccccgg

SEQ ID NO: 112506 - DNA, 584 bp, Homo sapiens
  misc_feature: GYAE6OF02JGJCZ.21.30.C08.1.454.CMB.1.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (433)..(433): a, c, t, g, unknown or other
  misc_feature (433)..(433): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaattntgtttttggaccagcagaagtcaggccagggcccctgtgttggtcatccatgaggacaggganacgaccctccgggatcccctgagagattctctggctccactnagggacgtggccagtttgatttcncgagtggggcccaggtcggaggatgaagctggactactactgttactcagcagacagccagngtcagtacgaggggctagttcggcggacgggaccgtaggtgaccggtctacgggtcgaaggcccgaaggtccgtccgtaccccccggttaggtcccgtaccgttaccgttccgttcccccgtaacccccgttcccgttcccgttaccccgg

SEQ ID NO: 112507 - DNA, 666 bp, Homo sapiens
  misc_feature: GYAE6OF02FYFM2.21.30.C08.1.454.CMB.1.raw
  modified_base (247)..(247): a, c, t, g, unknown or other
  misc_feature (247)..(247): n is a, c, g, or t
  modified_base (466)..(466): a, c, t, g, unknown or other
  misc_feature (466)..(466): n is a, c, g, or t
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagccaccctcggtctcagtcgtccccgggacaaacggccaggatcacctgctctggagatgcattcgaacctaaaaaatttnttaggttttttacggaccagccaaggaagtcaggccacggtcccctgtgttggtcatccatggaggacagggagaccgacccgtccgggactcccgtagagtagtacttctcgtcggcctccgaactcgagggacggtcgccgtacgttgacttcgacgtacggtcggggacccgagggtggacggagtaggaacgtcgtagactactacgtgttaccncgacgtacgagacgagacgaggtcgtacacgtacgaggggtctaggtcgggacgggaacgggtaccgtagggttccggtaccgttacgtacgggtaccgtaacggacccggtaacgggtccccgtaccggtaccccccggttacggtacccgtaacccgttcccggtttcccggttccccccgtacccccgtttcccccg

SEQ ID NO: 112508 - DNA, 615 bp, Homo sapiens
  misc_feature: GYAE6OF02IGNKG.21.30.C08.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
  modified_base (434)..(434): a, c, t, g, unknown or other
  misc_feature (434)..(434): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgaggcctcctatgagctgacacagccaccctggtctcagtgccccggganaaacggccaggatcacctgctctggagatgcattgaccaaaaaattnttgttttttcggaccagcagaagtcaggcaggccctgtgttggcatccatgagacaggagacgaccctccgggattcccgngacgagtacttctctcggctccaactcgaagggcggngccacgttgactttcgctaggtcggggacccagggtcgggagataggaagcgtacgacgtactacttacgttactanacgagaagaacgacgccgaaggttgcgtaacgtcgtaagggggctaacgttcgggacgggacgggaacccgtaggttcggtaaccggtctacggtcgaacgccccgaaggccgttcccgcccccgttacggcccgttaaccgttccgtaccgttttcccccgaacccttccccttccccgg

SEQ ID NO: 112509 - DNA, 772 bp, Homo sapiens
  misc_feature: GYAE6OF02FZ88U.21.30.C08.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattcgacctaaaaaatttnttgttttttggaccagcagaagtcaggccaggcccctgtgttggtcatccatgaggacgaggagaccgacccgtccggggactccccgtggagagtactttcgtcgtcggcctaccaacgtcgaacggggacggtcggaccgtacgttgtactttccgtacgtacgggtccggggacccgtaggggtacgggaagggtacgtagggaaacggtccgttaggtaaccgttaacgttaacgttacggtttaacctcggaacgaccgtaacggaactacggaccgtaaggttcgggtaccaaggttccgggaacgggggtctaacgggtttcccggggacggggtaacgggtaacccggtagggtttaccgggaacccgttaccgggttacgggttaccgaaccgggtaccccggtaaacgggtccccgttaccccgggttcccccccggttaccgggttaccccttaacccggtttcccgttaccccgggtttaccccccctacccccgtttccccgtttccccccgg

SEQ ID NO: 112510 - DNA, 536 bp, Homo sapiens
  misc_feature: GYAE6OF02GIID4.21.30.C08.1.454.CMB.1.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
  modified_base (376)..(376): a, c, t, g, unknown or other
  misc_feature (376)..(376): n is a, c, g, or t
  modified_base (427)..(427): a, c, t, g, unknown or other
  misc_feature (427)..(427): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggganaaacggccaggatcacctgctctggagatgcattgaccaaaaaattnttgttttttggaccagcagaagtcaggccaggcccctgtgttggcatccatgaggacaggagacgaccctcgggactccctagagagattctcgtggctaccaactcgaggggacgtcggcctagttgattccngaggtcggggcccagggtggacggagtgaagtctagactactactgttacncagcaagacagcagtgtcatcggaggggcagttcggacggaggaccaggtcgacgtcgtaggcacggccgaggctccgccctacggcacgtctcgtccccactcctccg

SEQ ID NO: 112511 - DNA, 789 bp, Homo sapiens
  misc_feature: GYAE6OF02IR5UW.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggaccctctcctgctcccctcctcactttctgcacagtctctgaggcctcctatgagctgacacagccaccctcggtctcagtgtcccgggacaaacggccaggatcacctgctctggagatgactattagacctaaaaaattacttggttttttacggaacctagcgagtaaagtcgaaggccacggcccctgtgttcggtctactccagtgaggtaacgaggagaccgaccgtccgggaacttcccctagacgtagactttcgtcgtcggcctacctaaactcgaacggggtacgggtcggaccgtaggttgaacgtttcgtacgtagggttccgggggacccgaggggtaggtacggggtaagtacgggaaacggtccgttacggaacgttaaccgttacgttaaccggtttaccgttacgaacggtcctaaacgggacgttacggactaacgggttagggaccgtaggtaacccgggtacggggggtagttaacccgggtttacggggacccgggggttaacgggtaacccgggtaaaggttcccgggtaaccgggttacccggtacgggttaccgtaaccgggaccgtaaccggtccgttccccggtacccccgggtaccggttacccggtaacctttcccggttacccggttacccccgttaaccccgtccccgttaacccggg

SEQ ID NO: 112512 - DNA, 744 bp, Homo sapiens
  misc_feature: GYAE6OF02H357Q.21.30.C08.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (531)..(531): a, c, t, g, unknown or other
  misc_feature (531)..(531): n is a, c, g, or t
tcagtcgtcgctcgcacgaccggtgctcgatttagtctgacgtcaaagggaaagggggtgggatcaggaggcagagctctgggaatctcaccatggcctggacccctctcctgctccccctcctcactttctgcacagtctctgaggcctcctatgagctgacacagccaccctggtctcagtcgtccccggganaaacggccaggactcacctgcttctgganatgcattcgaacctaaaaaattnttgtttttaggaccagcagaagtcacggtcacggccctgtcgttggtcatccatgacggacaggagtaaccgacccgtccggggtaactccccgtagagacgtattcgctacgggcctacctaaacgtccggaaggggaccggtggacccgtaaggtttcggaactttccgtacgacgggttccgggacccggtaggggtttcgggaacgggtagtagggaacggtacgtgtaacttaacgtacttacgttacctcgacgtacaacggtacaggaccgttaggnggttctaacggtcggacggggggtacctacggggttaccgggaccgggtacggggtaaccggtacgggttacggtaaccccggttccgttacggggtccaacccgggtacccgtaacgggacccgttccccggacccccgtttcccgggaacccttcccggttaccccgtttcccggtttaccccccggtaccccgtttcccggtaccccggg

SEQ ID NO: 112513 - DNA, 848 bp, Homo sapiens
  misc_feature: GYAE6OF02GNF2M.21.30.C08.1.454.CMB.1.raw
  modified_base (602)..(602): a, c, t, g, unknown or other
  misc_feature (602)..(602): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtcccggtacaaccggccaggatcacctgctcgtggagatgctattacgaacctaaaaaatttgtttggtttttttacggaacctagtacgtaaggtaacgttaccgacgggcccaacgggtcccccttggttcggtttcgggtacctaacgttcccgaagttcggaacgggtaacgaacggggaacgtaacccggtaacccccggttacccggggtacgttcccccgtaggtaaccggtagttacttttacccgtcgttacgggaccttacccgaaaccgtcggaacggggtaccgggttccggaccttacggtttacgtactttccgtaccggtagggttccgggggacccgtagggtgggaacggtagtacggaagtccgtacgaaccgttacttacgttacgttacctacganacgtaacgacctaggtacgtagggtcggttaaccgaggttaccggggacggggtactacggggttcccggggaacggggaccgggttaaccgtacggggtttaccgaccgggttaccgttacggaccggtacccggaaccccgttaacggggcccgttaacccgggttaccccccgttacggtacccgttaccccgtttaccggtcccccgtttacccccgtaacccccgttcccggtaacccggg

SEQ ID NO: 112514 - DNA, 706 bp, Homo sapiens
  misc_feature: GYAE6OF02IH6R0.21.30.C08.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagtctgacgtcaaagggaaagggggtgggctcaggaggcagaactctgggtgtctcaccatggcctggatccctctacttctccccctcctcactctctgcacaggctctgaggcctcctatgagctgacacagccaccctcggtgtcagtcgtccccaggacagaccggccaggatcacctgctctgcagatggactgaccaaaagaatatgtacttaattacggtaaccaaacaagaacgaccgaggccgaggcccctgtagttagtagataattaataaaggtaacacgtagacgacggaccccttnaacgacgtactcccgtggaacgcggtatttctcgtcggccttccgaagcctagagggaaccaggacagtactacggttacgaacttatacgagttagaacgtcgaacggacgaggaacgggtaacggacggacgttacggaacttaacgttaaccgtacgtaacgaaaacgtacggtaaacgtaacgtaacggaaaggttaaccggttaactaccggttaaggtttacgggggttacgttaccgggggaccgggaacggggtaacccgtaaaggtccggttaaccggtaaccccggttaccgtaagggttacccaaccggtaccccggtaaacgggcccttccccggaacccccggttcccgg

SEQ ID NO: 112515 - DNA, 862 bp, Homo sapiens
  misc_feature: GYAE6OF02JXU3O.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgacggcctcctatgagctgacacacgccaccctcggtctcagtcgtcccgggacaacggccaggatcacctgctcgtggagatgctattacgaacctaaaaaattgtttaggttttttacgggaaccctaggtaccgtaaggtaacgttcgaacgggtacccaacgggtcccccgttaggttcggttacggttaccgtaatccccgtagttagggaacgggaccgaagggaaccgaaccggtaacccccggtaccggggaaccttccccgtaggaacggtaggtaaccgtttccgttacgtccgggtacctacccgtaaaccgttaccggaagggggtaccgggtcgtacccggttaaccggttagtacgtttccgtaccggacggggttacccggggacccgtagggggtacgggaacgggtagtaacggaaacggtcgtaacggtaccttaaccggttaacgttacgtttaaccgtcgtacggtaccgaagaacccggtcgaaggtacgtttaggaccgtacgggttaccggagggggtactaggtcccggggaacgggtacgggtacccggtacgggttaaccgaccgggttacccgtagggtacccgtaacggtaccccggtaacggttccgtaccccggtaacccggtttcccgggtcctacccggttacccggttccggtttaaccccccctccggttacccctttaccccgg

SEQ ID NO: 112516 - DNA, 710 bp, Homo sapiens
  misc_feature: GYAE6OF02IRPUQ.21.30.C08.1.454.CMB.1.raw
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtcgtccccgggacaaacggccaggatcacctgctcgtggagatgcattcgaacctaaaaaattcgttgttttttaggaaccaggacaagaagtcaggccaaggccctggtgttcggtacagtaccagtcgtaaggaccgaggacgtaccgacctccgggactcccgtagacgtagacttcgtctacggtctaccgaacgttcgacggggtaccgtcggccgtacgtttggactttcgacgtaacgggtcggggtcccaaggggttcgggaaggaacgtacggaacggtcgtaacggtacgttaacgtacgttacgtacgtacgacgtacgacgacgtagacaggtacgtacgatacgggacggggtactacggttacgggacgggtaacgggaccggtaacgggtacgtaacccggtacggtaccggtaccgacgacccggtaacggaccgtccggacccccgttcgggtaccacccggtttaccgttccggttacccccgtccccgttccgtaccccgtttcccgg

SEQ ID NO: 112517 - DNA, 678 bp, Homo sapiens
  misc_feature: GYAE6OF02JDXQT.21.30.C08.1.454.CMB.1.raw
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtctcagtcgtccccgggacaaacggccaggatcactgctctgganatgctattgaacctaaaaaattnttgtttttgaaccagcaagagtcaggccacggccctagtgttgcatccatggaggaccaggacgaccgacccgtcgggactcccgtggacgtagtacttccgtcgtcggcctaccgaacgtcggacgggacggtcggacctacgttagtcgttactcgtaggtcgggccctaggggtgaaggtagtaggacgtcgtagtaactactacgtgttacctacgagtacagtaacgagtaccgagttacggtacgtacgtacgggacggggtaccgttacgggttacgggcgggaacggtacccggtacggttccgtaaccggttccgtacgggtaccgaccggacccggacggtacccgtacccggtacccccgtggtacccttacccggttcccgtaccccggtttcccccgtaccccgttacccgtacccggg

SEQ ID NO: 112518 - DNA, 715 bp, Homo sapiens
  misc_feature: GYAE6OF02IZH1Z.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccggacaaacggccaggatcacctgctctggagatgcattgaccaaaaaattattgtttttacggaccagcaagaagtcaggccaggcccctgtgttggtcatccatgaggacaggagaccgacccgtcgggactcccgtgagacgtacttctcgtcggtcctaccaacgtcgacggggtacggtcggaccgtacggttagtacgtttccgtcgaacggggttccgggggaccccgtaggggttacgggaagggtacgtacgggaaacggtcgtacggtaaccttaacgttaccgttacggttaacctaccgtacggaccgtaacgacgtacggaccgtaagggtcggtaccgaagttccgggaacggggtacacgggtttcgggaccgggtacgggtaaccgtacgggtttaccgaccgttccggtaggttaccgaaccggtacccggtaacggcccgttccggaccccccgttacggtaccctacccgttccgttcccggttcccccgtcccttcccttccccgg

SEQ ID NO: 112519 - DNA, 727 bp, Homo sapiens
  misc_feature: GYAE6OF02GZOAC.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctccccctcctcacttttctgcacagtctctgacggcctcctatgagctgacacagcccaccctcggtgtcagtcgtcccaggacaaacggccaggactcacctgctcgtggatattcattacgaccaaaaagaattaattacgtttggttcggttccagcaaggaagtcgacggccacggtcccctggtactggtacactccagtcggacggccaggtccgaacgaccgaccgtcccgggactcccgaggagactattctctcgtccctcgacgtcctacggacgggactacgggtccgaccctacccgttggaaccttacgtcgtacggggtccgggtacccgaggggtacggaaccggtaggtacggaacgtccgtaggtaaccttaattacgtttacggttaacccgaccgaaccgaagtaacgtagggttaggttcggtaccgtaaggttcggggtaacgggggttacgttccggggaccggggaacgggttaaccgtaagggtttccgtacccggtttcgtttacgggtaccgtaccggacccggacggtccgtcccggtcccccggttacggtccctaccgtccgtttcccggtcccccgtccccg

SEQ ID NO: 112520 - DNA, 779 bp, Homo sapiens
  misc_feature: GYAE6OF02HUEWM.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggatccctctacttctcccctcctcactctctgcacaggctctgaggcctcctatgagctgacacagccaccctcggtgtcagtcgtccccagggacaggaccggccgaggactccaccgtgcctcgtgcaggagtacgactacgaaccaaagtaactacgtcgtactttagttacggtaacaaacgtagtaacgaccgaacggaccaccgggtcccttgggttaccgttaaggtcgaaacgttagttaaacgaaaccgtaaccgtacgtagaacgggtaccgtccctaaggaacgtacgtaccttcccgaggacgtaccgttacttcgtccgtggacccttacgacggtccgtaacgggaacggactaccggtacgacgtaccgttacgtacgtaacttacgtacgaacgtcgggtaaacctccggaaggcgaaacgggtacggaccgggttaacgccgttaagttaaacgtaacccgttacgtaacgtaactaaaacggtacggtagaaccgttaaggttaacggacgttaccgttaagtaagggttttaccgggggtgtaacccgggtagggtaaaccgggtaacccgtagggaccgttacccggtacccggttacgttaaccggtcccggtaaccgaccccggtaacggttaccccggttacccgtacccccgggg

SEQ ID NO: 112521 - DNA, 648 bp, Homo sapiens
  misc_feature: GYAE6OF02FLX8G.21.30.C08.1.454.CMB.1.raw
  modified_base (391)..(391): a, c, t, g, unknown or other
  misc_feature (391)..(391): n is a, c, g, or t
tcagtcgtcgctcgcacgaccggtgctcgatttagtctgacgtcaaaagggaaagggggtgggctcaggaggcagagctctgggaatctaaccatggcctggacccctctcctgctccccctcctcactttctgcacagtctctgaggcctcctatgagctgacacagccaccctcggtctcagtcgtccccgggacaaacggccaggactcacctgcctcgtggagtattcattgaccaaaagatatacttgttggttccagcagaagtcaggccaggcccctgtactggtcatcatgaggccagtcgaccgacacgtccggatccctagagagtattctcgtcgtcctcgagtcctcgagggtacaggtcggcctaccgttagactacncgtacggtccgggacccgtagggtcggacgaagtggaacgctacgtaacttacgttacgttgttaccgactaacgagtactaaggtgtggtacacgtacggtaggggttacgttcgggacgggtacgggtaccgtaaggttaccggtaccgttccggttcggaccgtaccggacccgtaacggcccgtacccggtcccccgtacggtcccgtacccgttccgttcccggttaccccctaccccttccccgttccccg

SEQ ID NO: 112522 - DNA, 655 bp, Homo sapiens
  misc_feature: GYAE6OF02HJ9QK.21.30.C08.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctctcactttctgcacagtctctgaggcctcctatgagctgacacagcccaccctcggtctcagtcgtccccgggacaaacggccaggatcacctgctctggagatgcattcgaaccaaaaaattnttagtttttaggaccagctagaagtcaggccaggcccctgtgttggtcagtccagtgagacgaggacgacgacccgtcggactcccgtagacgagtattcctcgtcggcctaccaacgtcggaacggggacggtcggaccgtacggttgtacttccgtagtagggtccggggcccgtagggtacgggaaggaacgtggaaaggtcgtacgtaaccttaacgtacgttacgttaactccgagtacgaacgacgaagtaccgaggtcgtacagtcggaaggggcctaggtcggacgggaggaccggtaggtacgaccgttacgtcggtaccaccgggccaacggtccgtccggacccccgttggtacctcccgtaccgttcccggtttaccccgcccgttacccgacccggg

SEQ ID NO: 112523 - DNA, 793 bp, Homo sapiens
  misc_feature: GYAE6OF02H19LC.21.30.C08.1.454.CMB.1.raw
tcagtcgtcgctcgcacgaccggtgctcgatttagtctgacgtcaaaggggaaagggggtgggctcaggaggcagagctctgggaatctaaccatggcctggacccctctcctgcctccccctcctcactttctgcacagtctctgcggcctcctatgagctgacacacgcccacccgtcggtcgtaccaggtccgtccccgagggacacggaccggaccgaggactccacccgtggtcctcgtacgcaggtagtcgggacctacggaaccaaaaaggtaacttagtcggtactttaacgttacgggaacccaaaacgaaggaacgcccgaacgggaccccgaacgggtcccctagggtttacgttaggtacgtaagttaactaaagtaaaacgactaacgtaggacggaaccggtcccctagaaggtacgaccgtacccgtagacgcggtacgttcctcgtcggtccacgacgcgtacggacggacacgcgacgtctagtacgaactactacgtagtacgtaacgtacggacggacgaacggaacgggacggacggtacgtacgtaacgtaacgttacgtacgtaacgtaaacgtaacgtaagtaacgtaacggtaacggtaacggtaaccgttacgttacgggttagggttacgggttacgggtacggggtaccgggtaacggtaaccggtacggttaccggtaccggtaaccggttaacggtaccggtaccggacccggtttttttttttaaccggacccggttacccggtccccggttaccggtacccg

SEQ ID NO: 112524 - DNA, 713 bp, Homo sapiens
  misc_feature: GYAE6OF02IBAKL.21.30.C08.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
  modified_base (356)..(356): a, c, t, g, unknown or other
  misc_feature (356)..(356): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccggganaaaccggccaggatcacctgcctctgganatgcattacgaccaaaaaatttnttgtttttacggaccagctagaacgttcaggcctacggcccctgttcgttggtccatccagtacgaggacgaggacgaccgacccgtcgggtactcccgtagacgtanactttcgtctcggctaccaacgtcggaagggacgggtcgaccgtagttcgtacttccgtagacggtcgggaccctagggtcggaggtacgtaggaacggtactacggtaacttaccgtacgttcgttacctacgacgtacaacgtacgtacgcgtacggtacgtaccgtacgtcgggtaaggggtacgtacggtttcggggaaccgggacgggtaccgtacgggttacggtaacccggttacggtacgggttacccggacggtaccccggtaacggtcccgttacccggtccccggttaacggttcccgtaccgttccgttccccgttaccccgttaccccgttccctttaccccgg

SEQ ID NO: 112525 - DNA, 734 bp, Homo sapiens
  misc_feature: GYAE6OF02HEAM0.21.30.C08.1.454.CMB.1.raw
  modified_base (252)..(252): a, c, t, g, unknown or other
  misc_feature (252)..(252): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctcctcactttctgcacagtctctgaggcctcctatgagctgacacagccaccctcggtctcagtcgtccccggacaaacggccaggactcacctgctcgtggagatgactattacgaaacctaaaaaaatttntttaggttttttacggaacctaggtacgaacgtaacgtacgacggacccgacggtccccttaggttacgttcggtactacgttaccgtaagttaggaacggtaacgaagggaacgacccggtaccccgtaccgggtaactcccgtaggacgacggtaacttcgtcgttacggcctaacctaacgtacggacgggtacgggtcgacgtacgttcgtattcgtacgtacgggttcgggacccggtagggtcggaagtcgtaggaacgtcgtaacggaacttactacgttagttacctacgagtacgaacgacgacgtcgtaagttcggacgtacgttacgggaaggggtcttaacggttccggggacgggtacggaccggttacggtacggtacccgtaccggtaggtaccgacggtacccgaaggtccctccgggtcccctacgtccaccgttccgttaccccgttcccgtccctccgtcccg

SEQ ID NO: 112526 - DNA, 678 bp, Homo sapiens
  misc_feature: GYAE6OF02GV87U.21.30.C08.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccggganaaacggccaggatcacctgctctgganatgcattgacctaaaaattnttgtttttacggaccagcagaagtcaggccacggcccctgtgttggtcatccatgaggacaggacgaccgacccgtccgggactccccgtagacgagtactttcgtcgtcggacctaccaacgtccgaaggggtccggtcggacctacgttgactttcgtcgtaggtcgggcccgtagggtagggacggagtacggaacgtcgtacgtaaccttacgttacgttacgttactcgacgtacgacgaacgacgacgtaggttcggtactacgtcgggacgggggtacctagggttccgggacgggaaccgggtaccgtacgggttaccggacccgttaccgtacggtaccgacggtaacccggacggtccgtacccgtcccccggttggtacccgtacgttcccttacccggtccccttaccccgtcccgttccccg

SEQ ID NO: 112527 - DNA, 735 bp, Homo sapiens
  misc_feature: GYAE6OF02H09LD.21.30.C08.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggactcacctgctctgganatgcattcgaacctaaaaaattnttgtttttgaccagcaagtaagtcaggccacggtcccctggttgttcggtcatccatggaacggacgaaggacggaccggacccgtccgggactccccgaggacgagtactttcgcgtcggacctaccgaactcgacggggtacggtcgaccgtacgttgtactcgtcgagggtcgggcccgtagggtgggacgtagtacggaaggtccttaggaccttaacttacgtttacgtactacgacgtacaacgtaacgacgtccgtaaggttacggacctaaggtaccggggtaacggggtacttaacggggttcccggggaaggggtaaccgggtaaccggttacgggttacccggtaacccggttacgggtaccggttacgaacccggacccggtaaccggtcccgttaccccggtcccccgttcgggtacccttacccggttcccgttacccggtttacccccccgttccccgtacccgtttccccgg

SEQ ID NO: 112528 - DNA, 667 bp, Homo sapiens
  misc_feature: GYAE6OF02HWKR1.21.30.C08.1.454.CMB.1.raw
  modified_base (245)..(245): a, c, t, g, unknown or other
  misc_feature (245)..(245): n is a, c, g, or t
  modified_base (338)..(338): a, c, t, g, unknown or other
  misc_feature (338)..(338): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccctgggacaaacggccaggatcacctgctctggagatgcattgaacctaaaaaatttnttgtttttaggaccagcagaagtcaggccaggccctgtgttggtcatccatgagacaggagacgacctccggatccccgtgaagagattcctntcggctaccactcgagggacgtggccaggttcgattcctcgaggttcggggcccagggtcgggaggtagtaggaagtcgtaggtacttaaccgtacgttcgtttaactcgaacgtcaaggacgagtcgtagtacgggtacagtacggacgggggtactacggttccgggacgggtaacgggaccgtacgggttacgacccggttaccgtagggtacccgaacgggtacccccggtaaagggtcccgttacccgggtccccccggttaccgggttacccgttaacccgttcccggtttacccggttcccccgtaaccccgtttcccccgg

SEQ ID NO: 112529 - DNA, 649 bp, Homo sapiens
  misc_feature: GYAE6OF02GF30L.21.30.C08.1.454.CMB.1.raw
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgagtcctcctatgagctgacacagccaccctcggtctcagtcgtccccgggacaaacggccaggatcacctgctctggagatgcattagaacctaaaaaattcttagttttttagaacctagcagaagtcagccacggccctgtgttgcatcatgaggacaggagaccgacccgtccgggactccgtgagagacttctgtcgcctaccactcgaggacagtcggacctactgactatacgaggtcgggaccctagggtacgaacgtagtacggaagcgtagtaacttactaagttacgtacgtaccaacgaacgaacgtacgttagtcgtacgtagtacgggtaggggttagttacgggacgggtaccgggtaacgtaaggttacgtaccgttccgttacggtactaccggaccgaacggtccgttcccggcccccgttacggtaccctacccttacgttcccgttacccccgtacccgttccctacccgttaccgtccttacccg

SEQ ID NO: 112530 - DNA, 656 bp, Homo sapiens
  misc_feature: GYAE6OF02F2KAS.21.30.C08.1.454.CMB.1.raw
  modified_base (243)..(243): a, c, t, g, unknown or other
  misc_feature (243)..(243): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgacctaaaaaattnttgtttttggaccagcagaagtcaggccaggcccctgtgttggtcatccatgagccagtcgacgacacgtccgggatcccngagagattcnctgcctccagctcgagggacaggtcggaccctacgttgacttagtacgagggttcggggcccgtagggtcggaacgtagtggaaagtctaggaaccttaacttagttacgttaaccgacaccgtaacgaacgtagtagttacgggtactagtaccggtagggggtttacttcgggacgggtacgggtaacctagggttacgtacccggttccgttaggtaccgaccggtaacccgtaacgggtccttaccggtaccccccgtcgggttaccctaaccgtttcccgtccggtttacccccctacccgttccccgtttaccccg

SEQ ID NO: 112531 - DNA, 918 bp, Homo sapiens
  misc_feature: GYAE6OF02FL6S3.21.30.C08.1.454.CMB.1.raw
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
tcagtcgtcgctcgcacgaccggtgctcgatttagtctgacgtcaaagggaaagggggtgggctcaggaggcagagctctgggaatctcaccatggccctggacccctctcctgctccccctcctcactttctgcacagtctctgaggcctcctatgagctgacacagcccaccctcggtctcagtcgtccccgggacaaacggccaggatcacctgctntgganatgctattgacctaaaaaatttattgttttttacggaaccagcagaagtcaggcctaggcccctgtgttggtcatccatggagacgaggagaccgcccgtaccggactcccgtagagaggtaatttccgtacgtcggtcctacccgaaaccgttccgaacggggggtaccggtcgggtaccccgtaacggtttacggtaacttttccgttaccgggtaacggggttccgggggggtacccccgtaaggggggtacggggtaaaggggtaggttaacgggaaaggttccgtaacggtaacgtttaaccgtttaagtttaccggtttaccgaccgtaaccccgtaaggtaaccgtacggttaacgggttacgggttacctaacggtaccgggttaaggggggggtttaacggttcccgggggaaccggggttaaaccgggggttaaaccccggttaaacgggttttaaccggggtaacccccgttttaccgggttttaaccgggttacccggtaacccgggtacccccgtaaacgggttcccggttaccccccggggtccccccccggtttaaccgggggttacccccttaacccggttttaccccggtttacccggtttacccccccccgggttaccccgtttaccccccgtttacccccggttttaccggtttcccccgttttaaaccccggg

SEQ ID NO: 112532 - DNA, 765 bp, Homo sapiens
  misc_feature: GYAE6OF02IVT7Y.21.30.C08.1.454.CMB.1.raw
tcagtcgtcgctcgcacgaccggtgctcgatttagtctgacgtcaaagggaaagggggtgggctcaggaggcagagctctgggaatctcaccatggcctcggacccctctcctgcctccccctcctctactttctgcacagtctctgacggcctcctatgagctgacacacgcccacccgtcggtctcgacggtcggtccccgggaacaaaccggccaggactccacctcgctcgtggagctcgactatacgaacctaaaaaatttgtttggtttttaggaaccagtacgaagtaacgtcgacggaccgacggtcccttggtggttggtcactcagtgagagaacggacgaccgacccgtcgggtactccgtaggacgtacgtcttacgtcgtgcctacgaacgtcggaacgggcgggtcggacgtacggttacgtacttccgtcggtacgggggtaccggggaccggtaggggtacgggtaagggtaggtaacggtaacggtacgtaacggtaacgttaacgttaccgttacgttacgtacgtacgacgaacgaacgtacgacgtacgtcggtacgtacgtacgggacgggtacggtacggtacgggacgggtacgggtaccggtaacgggtaccggtaccggttaccggttaccggtacggtaaccggtaccggtaaccggaccgtaccggcccgttttttttttttttttaccggaccgttaccgttaccgttcccgttacccgtacccgttaccgtacccg

SEQ ID NO: 112533 - DNA, 704 bp, Homo sapiens
  misc_feature: GYAE6OF02F35O0.21.30.C08.1.454.CMB.1.raw
  modified_base (196)..(196): a, c, t, g, unknown or other
  misc_feature (196)..(196): n is a, c, g, or t
  modified_base (246)..(246): a, c, t, g, unknown or other
  misc_feature (246)..(246): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtcgtccccggganaaacggccaggatcacctgctctggagatgcattcgaacctaaaaaattnttagttttttaggaccagcagaagtcaggccaggcccctgtgttgtcatccatgaggacaggagacgaccccgtccgggatcccgtgagacgtattctctggctccaactcgagggacggtggaccgtacgttagacgtttctcgtaggtcggggcccaaggggttcgggaaggtagttacggaaacgtcgtaggtaaccttacgttacgttacgtttactacgtaacggtacgaacgtaacgaggtacgtagggttcgggtacctagttaccgggcgggggtaacctggtttacccggggaacgggtaacggggtacccgtaaggggtttaccggaaccggttacccgtaggggttacccaacggtacccggaacggtccggtccccggtccccgttccggttactacccgttacgtttcccgttaccccggtccccttcccgtcccgtttacccgg

SEQ ID NO: 112534 - DNA, 719 bp, Homo sapiens
  misc_feature: GYAE6OF02JKLVE.21.30.C08.1.454.CMB.1.raw
  modified_base (251)..(251): a, c, t, g, unknown or other
  misc_feature (251)..(251): n is a, c, g, or t
  modified_base (557)..(557): a, c, t, g, unknown or other
  misc_feature (557)..(557): n is a, c, g, or t
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgaggcctcctatgagctgacacagccaccctcggtctcagtcggtcccgggacaaacggccaggactcacctgctcgtaggagatgctattcgaacctaaaaaatttnttggtttttacggtaccaagactaaggtaacgtccgacggacccgacggtccccctggttcgttacggtctactaccgtagtacggaggacgacgggacgaccggacccggtaccggacctcccgtaggacggtacgttacttccgtcgtcggtacctacccgtaacgtacggacggggtaccggtggtacccggtacgttcggtacttccgacggtacgggtccggggtaccgtagggacggacggtagtacggacgtcgtaacggtacctacgtacgttacttacgcgtacgcgtacacgacgngtagtcggtactagtcggacgggtcctagggtaccgggagggtacgggtacgtaacgggttccgacccgttcggtaacggtaccgaaccggaccgtaaggcccttacccgacccggttcggtaccttacccggtccgttccgtaccccgtcccttaccccgg

SEQ ID NO: 112535 - DNA, 895 bp, Homo sapiens
  misc_feature: GYAE6OF02IKXAW.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggaccctctcctgctccccctcctcactttctgcacagtcctcgtggaccgtcccttactagtaggactcgtacgacacgccgacccctacccggttccggttcctacgtacggttcccggggtaccccggaaaccgaaaccggccgtaaggtacctaccgtacgtccgtcttacggtaggacgtacgtcgtacttacgttaactaaaaaccttaaaattttcgtttttcgggttttacgacctaacgtaacgtaagtacgtacgtaccggaccggtaccccggttcccgttggtttacggttaccgtactaaccgtacgtacggttacgggaacggtaccggaacgggtaccgtaccccggacccgggttaccggtaccttaccggaggtacgttaacgttcctttccggtaccgttccggtacctaccgtaaccggtaccggggaagggttcccggtaccggtaccgtttacggtttacgtaccgtttaccggtacggggtaaccggggtccggggtaaccgttagggggtacgtaacggtagtaacggtaaaccgttcggtaacgtttaaaccgttttacgttaacgtttcccggttaacgtacgtaacgacggttaaccgacgtaacggtacggtacgttacggtacgtacgggtacgggtaccgggtacgttaacggggtaccgggtacgggtaaccgtcggttacggtacccgtccgtaacggtcgaccgacggtaccgcgtccgtccctcccgtagtccctcgtccgtcccgtcctccggttccctacg

SEQ ID NO: 112536 - DNA, 832 bp, Homo sapiens
  misc_feature: GYAE6OF02FFYZI.21.30.C08.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagtctgacgtcaaagggaagggggtgggtccaggaggcagaactctgggtgtctcaccatggcctggatccctctacttctccccctctcactctctgcacaggctctgaggcctcctatgagctgacacagcccacctggtgtcagtgtcccccaggacagacggccaggactcacctgctctgcagntggactgaccaaaagtaaatacgtgtacttaagttacggtaaccaaacgtagaaacggcccaaggacccgaacggtccccccttaggttagtttacgtgtagttaactaacgttaaaagacctaacgttagaacggtacgggtacccccttacgacggtaagtaacgttacccccgttaggaacggtccgttaacgtttcccgttacgtcgggtccttacccgaaggtcccgttaccggaagggaacctaacggaccgtaacggtccgtaaccgggtttcgaacttaacgttacgtaaacggttagtaaaccggtacccggtaacggccgtaacgggtaaaccgggtaacgggacgggtaccgttaggaaacccgttttagttaaacccgttcggtaaaacgtaaaaccgaacgggtttaacaacggtaacggttaaacgggttaacggttaccgttaacgtacggttttaggggggttccgttaccgggggaacgggtacgggaaccctaagggttacccgtaacggtaaccccgttaccgggtagttacccggacggacccccgtaagggttcccgtacccccggttccccgtaccgggttaaccccg

SEQ ID NO: 112537 - DNA, 726 bp, Homo sapiens
  misc_feature: GYAE6OF02HI4XZ.21.30.C08.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (475)..(475): a, c, t, g, unknown or other
  misc_feature (475)..(475): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctctcactttctgcacagtctctgaggcctcctatgagctgacacagccacccgtcggtctcagtcgtaccccggganaaaccggccaaggatccaccgtgctcgtggagatgcagttacgaacctaaaaaattntttgtttttacggaccagcaagaacgtcacggccacggcccctggtgttcggtcactccagtgaaggacagggagaccggacccgtccgggacttcccgtagacgaggtactttaccgtcgtacggtcctaccgaaacgtacggaacggggtcgggtccggaccgtacggtttcgtaactttcgtcgtacggttccgggggacccgtaggggtgggtaaaggngttagggaacgtcggttacgaaccgttaacttaccgttacggttaacctaccgtacggtacgaacgaacgttacggacgtaggttcggactaacgtcgggaacgggggcttagggtccgggaacgggtacgggtacggtaacgggtcgtacccggtcggttacggtccgtaccggtaccgacggtccctacccgggtaccccgttcgtaccgtccggttcgttcccggtacccctcccgttaccgttcccg

SEQ ID NO: 112538 - DNA, 813 bp, Homo sapiens
  misc_feature: GYAE6OF02GRVK6.21.30.C08.1.454.CMB.1.raw
  modified_base (196)..(196): a, c, t, g, unknown or other
  misc_feature (196)..(196): n is a, c, g, or t
  modified_base (249)..(249): a, c, t, g, unknown or other
  misc_feature (249)..(249): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtcgtccccggganaaccggccaggactcacctgctcgtggagatgctattcgaacctaaaaaattnttgtttttacggaccagcagtaagtcaaggccgacggtccccctaggttcgttcggtcgacttcccgaatcggaaggtaccaagggaacgaccggtaaccccgtccgggaacttccccggtaggacgtaacgtactttccgtacgttcggtcctaacccgtaacgttaccggaacgggggtaccgggtacggtcccgttaacggttacggttactttaccgtaccggtacggggttacccgggggaccccgtaagggggttacgggaacggggtacgttaagggaacggtaccgttacgtaaccgtttaaacgttaccgttacgtttaaccttacgacggtaaccgaacggtaaccgtacggaaccggttagggttacggtacgtacggtaccggggacgggggttactacggggttacgggacggggaaccgggtacggtacggttaccgacccggttacggtacgtcgaccggtaacccgtagggtaccctcccggtaccccgtcggtacccgttaccggttcccgttaccccggtccccgttccccttacccgttccccgg

SEQ ID NO: 112539 - DNA, 753 bp, Homo sapiens
  misc_feature: GYAE6OF02GNA4X.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacacgccacctcggtctcagtcgtcccggacaacggccagatcacctgctctggagatgcattacgaacctaaaaaattgtttcgtttttacggtaaccagtacaaggtaacgtacgacggaccgaacggtcccccgttaggttcggtttcggtacctacgttccgtaagtggaacggaacgtaaggacgaccggacccgtccggactccgtgagacgtattccgtacgtcggcctaccgaacctggaacggggtacggtcggaccgttacgttagtacttcgtacgtagggtccggggtacccgagggtttacggaagggtacgtacggtaaggtaccgtacgtaacgttaccgttacttacgggttacttacgacgtagtaaacgacgtacgcgtaagtcggtactacgggttacggaggggtaccgtacggttcgggaccgggtaagggtaacccggtggttaccggtaccgttaccgtcgggtaccgaccgggaacccgtacggccccgttaaccggtccccggtaccgtaccgttaccggttacccgttccccggtacccccgtcccctttaccgttacccccgg

SEQ ID NO: 112540 - DNA, 783 bp, Homo sapiens
  misc_feature: GYAE6OF02IR101.21.30.C08.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgagcctcctatgagctgacacagccaccctcggtctcagtgtccccgggacaaacggccaggatcacctgctctggagatgcattcgaacctaaaaattnttgtttttggaccagcagagtcagccaggcccctgtgttggtcatccatgaggacaggtacgaccgacccgtccgggactcccgtagacgatacttctcgtcggtacctaccgtaaccgtcggacggggtaccggtcggtcccgtaacggtttgtactttaccgtacggtaacgggtcgggggacccgtaggggttcgggaaggtacgtaggtaacggtaccgttacggtaaccgttaacccgttacgtttacgtttaaccgtacggaacgtaccgaacggtaacgacgggtcgtagggttacgtaccgtaaggtaccggggacgggggtaccttaacgggtttacccgggggaccggggtaacgggtaaccgggttacgggttacccggtacccggttaccggttaaccgggttccgaaccggtaccccggtaacgggtcccggttcccccggtaccccccggttacggttaccccgttaccgttcccgtttccccggttacccccctaccccgtttccccgttccccgtttaccccgg

SEQ ID NO: 112541 - DNA, 817 bp, Homo sapiens
  misc_feature: GYAE6OF02FT9NI.21.30.C08.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagtctgacgtcaaagggaaagggggtgggcgtcaggaggcagagctctgggaatctcaccatggcctgggacacctctcctgctcccctcctcactttctgcacagtctctgaggcctctatgagctgacacagtccaccctcggtctccagtgtcccggganaaaccggccaggatcaacctgctctggacgagttgcaacttgacctaaaaaagttgttagttttttaggaccaagtaccgaagaaacgttcgacgggtaccaggtacccccgttaggttcggttacgggttcctacggttacccctagttacggacgggtaactaacgggaaggtaacccggaccccggttacccgggaacgttccccgtacggaagtaacgtacgtttaccgtcgttcgggtacctacccgtaacgtaccgtacggggtacgggttacggcccgtaacgtttcggacgtttacctaccggtaacggtacgggggaccccgtagggtacggggtaacgggacgtttacggaaacgggtaccgtagggtaaaccgtttaccgttaacgttaaccggtttaaccgtacccaggttaaccgtacggaacgtacggtacggtacgtaacgggtactacgtacggtagggggtactacgggttaccgggacgggtaccgggtaccgtagggttaccgtaaccgtccggtaaggttaccggacgtcccggtaacggccgtacccgaccgttcggtactacccgttagttaccccggttccccggtcccgttaccccg

SEQ ID NO: 112542 - DNA, 634 bp, Homo sapiens
  misc_feature: GYAE6OF02GRH2Q.21.30.C08.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctgaggcctcctatgagctgacacagccaccctcggtctcagtcgtccccgggacaaacggccaggatcacctgctctggagatgcattgaaccaaaaaattnttgtttttaggaccagcagaagtcagccaggcccctgtgttggtcatccatgaggacaggagacgacccgtccgggactccccgtaggacgagacttctacgtggacctccaacttcgaggggaccggtcggcctacgttcgtatttctacgaggttcggggacccgtagggtgggaggtagtaggaacgcgtagtactacgtacgttagtttactacgtaagtccaagaccagcgtaggtgtcaggtcgaggggcttacggtcggcgggagggaccacggttcggaacccggtcgtagggtccgacgtcccggaaggtccgtacccgaccccggttcggtaccgtacgttccgttcccgttaccccctaccccttccgtcccttcccgg

SEQ ID NO: 112543 - DNA, 721 bp, Homo sapiens
  misc_feature: GYAE6OF02HZBWV.21.30.C08.1.454.CMB.1.raw
  modified_base (514)..(514): a, c, t, g, unknown or other
  misc_feature (514)..(514): n is a, c, g, or t
tcagtcgtcgctcgcacgaccggtgctcgatttagtctgacgtcaaaagggaaagggggtgggctcaggaggcagagctctgggaatctaaccatggcctggacccctctcctgcctccccctcctcactttctgcacagtctctgaggcctcctatgagctgacacacgcccaccctcggtctcaggtccgtccccgggaacaaacggcaggactcactgctcgtggagatgctattcgaaacctaaaaaaatttgtttgtttttacggaccagacaagtaagtacgacggccacggccccttaggtggttgtcactccatggaggaacgaggagaccggaccccgtccgggactccccgaggagagtacttccgtcgtcggacctaccaactcggaggggtacggtcgaccgtacggttacgtactttcgtacgtacgggtccgggggtacccgaggggtgggaacggagtacggaacgtcgtacgtaacttaaccgtagttcgtttaacgngaacgcgaaacgtacgagccgtaggtacgtgtacgtcgggagggctacggttcggggacgggacgggacggttacgggtacgtacccggttacgaggtaccgacggacccgtaaggtcccgtccccggtacccccggttacggcccgttacgttccccggtttacccgttacccccccgtacccttttccccgtccctttaccccgg

SEQ ID NO: 112544 - DNA, 765 bp, Homo sapiens
  misc_feature: GYAE6OF02GS70Q.21.30.C08.1.454.CMB.1.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctcctcactttctgcacagtctctgagacctcctatgagctgacacagcccacccgtcggtctcagtcgtccccgggacaaacggccaggatcaccgtgctcngganatgctatacgaacctaaaaattnttggtttttacggacagacaagaagtcgagccgacggccctggttagtcggtacagtccagtcggaggaacgtacggacggaccgacccgtccgggaacttcccgagagacgtacttcgtcgtggcctacaacgtgacggggtaggtccggtcgtacgttacgtagttaccgtacggtacggtacggggcccgtagggtaggaacggtaggtaggtaacggtcgtcgtaacgttaccgttagtaccgggttactaccggtacgacggtaacgtaccgacgggttaccgacgggtttagaaccgttacggttaaccggggaacggggtaccgtttcgggttaacccggggacggggtaaccggttaaccggttacgggtaccggtaacccgggttaccgggttaggttacccggaacggaccccggttaacggacccgttacccgggtacccccggtacgggtttacctaacccggtttcccgttaccgtcccccggttacccgtaccccgtttcccgg

SEQ ID NO: 112545 - DNA, 956 bp, Homo sapiens
  misc_feature: GYAE6OF02JQN8Q.21.30.C08.1.454.CMB.1.raw
  modified_base (228)..(228): a, c, t, g, unknown or other
  misc_feature (228)..(228): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctcctcactttctgcacagtctctgacggcctcctatgagctgacacacgccaccctcggtctcagtcgtcccgggaacaaacggccaggactacactcgctcgtggaagntgacattacgaacctaaaaattgttgtttttacggaccagtactagaacgtcgtacggaccacggtcccctaggtcgttcggtacaacttcgaagttcgaacggtacgagacggtaccgacccggtaccggtactccgaggtaggacgtattccgtcgtacggtctacccgaaacgtccggaacggggtacgggtcgaccgtagttcgtaccttacgtacgtacggtacgggtacccgtaggggtacgtaaggtacgtacggtaacgtcgtacgtacgtaccgttacgttacgttacgtaaccgtacggtaacggtaacgtacgtaacggtacggtaacggttacggtaccggttaaacggaccgggggtaacgggtacggttaaccggggttacccgggggtaaacccggggtaaacccggggttaaaccgggtaacgggtttaacccggggttttaaccccgggttttaccccgggggttttaaacccggggtttaaccccggggttaaaacccccggggttaaccccgggggtttaaaaaccccggggtttcccccgggggttttaacccccgggttaacccccccggggtttttacccggggttaacccccggggttttaaccccggttttaaacccccggggttttacccccccgggtttttaaccccccccgggtttaaaccccccggttttacccccccgggtttttaaccccccccgggg

SEQ ID NO: 112546 - DNA, 666 bp, Homo sapiens
  misc_feature: GYAE6OF02HOV7L.21.30.C08.1.454.CMB.1.raw
tcagtcgtcgctcgcacgaccggtgctcgatttagtctgacgtcaaagggaaaggggtgggctcaggaggcagagctctgggaatctcaccatggcctggacccctctcctgctccccctcctcactttctgcacagtctctgaggcctcctatgagctgacacagccaccctcggtctcagtcgtccccgggacaaacggccaggatcacctgctctggagatgcattacgaaccctaaaaaaaatttgtttggtttttttacggtaacccagacaagaaagttcacggccacggccccctggtgtttggtcatcctagtgaggacgaggagaccggacccgtccgggactccccgtggacgagtattcctcgtcggtcctaccaacgtcgacgggtacggtcggaccgtacgttgtacttctcgtaggtcggggcccaggggtggaggatggaagctagactactactcgttactcagcaacgacacgcaggtcgacagtcggacggggtcacggttcgggacggtaacggggaccgtacgggtaccgtaccgggttacgtacggtccgaaccggtcccggaaacggtccgtacccggtcccccgtccggttacctacccttccggttacccgtttcccccggtccccttccccgtttaccccg

SEQ ID NO: 112547 - DNA, 686 bp, Homo sapiens
  misc_feature: GYAE6OF02FL91H.21.30.C08.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtgtcagtgtccccaggacagacggccaggatcacctgctctgcagatggactgaccaaagaaatatgctttattggtaccaacagaagccaagggccaggaccccctggtcgttatgatataataaagacactgagaggcccctanagacgactccccgtagacggcgtattccgtactggtaccttcccgaacggtcttaccggacggggaacaacggcctaggttccaacgttacgtaaccttacgtacgtacggtacgaacggttacccgacgggaccgtaaggaacgggtaaccggaacgggtactacggtaaccgttaacttaaccgtaggtaacccgaaaacgtacggtaacgaacgtacgttaaggtaacgttacgtacgtagtttacggggttacggttacgggacgggtaacgggaccgtaaggtccgtacggaacccggttaccgtaacggtaccgaccggacccgtaacggtacccgtaccgtcccccgttaccggg

SEQ ID NO: 112548 - DNA, 836 bp, Homo sapiens
  misc_feature: GYAE6OF02IZI7W.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcatatgagctgaccacacgcccaccctcggtctcagtccgtccccgggacaaacggccaggactccacctgcttcgaggacgtatcgactagttacggaaacctaaaaaaattttcgtttaggttttttacggaacctaggtaccgtaaaggtaaacgtaccgacggacccgtaacggtccccgttggttcggtttccggtactaacgtcccgtaacgttaggaacgggtaaccggagggtaaccgtacccggtacccggttaccggggaacctccccggtaggtaacggtacgtactttccgacgtccggtacctaacctaacgtcgggtacggtacggtcgtacgtaacggttcgtactttcgacgtcgggtacggcccgtaagggtccggggaagacggttaagacggtcgtaaggacctttaacgtcgttacgttaccgtcgaacgttcgaaccgtacgtccgtacgtacggtacggtacgtaaccggttacgggacggtcgttacggttacggggaaccggtaccgggtaaccggttacgggttaaccgttacccggttacggtaacgggtaacccgtaccgggtaacccgtaagggtcccccgttaacccggtccccgttaacggggttcccttacccggtcccggtttaccccggttccccgttcccccgtttacccgg

SEQ ID NO: 112549 - DNA, 775 bp, Homo sapiens
  misc_feature: GYAE6OF02F1NV8.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctccccctctcactttctgcacgagtctctgaggccctctatgacgctgacacacgccctacccgtcggtctcgtacggttccggtaccccgggaacaaaccggccaaggactcctaccttctcgtggagtattcagttcgaacctaaaagtattacgtacgtttggttacggtccagtccaagtacgtacgacggcctaaccggccccttagtaccgtcggttacactccgtagtacggaccggtaccgtaggtaccgtaccgaaccgtaccggtccgggtaacctcccggtagaacggtacgttacttcctacgtccgcctaccgtacgtccgtacggacgggaccgtacggtcccggtaacctacgttcgaaccttacggtaccggtacggggtcccgggtacccggtagggttacggaacgtacgtacggaacgtcgtacgtaacttacgtacgttacgtaccgactacgtacgtacgtaggtacgttcgacgtaacggtacgggtagggtacgttcgggacgggtaacggtactacgggttaccgtaccgttaccggttcgaccggtacgtaacccggaggttaccccgtacccggttcccgtaacgttccgtaccggttccctacccggtccccgttacccgtccccgtttcccg

SEQ ID NO: 112550 - DNA, 816 bp, Homo sapiens
  misc_feature: GYAE6OF02I9SWX.21.30.C08.1.454.CMB.1.raw
tcagtcgtcgctcgcacgaccggtgctcgatttagtctgacgtcaaagggaaagggggtgggctcaggaggcagagctctgggaatctaaccatggcctggacccctctcctgcctccccctcctcactttctgcacagtctctgagcctcctatgagctgacacacgccctaccctcggtctcagtcggtccccggaacaacggccaggactccacctgctccgtaggagtatcgctagttacgaaaaccttaaaaaatttcgttttaggttttttaccggaacctacggtaaccgtaaggtaaacgtaccggaaccggtacccgaacgggtcccccgttaggttcggtttaccggtacttaacgtaccgtaaggtacggaacggtaaccggaagggtaaccggaaccccggtacccccggttaccgggaacccgttacccgtgggaacgttacgtacgtttaccgtccgtcggtaccctaccgtaaacgtcggtacggggtaaccggtcgacccgttaggttaacgtcgtttccgtacgggtacgggtcccggggtacgtacggggtagggtaacgtaggtaccggaagtccggtaacgtaaccgttactcgttaacgttacgtacgagacgtagacgtaagcgtacgtcgtacagggtcggtaggtacgtcggtacggaacgggtacggacgttcgggtacgtaaccgggtcgtacggtacctaccggaacgaccgggtcctcccggtacccggtaccgtccgtaacgttcccgtaccccgttccccgtaccccgttccgttacccgtaccgg

SEQ ID NO: 112551 - DNA, 772 bp, Homo sapiens
  misc_feature: GYAE6OF02F653Y.21.30.C08.1.454.CMB.1.raw
  modified_base (233)..(233): a, c, t, g, unknown or other
  misc_feature (233)..(233): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgacggcctcctatgagctgacacacgcccacccgtcggtctcgacgtcgtccccgggaacaaaccggccaggatccacctgctctggagntgactacttagaacctaaaaaattgtttgtttttacggaccagcaagtaagtcgaggaccacggcccctgtcggttggtcacgtccatcggaggacgtaggacggaaccgaccccgtaccggggtactccccgtaggtacggtacgttacttcgtcggttcgacctaccctaacggtaccggacgggtcgggtacggtacccgtacggttacgtacttaccgtcggtacgggtcggggtaccgtaggggtaggaaggtacgtaggtaacgcgtacgtaacttaccgttacgttacgttacctacgacgtaccgaaacgtagaacgtacgtaacgggtcggttaacgtaacggtcgggtaacggggtctaaccggggttcggggaaccggggttacgggaaccggttacggtaacgttcccgggtaccgtaggtaccggaccgaacccggtaggtcccggtacccggtaccccgtttacgggccctaaccggtttcccccggtttcggtaccccccggttcccgttacccgtttccccgg

SEQ ID NO: 112552 - DNA, 753 bp, Homo sapiens
  misc_feature: GYAE6OF02IHQLV.21.30.C08.1.454.CMB.1.raw
  modified_base (134)..(134): a, c, t, g, unknown or other
  misc_feature (134)..(134): n is a, c, g, or t
  modified_base (171)..(171): a, c, t, g, unknown or other
  misc_feature (171)..(171): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
tcagtcgtcgctcgcacgaccggtgctcgatttagtctgacgtcaaaagggaaagggggtgggctcaggaggcagagctctgggaatctaaccatggcctggacccctctcctgcctccccctcctcactttcngcacagtctctgacggtcctcctatgagtctgacacncgccctacccgtcggtctcagtcggtccccggaacaaccggcaggctccacgtgctntgganatcgctattacgaaactaaaaatttgtttcgtttttacgacagtacaagtaacgtcgacgaccaccggtccgttgtcgttggctatacagtggaacgacgaaggtacgaccgtacccggtcggctaccgtaggacgtcgtacttcgtccgtgacctaccgaacggtccggtaacggtcgggtaccgtaccgttgtacgttacttcggtaccgggtacggggtccgggtaaccggtcggggaaggtacggtaacgtcggtacgtaacgtaaccgttacttaacgctttaacgaccgtacgagaaccgagtaccgtacggtgtcgtaacgcgtacgggttggggaccgttacgttaccggggagggaccggtacggttacggtaacgggtaccgtaccggtaaccggttcgaccggaacccggtccgtccgggtaccccctcccgttaacccgggtacgtttaccctcccggtttacccgtccccccgtaacccccggtttccttaccccggttacgttcgg

SEQ ID NO: 112553 - DNA, 701 bp, Homo sapiens
  misc_feature: GYAE6OF02I0U8N.21.30.C08.1.454.CMB.1.raw
  modified_base (251)..(251): a, c, t, g, unknown or other
  misc_feature (251)..(251): n is a, c, g, or t
  modified_base (518)..(518): a, c, t, g, unknown or other
  misc_feature (518)..(518): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtctcagtcgtccccgggacaaacggccaggatcacctgctctggagtatgcattacgaacctaaaaaaatttntttggttttttacggaccagccaagaagtcacggccgacggtcccctgtgttcggtcactccatggacgacgaggacgaccgacccgtccgggactcccgtagacgtagtacttcgtcgtcggccttaccaaacgttccggaacggggtaccgggtcggaccctacggttagtccttacgtccgtagggtccggggcccgtaggggtacgggaaggtacgtacggaacggtcttacggtaaacttaccgttaccgttacgtttaccncgtaacgtcgaaacgacggacgtacgaggttggtaacacgtacgggacgggtcgtaggtccgggacgggtacgggacccgtaggtcgtacccgtacgtacgggtacaccgggtacccgacggtaccgtcccgtccccgtcggtccctaccgtccttacccgtcccctaccccttcccgtcccg

SEQ ID NO: 112554 - DNA, 846 bp, Homo sapiens
  misc_feature: GYAE6OF02IXFT9.21.30.C08.1.454.CMB.1.raw
  modified_base (165)..(165): a, c, t, g, unknown or other
  misc_feature (165)..(165): n is a, c, g, or t
  modified_base (245)..(245): a, c, t, g, unknown or other
  misc_feature (245)..(245): n is a, c, g, or t
tcagtcgtcgctcgcacgaccggtgctcgatttagtctgacgtcaaagggaaaggggtgggctcaggaggcagagctctgggaatctcaccagtggcctggaccctctcctgctcccctctcactttctagccacagtctctgacggcctcgtatgagtctgacncacgccgacccgtgtctcgtacggtcgtacccggataaacggccagtacgtcgacctcgctacgtggactagtcgtaccngttacggaacctaaaaattccttggtttttaacggacctagacgaagtacggtaccgaaggtccaacggtccccttaggttcggttacggtcacgtactagtaggaacgtacggaggtacggaaccggtacccgtacgggtaccgtaccgtacggaacggtcttaagttccgttacggtcggtaccgttaccgaaaccgtccggtaagggggtaccggtacggtacccgttaggttaccggtaaacttccggtaggaacccgggttccggggaccggtacgggggttaccgggaacgggtacgtaccggggtaaacgtccggtaacggtaccgtttaacccgttacgttaaccgttaaccggtacctaaccgggaccgtaaacgttaaccggacgttaccggtaacggttccgtaccgtacggtaccggtacgggggttaccgaacggttaccggggaacgggtaaccgggtaccggttacggttaccggtaaccggggtcccgtaggtacccggtaaccggaaccggtccgtaccgtacccggtaccccgtaggtaccgtacggtcccttcccggggtaacctcccggtacccgtaccgg

SEQ ID NO: 112555 - DNA, 762 bp, Homo sapiens
  misc_feature: GYAE6OF02F7WL7.21.30.C08.1.454.CMB.1.raw
  modified_base (166)..(166): a, c, t, g, unknown or other
  misc_feature (166)..(166): n is a, c, g, or t
  modified_base (196)..(196): a, c, t, g, unknown or other
  misc_feature (196)..(196): n is a, c, g, or t
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctcactttctgcacagtctctggaggcctcctatgagcttgacnagccaccctcggtctcagtgtccccggganaaacggccaggatcacctgctctggagatgcattgaccaaaaaattnttgttttttggaccagcagaagtcaggcaggccctgtgttgtcatccatgaggacaggacgacgaccccgtccgggactccctgacgagtacttctcgtcggtcctaccaactacgacgggacggtcggacctaggtttgattctacgtaggtcggggacccagggttcggaggtactaggaaacgtcgtagtaaccttaacgtaacgttggtttaaccctacggtaagaccgtaacggaaccgaaggtaccgtaaggttacgggttacccgtaagttccgggaaacggggggtacctaacgggtttttaccgggggaccggggtaaacggggggttacccggttaaacgggtttaccgggtaaacccgggttacccgggttaagggttacccgaacggtacccccgggtaaaacgggtcccgttcccgggtaacccccccgttccgggtacccctaacccggtttcccgttaccggtttccccctaaccccccggtttccctacccccgtttacccgg

SEQ ID NO: 112556 - DNA, 782 bp, Homo sapiens
  misc_feature: GYAE6OF02JLF11.21.30.C08.1.454.CMB.1.raw
tcagtcgtcgctcgcacgaccggtgctcgatttagtctgacgtcaaagggaaagggggtggggctcaggaggcagagctctggggaatctcaccatggcctggacccctctcctgctccccctcctcactttctgcacagtctctgaggcctcctatgagctgacacagccaccctcggtctcagtcggtccccgggacaaacggccaaggatcaccgtgcctcgtggagatcgcattacgaacctaaaaaattgttggtttttacggaccagacaaggaagtcgacggaccgtacggaccccttggttcggttcggtccaacttccagtaggaagggacaggtacggaacccgtaccccggtaccggaccgtcccgaggacgtagtactttccgtcggtcgtcctaccgaacgtcggtaacgggggtacggtccggaccgtacggtttagctttccgacgtacggggttccggggacccgtaggggttagggaagggtacgtacgggtaaacgtgtaacgtaacccttaaccgttacgtttacgttaactaccgagtaccgaagaccgttaacggcgtaggtacggtacgtacgtagggacgggtctacggggttcgacgggggtaaacggtcggttaacgggttccgtacccggttacgttaccggggacgacccgggtaacccggaaggttcccggtaaccccgtcccccggttaaccggtccccgttaccggttcccggttccccggtacccccgttcccggtaccccgtacccgggg

SEQ ID NO: 112557 - DNA, 793 bp, Homo sapiens
  misc_feature: GYAE6OF02IX7TW.21.30.C08.1.454.CMB.1.raw
  modified_base (495)..(495): a, c, t, g, unknown or other
  misc_feature (495)..(495): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgacgcctcctatgacgctgacacacgcccaccctcggtctcgagtccggtaccccggaacgaaaccggccgaaggactccaccgtgcctcgtggagtctcgacagttacgaaacctaaaaatttgtttcggtttttacggaaccacgtacctaaaggtacgttaccgacggtcccgtaaccggtccccgttaggttcggttcgtactacgtacgtagttacggaaggaacggacgggtacgaccgtacccggtaccggtactcccgtaggtaacgtcgtacgttccgtacggtcgtacctaccgtaacgtccgggacgggtaccggtcgaccgtttcggacgtttaccgtntaccggtcggtccgggaacgtacgggtacggagacggtaaggtaccgtacgtacgtaccgttagttaacctcgttaacgacgacgaacctacgacacggtcgtaagtcgtaacgtagtcgggaacggtacggtaccgttcgggaaccgggtacgtaaccgggttacgggtaccgtaccgggttaacgcggttaccgtaccggacccgggttaaggtcccccgtccggtaacccccgtggttaaccccgtccggttcccccgttacccggtaaccccctttcccggtccgttaaccccg

SEQ ID NO: 112558 - DNA, 785 bp, Homo sapiens
  misc_feature: GYAE6OF02I558Z.21.30.C08.1.454.CMB.1.raw
  modified_base (194)..(194): a, c, t, g, unknown or other
  misc_feature (194)..(194): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctcctcactttctcgcacagtctctgagcctctatgagtctgacacacgcctaccctcgtctcagtcgtacccgganaacgccagactcacctgctctaggagtactcgctattacgaacctaaaaaatttgttttggtttttacggaacctacgtacaagaacggtcacggtaccgaccgggtccccttaggttcggtttcgggtaccacttccgtaagttacgggaaacggacggtaacgggaacggtaacccggtaccccgggttaccggggtacctaccccggttaggaacggtaacgttacctttaccgttcgtacgggtaccttacccgtaaacgttccgggaacggggtaccgggtccggacccgttacggttcgtactttcgtacggtacggtaccggggaccgtaggggtacggaggtacgtacggtaagtctacgtacctaagttacttcgtactacgacgtacgtagacgacgtccggtaagttcggactacggacggtacggggtactagggtaccgggcggggtaaccgggtaacgtaccggttacgaccgttacggtacgtaccgacgggaacccggtacggtaccgtacccggtccccgttaggtcctaccgtttccggtaccctttaacccccggtccttccccgttacccg

SEQ ID NO: 112559 - DNA, 923 bp, Homo sapiens
  misc_feature: GYAE6OF02HNDOM.21.30.C08.1.454.CMB.1.raw
  modified_base (248)..(248): a, c, t, g, unknown or other
  misc_feature (248)..(248): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctcctcactttctgcacagtctctgagcctcctatgagctgacacagccaccctcggtctcagtcgtccccgggacaaacggccaggactcacctgctcgtggacgatgctattacgacctaaaaaatttnttacggtttttaggtaaccagtcctaagaacgttcgaacgggccaacgggtcccccttaggttcggttttacgggtacctaacgttccccgtaaagtttcggggaacggaaccggaaggggtaaccggtaaccccggtaccccggttacccggggtaacttcccccgtaggtaacggacgtactttaccgtcgttcgggtccttacccgtaaaccgtccgtaacgggggtaccgggttacgggacccctttaacggtttcgtaaccgtttacgtccggtacgggttaccgggggaccccgtaaggggttccggggtaaggtacgtttaggaaacggtccggttacggtaaccgtttaaccgttacttacggtttaaccgtacggtacgtaaccgtaacggaccgtaaccggtagtaacgggtttacggtactaacggttaccgggaaggggtcccgttaagggttacccgggggaacgggtaacgggttaaacccggtaaggttacccggttacccggttaccggtttacgggacccgttaacccgggtaccccggtaaaccgggttcccgttaccccgggtaccccccggttaccggttaaccccgttaccggttacccgttttacccccggttccccccgggtttaccccccgtcccggttttaaccccccgg

SEQ ID NO: 112560 - DNA, 846 bp, Homo sapiens
  misc_feature: GYAE6OF02IZR86.21.30.C08.1.454.CMB.1.raw
  modified_base (205)..(205): a, c, t, g, unknown or other
  misc_feature (205)..(205): n is a, c, g, or t
  modified_base (713)..(713): a, c, t, g, unknown or other
  misc_feature (713)..(713): n is a, c, g, or t
tcagtcgtcgctcgcacgaccggtgctcgatttagtctgacgtcaaagggaaagggggtgggctcaggaggcagagctctgggaatctcaccatggcctggacccctcccctgcctcccccctcctcactttctgcacagtctctgacggcctcctatggagctgacacacgccaccctcggtctcgagtcggtcccccgggaanaaaccggccaggactcctaccctggtcctcgtggaagagcaacttagtccaaaaaactttaattacgttttttcggtttacctaacggcacgtaaacgtccagggtacccacggtaccccgtcggttacgttttcggggttcaacgttccacgtacgacgggtacgaacggtacggaccgaacccccgttccccgggtacggtaccccgttaccggacgggtaaacgtacgttttacccggtacccgtttagggaccccgttccccgtaaaaccggttaccgtaaccgggggtaacgggggttaacggggtcccctaaccgggttttacccggttaggtttcccgtttaaaccgcggggttacggggggtcccccggttaaagggggtggtaacgggtacccgggtaaggtacgtacggtacgttaacccgtacctttaacgttaaccggtcgtttaccgacgtaccgagtaacggtcgtaaggtacgtcgtacgtcagggttacggnggtacggtacggtcggggaaccggtacggttcgacggttccaccggtacgaggacctacggaccgtcggtaccctccggtaccgtccgtccgtaccgttccgtaccccgttccgtcccttcccgtacgttccg

SEQ ID NO: 112561 - DNA, 717 bp, Homo sapiens
  misc_feature: GYAE6OF02FM763.21.30.C08.1.454.CMB.1.raw
  modified_base (178)..(178): a, c, t, g, unknown or other
  misc_feature (178)..(178): n is a, c, g, or t
  modified_base (387)..(387): a, c, t, g, unknown or other
  misc_feature (387)..(387): n is a, c, g, or t
tcagtcgtcgctcgcacgaccggtgctcgatttagtctgacgtcaaagggaaagggggtgggctcaggaggcagagctctgggaatctcaccatggcctggacccctctcctgctcccctctcactttctgcacagtctctgacggcctcctatgagctgacacagccacccttggtntcagtcgtccccgaggaccaaccggccaggactcgacctgctctggatacttcattcgaccaaaagtataacttacgttgttcggtacagcgaagagtcaggccgacggccctgtacgtggtcactcatcgacgcagtcgacgacacgtccggactcccgtgagacgtacttctcgtacgtcctaccgacgtacctacggacgggtacncggtaccggacccgtaacgttacgaccttagtacccgtaggggtaccggggtaccgtacgggtacggaacggtaacgtacggaaacggtcgttaacgtaacgttacgtttacgttacggttaccgtaccgtaaccgtaacggtaacctacgggttacggttacggtaacgttacgtacggggttaacggggttcgttaccggggtacgggtaaacggtaaccgttaagggttacccgtaccggttcgttaccgggtacgtaccggaccgtaacggtccgtcccggtaccccggtcggtcctaccgtcgtttacccgtcccgttacccccg

SEQ ID NO: 112562 - DNA, 783 bp, Homo sapiens
  misc_feature: GYAE6OF02HCGPS.21.30.C08.1.454.CMB.1.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (520)..(520): a, c, t, g, unknown or other
  misc_feature (520)..(520): n is a, c, g, or t
tcagtcgtcgctcgcacgaccggtgctcgatttagtctgacgtcaaaggggaaagggggtgggctcaggaggcagagctctgggaatctcaccatggcctcggacccctctcctgctccccctcctcactttctgcacagtctctgacggcctctatgagctgacacagccacccgtcggtctcaggtccggtccccgggaacaaacggccaggactaccaccnggtccttcgaggganagtgacctaagttagaaacctaaaaaagtttgtttaggtttttttacggaaccgttagaccgaagtaaacggtacgaacggcccgtaacgggtccccctagggttcgttcggtacctaaactacccgaagtacggaagggaaccgacggggaacgaaccccggtaaccccggtaccggggtacctacccgtagggaaacgtaacggttaacttccgtttacggaaccggtccttaacccgaaacggtcggaacggggtaacggtcggtaccgtacggttanaacgtttccgtaagccggggttccgggacccggtagggtaacggggttaggaaggtacggtaagtcgtaacggtacttaacttaggtacgttacgacgtagaccgaagagtacgagtacgttaggactagacgggacgggttacgacggttacgggacggtacggtacggtacggttacgacgtacggtcgacgaccggccgagccggtacccgtacccgtccgtacctacctaccggttcccgtcccgtccgtccctaccgg

SEQ ID NO: 112563 - DNA, 775 bp, Homo sapiens
  misc_feature: GYAE6OF02FGZQC.21.30.C08.1.454.CMB.1.raw
  modified_base (227)..(227): a, c, t, g, unknown or other
  misc_feature (227)..(227): n is a, c, g, or t
  modified_base (527)..(527): a, c, t, g, unknown or other
  misc_feature (527)..(527): n is a, c, g, or t
tcagtcgtcgctcgcacgaccggtgctcgatttagtctgacgtcaaagggaagggggtgggctcaggaggcagagctctgggaatctcaccatggcctggacccctctcctgctcccctctcactttctgcacagtctctgaggcctcctatgagctgacacagccaccctcggtctcagtcgtaccccgggacaaccggccaggactccacctgcctcgtcgggantcgcacttcgaacctaaaaattttgttcggttttttacggaccagtacaagaacgtcgacggcccgtaggccccttaggtcgttcggtccactccagtcggaacggtacacggacgaccgtacccgtccgggactcccgtgacgacgtacttccgtcgtacgcctaccgacgttacggacggggtacggtccggaccgtacgttacgtacttaccgtacgtacggggtaccgggtcccgttaagggacggtacggaattcgggaactcgtacgtacccttaacgtacgtttacgttaacncgtaacgaccgaacgtaaccacggtcgtaagggttccggtactaacgggttaccgggacggggttaacctaaccgggttcggggaaccggtacgggacttacggggtttaccaccccgggttagttaccgggaccacccgggttaacccgcgggttaccccgtccccggtacccccggtttacggaacccgtttcccgttcccggttccccggtttcccccccgtacccgttacccggtaaccccggg

SEQ ID NO: 112564 - DNA, 739 bp, Homo sapiens
  misc_feature: GYAE6OF02H4INR.21.30.C08.1.454.CMB.1.raw
  modified_base (267)..(267): a, c, t, g, unknown or other
  misc_feature (267)..(267): n is a, c, g, or t
  modified_base (532)..(532): a, c, t, g, unknown or other
  misc_feature (532)..(532): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctagtgagctgaacacagcccacccgtcggtctacgagtcggtccccgggaacaaacggccaggactacaccgtgctacgtaggagtactgctaattacgaaacctaaaaaatttntttacggtttttacggaacctagacaagtaagtacgaggccgacggtcccctgtagttcggtacactccagtaggacggtacgaaggacgaccgaccccgtcgggtactccgtaggacgtagtacttctcgtacgtacctactacgtacgtagggacggtcgaccgtagttcgtacttcgtacgtcgggtacgggtccgtaagggtacgggaaggtagtaggtacgtacgtcgtaaacctacgttacgtttcgtaactacggtanacggaactacgacgtaacgtcggtacgtacgacggtacgggacgggtacgttacgggtaccgggtaacgggaacggtaccggtacggtacggttaacccgtcggtaccggtacgtaacccggcggtaaccggccgttaccccgtccccgttcggtaccgttacggttcccgttacccggtcccccgttacccgtcccgtttaccccg

SEQ ID NO: 112565 - DNA, 779 bp, Homo sapiens
  misc_feature: GYAE6OF02F9TK7.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctccccctcctctactttctgcacagtctctggacgcctcctatgagctacgacacagccctacccgtcggtcctcgaggttccgtaccccgggaacaaaccggcctaaggactccacctgcctcgtaggagagtagactattacgaaaccttaaaaagtttgtttcggtttttacgacagactaagaacgtcgacggacctacggtccccttggttacgttacggtacctaagtccctagtacgaacggtaacgacggtaacgacccgtacccgtaccgggaccttaccggtagtaacggacttcgttacctccgtacggtaccctaccgaacgttagggaccggggttacggtaccgtaccgtaagttcgtattaccggtacgtaccggggtcgggaccggtaagggtacgggtaaggtacgtaacggtaggtccgtaacggtaccgttacttacggttacgttacctacgtacgtaccgaagccgttaggacgttaggtacgtaccgaggtcggaacgggtcctaacgggtcgggacgtaagggccgttaggtaaccctcgggtaccgagttcccgaccggaccgtaacggtccccgtacccgtcccgttaacggtacccttcgtaccccgttaccggttcccccgacgtttacccgaccgg

SEQ ID NO: 112566 - DNA, 757 bp, Homo sapiens
  misc_feature: GYAE6OF02IMSX6.21.30.C08.1.454.CMB.1.raw
  modified_base (165)..(165): a, c, t, g, unknown or other
  misc_feature (165)..(165): n is a, c, g, or t
  modified_base (193)..(193): a, c, t, g, unknown or other
  misc_feature (193)..(193): n is a, c, g, or t
  modified_base (243)..(243): a, c, t, g, unknown or other
  misc_feature (243)..(243): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctcctcactttctgcacagtctctgacggcctcctatgagctgacacngccacctcggtctcagtcgtcccggganaacggccaggatcactgctcgtggagatgcattagaacctaaaaaatttnttagttttttcggaacctagctaagaagtcgaacggccacgggcccctggtacgttggtctactccagtacgaggacgaggacgacgtaaccgtccgggatccctggaagacgacttcgtcgtcggcctaccgtaaccgtcggaacgggtaacggttccggccgtaacgtttcgaacgtttcgtacgtaacgggttccggggccgtaagggtcggtacggtaacgtggaaacgtacgtacgacgttaactacgttcgttaaccgtgaacgtcgtaacgaacgtccgtaaggtcgtacggtactcggttacgacgggggaactcggggtaccgggtacgggtaaccggggtaaccgtacggggtttaacccgacccgggttacttaaccggggttaaccgtaccggtaccccggtaagggtacccgttccccgggaaccccccggttttaggacccggttacccgttccgggtttaaccccggttccccggtcccccgtttcccgttcccccggg

SEQ ID NO: 112567 - DNA, 712 bp, Homo sapiens
  misc_feature: GYAE6OF02GWK9U.21.30.C08.1.454.CMB.1.raw
  modified_base (193)..(193): a, c, t, g, unknown or other
  misc_feature (193)..(193): n is a, c, g, or t
tcagtcgtcgctcgcacgaccggtgctcgatttagtctgacgtcaaagggaaagggggtgggctcaggaggcagagctctgggaatctcaccatggcctggacacctctcctgctccccctcctcactttctgcacagtctctgagcctcctatgagctgacacagcccacctcggtctcagtcgtcccgganaacgcaggatcactgctcgtggagatgcattacgaacctaaaaaatttgttaggtttttacgaaccagacagaagtcacggcacggtccccttgtgttggtacacgtaccagtaggacggacgaggagaccgacccgtacgggactacctgagagtattcctctcggacctactaaccgtcgacggggtacggtcggtaccgtacgtagtacgttacgtagtacgggtacgggggccaggggttacggaaggagtaacggtagtacgtacggaacttaccgttaacgtgttacctacgtagtacgacgtaacgtacgacgtaggttacgtacgtaacgttacgggaagggggtacctaacgggttccgggaccggggaacgggtaccgtaacgggttaccggaaccgttaccgtaacgggtaccggtaaccggaaccccggtaaggtacccgttccccggtaccccgttccggtactacccggttccgttcccgttcccccggtaccctttccccccgg

SEQ ID NO: 112568 - DNA, 868 bp, Homo sapiens
  misc_feature: GYAE6OF02GVAR0.21.30.C08.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagtctgacgtcaaagggaaagggggtgggctcaggaggcagagctctgggaatctcaccaatggcctggacccctctcctgctccccctcctcactttctgcacagtctctgaggcctcctatgagctgacacagcccaccctcggtctcagtcgtccccgggacaacggccaggatcactcgctcgtagganatgcattacgaacctaaaaaatttagtttggttttttacggaaccgtagacgaaggtaacgtcgtaacggaccccgtaacgggtccccctttggttaggttcggtactaccgtacccgtagtaggaacggtaacgaggaaccggaccggacccggtccggaacctcccgtaggaagtaaccgtattcgtacgtcggtaccgtacctaaacgtcggaaacgggggtaccgggtcgggtaaccgtacggttagtaccgtttaacgtaccggtaggggttacccggggacccgtaggggtaacgggtagggtagtaaacggtacggacgttagtaccgttactacgttacgttacacgtaagccgtaacgacgacgtacgaagttaggtaccgacgttacgggggacgggtacggtaaaccggtttccgggggaacggggtaaccgggttaaacccggtacggggtttaaacccgcccggggtttaaccgggttacgggaaccccgtaagggaaccccggttaaaaccgggtcccggttacccccgggtaccccccggttaacccggttaccccgttacccggttaacccgtttaccccccggggtttaccccctttcccccgggttaccccgttttacccccgg

SEQ ID NO: 112569 - DNA, 841 bp, Homo sapiens
  misc_feature: GYAE6OF02FLJS3.21.30.C08.1.454.CMB.1.raw
tcagtcgtcgctcgcacgaccggtgctcgatttagtctgacgtcaaagggaaagggggtgggctcaggaggcagagctctgggaatctaaccatggcctggacccctctcctgctcccctcctcactttctgcacagtctctgaggcctcctatgagctgacacagccaccctcggtctcagtcgtccccggacaaacggccaggactcaccgtgctctgggagatcgcagtttcgaaccctaaaaaaattttattcggtttttttacggaacctaggtcaaggtaagttacgacggcctaacgggccccctggttgttcggtcagtccagtggaacggacgaacgggagacccggtaccccgtccggggactcccgtaggacgtaggtatttccgtacgtcgggtacctaccaaaccgttcggaacggggacgggtccggtacccgtaacgtttcggtacgtttccgtacggttacgggttaccgggggacccgtaagggggttacggggaacgggtagtacgggaaacggtccggttacggtaaaccttaaccgtttaccgttacgggtttaaccttaccggtacgaaccggttaacggaaacgtacggaacggttacgggttaggttaccgtacggttaccgggtaacgggggtaaccttacgggtaccggggacggggtaaccgggggttacgtacgggtttaccgggcccgttaacccggttacggtacgaaccgggtacccgaacgggtcccgttaacccggtcccccggttacggttacccgtacccgttccgttcccggttacccccgtccccgttaccccgtcccgttcccg

SEQ ID NO: 112570 - DNA, 877 bp, Homo sapiens
  misc_feature: GYAE6OF02GE90C.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctccccctcctcactttctgcacagtctctgaggcctcctatgagtctcgaacaccagccctacccgtcggtcctctagtccgtccccgggaactaaacggccaggactcacctgctctggagagtcgctatcgaaacctaaaaatttcgtttgtttttacggaaccagtacaagtaacgtacgacggccgaccggtccccgtttggttcggttacggtactacgttaccgtaggtacggaaccgggtacggaacgggaaccgtaaccccggtaccccggtacccggggtaacttccccggtaggaacggtacgttagtttcccgtacggttacgtccccgtaactaaccggtacggaacgggggtaaccggttccggaccggttacggtttacggttacgttaccgttacgggtacgggtacccgggggaccgtagggggtaacgacgggtaagtaacgggtacggtaccgtaacgtaaccgttaaccgtttacgttaccggttaacctaccgacggtacaacggaccctggacggttacgttcggtatacggttacggggacggtacgtaccgggttacggggaaggaccggggttaccgtaaccggttccggtaaccccgttacgggtacgttacccgacccggtaacccgggtacgttacccggtacccccgggttacccgtacccggtttaccggtacccggtttcccccggttcccgggttttacccccccgttccccggtaccccctttaccccgg

SEQ ID NO: 112571 - DNA, 683 bp, Homo sapiens
  misc_feature: GYAE6OF02G5TE7.21.30.C08.1.454.CMB.1.raw
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
  modified_base (355)..(355): a, c, t, g, unknown or other
  misc_feature (355)..(355): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccctaccctggtgtcagtcgtccccaggacacgacggccaggatccacctgctcngcagagtggactgaaccaaagaatnagtacttatacgtaaccaanaagaacgccgacggccgaccgcccgttgtagttagtagtatactaataaagacacgtagaacgacggccctacgacgagtacctccgngtacgtacgtactttccgtacgttacggtcctacgacgcgttacggacgggacacggcgacgttacgtaacggtttacgtaccgttacgtacgtaacggtacgaacggttccggaagggtaccgaaacgggacggacggtacgtcgtaacgtactttagttacgtataaaccgaacgtaggtacgtaacgtacgtaaggacggttaacttcggttaaggtttcggggtacggtacgggtacgggtacggtaacggacggtccgtacggtacccgttacgttacggacggtaccgaacccggtaccgtacccgttccgccccgttccgg

SEQ ID NO: 112572 - DNA, 704 bp, Homo sapiens
  misc_feature: GYAE6OF02HK5XN.21.30.C08.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (525)..(525): a, c, t, g, unknown or other
  misc_feature (525)..(525): n is a, c, g, or t
  modified_base (534)..(534): a, c, t, g, unknown or other
  misc_feature (534)..(534): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgacggcctcctatgagctgacacagcccaccctcggtctcagtcgtccccgganaaacggccaggatcacctgctctgganatgctattcgaacctaaaaaatttnttaggttttttacggaccagacaagtaagtcgacggccgtaacggcccctggttgttcggtcatccagtacggaacggtacgaggaacgacccggtacccgtaccgggactccccgtagacggtactacttaccgtcgtcggtcctaccaacgtcggaacggggtaccggtcggacccttaggttcgtacgttcctcggtaacgggtccggggacccgtagggtacgggagagtacggaacgtcgtacgtacgttaccttagttcgtttacgcganacgtacganagtcgtagtacggtacagttaccgggacgggtactacgggttccgggaacgggttacggaccggtaggttcccggaccgttcgtacggtccgaacggcccgaacggtccctcccggtccccgtggtaccctccggtacccttccggttccccctaccgttcccgttcccg

SEQ ID NO: 112573 - DNA, 797 bp, Homo sapiens
  misc_feature: GYAE6OF02GYBGI.21.30.C08.1.454.CMB.1.raw
  modified_base (190)..(190): a, c, t, g, unknown or other
  misc_feature (190)..(190): n is a, c, g, or t
  modified_base (242)..(242): a, c, t, g, unknown or other
  misc_feature (242)..(242): n is a, c, g, or t
tcagtcgtcgctcgcacgaccggtgctcgatttagtctgacgtcaaagggaaagggggtgggctcagggaggcagagctctgggaatctcaccatggcctggacccctctcctgcctccccctcctctactttctgcacagtctctgacggtcctcctatgagctgacacacgcccacccgtcggtctcncggttcggaccccggaacgaaccggaccgacggactaccacctcgccttcgnggaagcgtgacctattacgaaacctaaaaatttgtttagtttttacggaccagtacgaagtaagtcgaacggaccgaccgccccgttggttcggttcggtactaacgttccgaagttaggacggaacggaacgggacggaccccgttacccggacgggtacctacccggtaggagtacgtattccgtcgtcgtccacctacgtacggacggggcggtaccgtcgtacgtctacgttcgtacggtacggggtaccgggacggtacgggtcgggggacgtaaggtacggaacggttaccgtacgtaaaccgttacgttacgttaccgttaccgaacgttacggacgttaacgaacgtagtacggtacggtcggttacgacggttaccggggaggtacggtacgggggttacgggaccggggtacgggaccggttaacgggtaccgttcccggggttaacgaccgtacgggaacccggtccggtaaccggtcccggtccccggttacccggtcgaccttcccgttaccgtccccgtcccggtaccctccggtacccgg

SEQ ID NO: 112574 - DNA, 912 bp, Homo sapiens
  misc_feature: GYAE6OF02JV5UV.21.30.C08.1.454.CMB.1.raw
tcagtcgtcgctcgcacgaccggtgctcgatttagtctgacgtcaaagggaaagggggtgggctcaggaggcagagctcgtgggaatctcaccatggcctggacccctctcctgcctccccctcctctactttctgcacagtctctgacggcctcctatgagctgacacacgcccaccctcggtctcgacgtccggtccccgggaacaaaccggccaaggactaccaccgtcgacctcgtagggacgtagtacgactagttacggaaaaccttaaaaagtttacgttttacggtttttacggaaccctagtaccgtaaggtaacgtacgacggtacccgaccggtccccgtttgggttacgttaccggtacctacgtaccgtaagtacggtaacggtaacgtaacggaccggtaacccgtaccccggtaccgggtacctacccgtagggacgtaacttacgttaccgtacggttccggtaccctaaccggtaaccgtacgggtaaccggggtaccgggttccggaacccgtttaacggttacgtacgttaccgtaccggtacgggtacccgggggtacccgaaggggtttacgggaacgggtaagtacggaaccggttacgttaaccggtaacgttaaccgttaggttaccgttaacggtacgtaacggtaacgacgtacggtacgtaacgggttcgtacgtacggttacgggaaggggttcgtacgggtttacgggacggggtaccggttaacgggtcggttaacccggtaccgggttaccgtaagggtacccgtaaccggtaccggtaaccggtacccggttcccggtacccccgggttcggttaacccgttcccgttaccggttcccccgggttaccccgtccccggttacccggttcccggaacccgg

SEQ ID NO: 112575 - DNA, 813 bp, Homo sapiens
  misc_feature: GYAE6OF02JAJWU.21.30.C08.1.454.CMB.1.raw
  modified_base (618)..(618): a, c, t, g, unknown or other
  misc_feature (618)..(618): n is a, c, g, or t
tcagtcgtcgctcgcacgaccggtgctcgatttagtctgacgtcaaaggggaaagggggtgggctcaggaggcagagctctgggaatctcaccatggcctcggacccctctcctgcctccccctcctcgtactttctgcagacgtctcgtgacggccctacctatggagctagacacgacgtcccacccgtcgtactccgtaggttcccggtccccgggaacgaaaccggccgaacggacctaccgtacccgttcgccgtacggtagggactagtcgtacctagttaaccggtaaaccttaaaaaagttttcgttttacggttttaccggtaaacctaagtacgtaaagtacgtacgaccggtacccgtaccggtacccgttggttacggtaccgtactacctaccgtagtaggaacgggacgtacgggaccgtacccggtacccggtaccggtacgtcccggtagacgtaactcgttactcggtacgaccgtacgtaccgtacggtacggggacgtcgacccggttagtcggttactccgtaggtcgggtaccggtaccggtgggtacgaggtacgttacgacggtatacggtacttacgtaccgttagtaccgtanacgacggttaacgacgtagtaccggtagtacgtccggttacgtagggaccggttacggtacggccgggtaacggacggttacggtacggtcccgtacggtacgtaccgacgacccggtacggaccttcccggaaccgtcccggttacgtacctacccgttcccgttcccgtacccgttccccgtaccgtttcccg

SEQ ID NO: 112576 - DNA, 867 bp, Homo sapiens
  misc_feature: GYAE6OF02JJG48.21.30.C08.1.454.CMB.1.raw
  modified_base (620)..(620): a, c, t, g, unknown or other
  misc_feature (620)..(620): n is a, c, g, or t
  modified_base (690)..(690): a, c, t, g, unknown or other
  misc_feature (690)..(690): n is a, c, g, or t
  modified_base (842)..(842): a, c, t, g, unknown or other
  misc_feature (842)..(842): n is a, c, g, or t
tcagtcgtcgctcgcacgaccggtgctcgatttagtctgacgtcaaagggaaagggggtgggctcaggaggcagagctctgggaatctaaccatggcctggacccctctcctgctcccctcctcactttctgcacagtctctgaggcctctatgagctgacacacgccaccctcggtctcacggtcggtaccccgggaacaaaccgggccaaggactaccgacctgcctacgtcggaagatcgactattacgaaaccttaaaaaaatttgttttacggttttttacggaaccgtacggtaccgtaaacggtaaacggttccgaaacgggcccgtaacgggtaccccttaggtttacgggtttcggacctaacgtaccgtagtacggtaacgggaacgtaacgggacgtaccggtaccccgtacgggtaccgtccgaggaacggtaagttacttccgtaccgttcggtacctaccgtacgtacggtaacggggtacggtacggtccgtaacggtttagtaccgttccgtacgtacgggtacccggggtccgtaaggggtaccgggtaaggtacgtaacggagtaccgttacgaaccgttaccgttacgttacgttaaccgnggtaaccgtaccggtaaggttaaccgacggtacgttaggttaccgtacgtacggtaacgggtaccggggnttaaccggggtcccggggtacgggtaaccgggtcggttaacgggttaacgaccccggtttacgacggtacccgtacgtacccgggtaaagtccccggtcccggtttcccgaacccgggttcttacccggttaccgttaccccgtttaccccnccggtttcccgtccctttaccccgg

SEQ ID NO: 112577 - DNA, 872 bp, Homo sapiens
  misc_feature: GYAE6OF02FR2HR.21.30.C08.1.454.CMB.1.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacacgtctctgacggcctcctatgagctgacacagcccaccctcggtctcgagtcgtccccgggaanaaccggcaggactcacctgctcnggtantgctatcgaactaaaaattnttgttttacggacagnaagtatcgacgaccgcgcccgtgtgttcgtctactcctatggacggacgaacgggacgtacccggtacccggtaccgggtactccgtaggtacggagttaccttcgtaccgttcggtaccctaaccctaaccggtacgggtacgggggtaccggttcggtaacccgtcgggtttacgtactttaccggtcggttaaccgggggtaccgggcccgggtaaggggttacgggaacggttaactcgggaaggtaccgtcgtaaaccggtttaacttacgggttacgtttaaacgcccaaggtaccgtaaacggaacgtacgaaccgggtttagttaccgggtccggttaaacgtacgggggtaaccgggggttattacccggggtttaccggggggaaccggggttaaaccgggggtaccgggtttaaacccgggttccggttaaaccccgggtttacccgggttcgggtaacccggtttaaacccggaccgggttaaacccggtacccgggtaccccccgggttacccccggttaccggttaccgtaaccccggtttccccggtttaccccggtacccccgttacccccggttaccccgtaacccgggg

SEQ ID NO: 112578 - DNA, 803 bp, Homo sapiens
  misc_feature: GYAE6OF02GE0E3.21.30.C08.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagtctgacgtcaaagggaaagggggtgggctcaggaggcagagctctgggaatctcaccatggcctggaccctcccctgctcccctcctcactttctgcacagtctctgaggcctcctatgagctgacacagccaccctcggtctcagtgtcccgggacaaacggccaggatcacctgctcgtggagatcgctattgaacctaaaaaagtttnttggttttttacggacccagacaagaagtcgaaggccacggcccctggttcgttcggtctactccgagttggacggaccgagggtacgaccggtaccccgtccgggaacttccccgtaggacgtacgtacttccgtcgtcggtacctacgtaaccgttccgacgggggaaccgggttcggaccgttacggtttacggtactttcccgtacgtaacgggttccgggggcccgtaagggggtacgggaacgggtacgttagggaaccgtccgttaacggtaacccgttaccgttaacgttcgtttaaaccgtcgtaccggtacgtaacggaccaagggtacgtacggttcgggtactaacgggttacgggagggggacccgttagggtttaccggggaccgggtaacgggtaccggttacgggtaccggttaacccgggttcgttaccgggttacgaaccggtcccggtaaacgggtccttacccgggtcccccttacggggttccctaccgttaccgttccccggttaccccggtccccgttccttcccgttacccgg

SEQ ID NO: 112579 - DNA, 932 bp, Homo sapiens
  misc_feature: GYAE6OF02I49D7.21.30.C08.1.454.CMB.1.raw
  modified_base (111)..(111): a, c, t, g, unknown or other
  misc_feature (111)..(111): n is a, c, g, or t
tcagtcgtcgctcgcacgaccggtgctcgatttagtctgacgtcaaagggaaagggggtgggctcaggaggcagagctctgggaatctcaccatggcctggaccctctccngctcccctcctctactttctgcacagtctctgacggcctcctatgacgctgaacacagccacctcggtctcagttcgacccggacaaccggcaggactcaccgtcgctcgtggagactcgaccgtattacgaaaccttaaaaaactttgttttacggttttttacgggaacctacgtacgtaaacgtaacggtaccggacggtaccccgtaaccgggtccccgtttaggtttacgggtttccggttaactaaccgttacccggtaacggttacgggtaaacgggaccggttaaggggaaaccggtaacccccgggtaacccccgggttacccgggtaaaccgtttccccgggtaacggaacggtttaaccggttaccttttaccgttaccgggttaccggtaccccgttaaacccgtaaacgggtttaccggaaccggggggtttaaccgggtccggttaacccggttacggtttacggtaaccggtttccgtaacgggttacggggtacccggggtaccgggtaaggggttacgggaaggtacgttaacgggtaaccggtacgtaaccgttaaccgttaaccgttaccgttacggtttaaccacggtaacggaaccgttaacgtacgtaacggttacggtcgttacggaccgtaggtacgggacgggttaccgtagggttaccggggtacggaaccgggttacggtaccggttaccgggtacctacgggttaccgacgaccggtccggaccggtccggtaccgttcccggtacgttaccttccggtacccttccggtaacccctcccggttacacccggg

SEQ ID NO: 112580 - DNA, 802 bp, Homo sapiens
  misc_feature: GYAE6OF02GQCL2.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggaccctctcctgcctcccctctcactttctgcacagtctctaggacggtccctccgtatggagtctgactacacgcccacccgtcggtctacgtacggtccggtaccccgggaacaaaccggtccgaaggtactaccgtaccgtacgtccgtcgttagggactacgtcggtactacgttacgaaaaccttaaaaaagtttcgttttacggtttttacggaactaggacgtaaggtaacgtcgtacggaccgtaccggtcccgttaggttcggtacgttactacgtccgtaagtacggaacggaacggtacggaacgacccgggtacccgtaccgggtaccttccggtagtacgtacgtcttacgtcgtcggtacctaccgtacgtaccgggtacgggtacggtaccggtaccgtacggttacgttacgttccgtaacgggtacgggtccgggacggtagggtacggtacggtagtacggtacgtacgttacgtacgtactacgtacgtaccgacgtacgtacgtactacggacgtacggaacgtgtaacgtacggtgggaacggtcgtacggtcgggacgggtaacgtccggttacggaccgttcgtacgtacggacgaccggaccgtacggacccgtcccgtcccgttacggtaccctaccgtttcccggtccgtaccccggttaccgtcccgttaacccg

SEQ ID NO: 112581 - DNA, 860 bp, Homo sapiens
  misc_feature: GYAE6OF02JJATF.21.30.C08.1.454.CMB.1.raw
  modified_base (163)..(163): a, c, t, g, unknown or other
  misc_feature (163)..(163): n is a, c, g, or t
  modified_base (582)..(582): a, c, t, g, unknown or other
  misc_feature (582)..(582): n is a, c, g, or t
tcagtcgtcgctcgcacgaccggtgctcgatttagtctgacgtcaaagggaaagggggtgggctcaggaggcagagctctgggaatctcaccatggcctggaccctctcctgcctccccctcctctactttctgccacagtcctctgacggtcctcctatganctgacacacgccacccgttcggtcctctacgtccgtaccccgggaactaaaccgggccacggtactccgtaccgtgtcccgtctagggaacgtacgtcggtcctaacgtaacggtaacccttaaaaaaatttccgttttaggttttttaccggtaccgtaacggtaaccgaacggttaacggtaccggtaacggcccgtaaccggttccccgttaggttcggtttacggtctaaccgtcctaaggtacggtaacggacgacgggtaacgtaccccgtaccccggtacggaccttccggtagtacgtaaggttcttccgtacgttacgaccgtacctaacgtcgggtaaccggggtacggttacccggaccttaacggttcgtacttacgttaaccggtcggggtacccgggtacccggngggttacggacgaacgtcgaaacgttgaacgtaaccgtttaccgtacgttacgttacggtacctgtaaccgaggtaacccacgggttacgtaaccggtagtaaccgacggttaccggggacggttacgtacccggggtttacggaacccggggtaacggggttccgtaacgggttaacccgcgtttaacggccggtaacgtccggaccgtacgtcggtcccccacggtccgtaccgtaaccgttccgttacccccggaccttccgtccttaaccccgg

SEQ ID NO: 112582 - DNA, 826 bp, Homo sapiens
  misc_feature: GYAE6OF02FS8FO.21.30.C08.1.454.CMB.1.raw
  modified_base (139)..(139): a, c, t, g, unknown or other
  misc_feature (139)..(139): n is a, c, g, or t
tcagtcgtcgctcgcacgaccggtgctcgatttagtctgacgtcaaagggaaagggggtgggctcaggaggcagagctctgggaatctcaccatggcctggacccctctcctgcctcccccctcctcactttctgcacngtctctgacggcctcctatgagctgacacgacgcccacctcggtgtcgcggttccgccccgaaggtaaccgaaccggaccaaggtacctccgaccgtcgtcctccgtagggtagtacttactacgttaccgaaacctaaaagtaattacgttaacgttgtttcgttaccgagacaaggtagtcgaacggcccgaccggtacccccgtagttacgtacggtacctaccgtcctaggtacggacgaccgtacggtaccgaccggtaccgtaccggtaccggtactacccgtaggaacggtaatccgttacgtctaccgtcccgactccgacgtacggacccgggaagtcgtacccggtcctacgttacgtaacctacggtcggtacgggtccgggtaccggtacgggtacggtaacggtaggtacgtacgtacgtaccggtaacttacggttacgttaccggttacgtacccgtaacgtaacgtacggttaacgtaggggttacgtaccggttacggtacggggttaacgggttaaccgggttcggggtaacgggtacgggtaaccggttaacggttaccgttacccggttacggttaccgtaacggtaccggtaccggaaccggttcccgtaccgtcccggttaccgtccgttacccgtttccggtaccccgttcccccgttacccgg

SEQ ID NO: 112583 - DNA, 777 bp, Homo sapiens
  misc_feature: GYAE6OF02H65CT.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctcccctcctcactttctgcactagtctctgaggcctcctatcgagctgacacacgccacccgttcggtctcgagtccggtccccgggaacaaccggccaggactaccaccgtgctcgtggatagtcgactagttaggaaaaccctaaaaaatttcgttttacggtttttacggtaaccgaaggtacctaaggtaacgtacgaaccgggtaccgtaaccggtccccgtttagggtcgtttacgggtctaaccgttaccgtaagtaacggaacggtaacggaacggggaacgtaaccgtacccccgggtacggttacctacccgtagaaggtacgtactttacgcgtaccggtccaacctacgtacggtaacgggtcggtacgaccgttgttactcgtactaggacggtccgggcgacggggttgaggagtaagtacggccttagaacttacttactaccggtactaccggaagtaaccgagtaacggacgttggtaacggtagtcgttaacgggacggttacggggactaacggggtttccgggaaggggttaacccgtcgggtaccggtacgaccgttacgttaggtaccggaaccgtccgtaacgtcccggtacccggccgttaccgtctccggttactcccgtccgtaccctcccgtcccg

SEQ ID NO: 112584 - DNA, 822 bp, Homo sapiens
  misc_feature: GYAE6OF02IVBNC.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagcctgacacacgcccacccgtcggtctacgagtccggtaccccgggaacaaaccggcccgaggactccaccgtcgtctcgtggactatcgactattacgaaacctaaaaatttcgtttagtttttacggaccagacgaacgtacgtacgacggaccgtaaccggtccccgttaggtcggtttacggtctacgtacctagtacggaacggtaacgagggaccgaacccgtacccgtaccggtacctacccgtaggaggtaacgttacgtttcgtaccgtcggtacccttaccgaaacgtcggaacggggtacggtccggaccgtttacggtacggttacttccgaggttacgggtaccggggtaccgtagggtacggacggtagtaggtaacgtcgtaaccgtacgttacgttaacgttcgttaacctacgacgtaacgaaacggtcgacgtacgtaacggttaccggtacgtacggtaccgggtagggacccggttagtaccggggtacgggtaaccggtacggttaacgggtaccgttaaccggtccgggtaacgtccgtaaccggtaacccgtaccgggtccgttacccggtcccccggttacgtacccgttacccggtacccggtttccccgtaccccggttacccgttcccgttaccccgg

SEQ ID NO: 112585 - DNA, 920 bp, Homo sapiens
  misc_feature: GYAE6OF02ICKTQ.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggccttcctatgagctgacacgacgcccacccgtcggtctcgacgtccggtcccgggaacgaaacggccagggactccgacctgcttcgtagggacgtagtacggctaagttaacgaaaccttaaaaaaaacgttttgtttttggttttttacggaacccaggtacgaaggtaaacgttacgaacgggacccgtaccggtcccccgttaggttcgggtttacgggtcctaacgttacccgtagttaggaacgggggaaacgacggggtaacggaaccggaaccggtaccgtaccccgggggacttccccggtagaacggaaggttacttccgttcgtaccgtcccctaaccggtcgacccggtttacgaacggggtactacggggtccggaacccttaccgtttacgtaaccttacggtaccggacgggggttacccgggggtacccgggagggttaacggggtacggtaaacgggtagtaacggttccggtacgtaaccgtttaaactttaggttttaaccggttaaccgtaccgtaacccgtaacggaaacgttacgggttacgggttacgtacgtacggttaccggggttcggggttaacggttacggggtacggggaaccgggtaacgtaaacgggttaccgttacccgggttactttcgggtaccgtaaccggtacccggtaaccggtcccgtccccgggttccccgttacccggtcttacccggttcccgttacccgttttccccctaccccgttcccctttaccccgg

SEQ ID NO: 112586 - DNA, 883 bp, Homo sapiens
  misc_feature: GYAE6OF02G8D9Z.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgcctcccccctcctctactttctgcacagtctctggacggccctctatgagtctagaccacacgccaccccgtggtgtcagtcgccccaggaccaaccggcaggactccactgctcgaggactattctagtacgaaccaaaagtatacgttacttggttcggtaccaggtacaaggaacgttccggacggaccgacggtccccctacggttaaccgtgggtacctacttacccgagttcgggaaccgtccgaaccggtacccggaacccgtaaccgtacccgggttacccgggtaccgttaccccggttaggtaaccggttagttaccttttacctacccggttaccgtaccccgttcccgacgtaccccggtacgggaacgggtacccaacgggtcccggtaaaccctttaccggttaacggaccgtttaacgacccgggttaggggtaccggggtacccggtacggggtacgggtaaccggtgttaaacggagtcgtaaccgtacgttacgttaacgtttacgggtaccgtaccgtaacgtaaccgtaacggttaggttaaccggttcggttaaccgtaggttaccgggtaggggggtttaccgttcggggaccgggtaacggtaccggttacgggttaccgggttacccgttacggtttacccgggaccgtacccgggtaacggtcccggtacccgttccccggtacccccggttacggttacccttccccggtttacccgtttacccgggtccccccttacccccgg

SEQ ID NO: 112587 - DNA, 829 bp, Homo sapiens
  misc_feature: GYAE6OF02GL1LS.21.30.C08.1.454.CMB.1.raw
  modified_base (249)..(249): a, c, t, g, unknown or other
  misc_feature (249)..(249): n is a, c, g, or t
tcagtcgtcgctcgcacgaccggtgctcgatttagtctgacgtcaaagggaaagggggtgggctcaggaggcagagctctgggaatctcaccatggcctggacacctctcctgcctcccctcctcactttctgcacagtctctgacgcctcctatgacgctgaccacacgcccacccgttcggtactccgtagtcggtccccggggaacaaaaccggccgaaggactccgaccgttcgctcgtacgganagtcgtactattacgaaaccttaaaaaagttttcgtttacggttttttacggaaccgtagtaaccgagtaaacgtcgaccggtaccgtaccggtacccgttggttcggttacggtcctaacgttaccgtaacgtacggggtaacggaacggaacgggtaccgaacccggtacccggtaccggtaaccgttccgaggtaacgtacgttacgttccgttaccgtccggtaccgttaacccgtaaccgggttaacgggacgggggttaccggtaccgggtacccgttacggtttaacgtccgtttaccgtacggggtttaccggggaccggggttccgtaagggggtacggaggtaggtacgacgtcgtaacgtacctacgtaattcgtaacgtcgaacgtcgaacgcgagtctaggtacgcgtacgaggtacgggtactcgggtaccgggacgggtcggtaaaccgtcggggtaccgtacccggttacgtacgggtccgtaacggtacccgtacgggtaccctcccggttccgtaccggtcgtacccggttccgttcccgtacccggtcccctttaacccgg

SEQ ID NO: 112588 - DNA, 932 bp, Homo sapiens
  misc_feature: GYAE6OF02HVDQV.21.30.C08.1.454.CMB.1.raw
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgatctgacacacgccaccctcggtctcagtcgtacccgggaacaaaccggtcaggactccaaccgtgcctcgtaggagatcgctacgttacgaaacctaaaaatttgttttacggtttttacgaaccgtagtacgaagtaacggtaccgtaacggcccgtaacggtcccccttagggtttacgtttacgggtacctaacgttacccgtaagttacgggaacggtaaccgaacggggaaaccggtaaccccggtaacccccgggttccggggtaaaccttcccccggttaaggggtaacgggtaaaccgttaccgttttaccggttacccggttccgggaacccgtttaccccgtaaaacgtttccggggaaacggggggttaccccgggttacgggaccccggtttaacggtttcggtaaccgtttaccgttaaccgggtacggggttccgggggtaccccgtaaggggtggggtaaccggtaacggtacggtaacggtacgttaacgtaacgttaccgtttaaccgttacgttaacgtaccggtaacgtaccgtaacggtaccgtacggtacgtaggttacggtacgttacggtacgggtaacgggtacgtacgggtttccgggacggggtaacggtaccggttacgggtacgttacccgggtacgtaccggtacgtaccggccgtaaaccggtccgtacccggttccccgtaccggttccggttacccgttcccgtttacccggttcccccgttacccgtccccgtttaccccgg

SEQ ID NO: 112589 - DNA, 662 bp, Homo sapiens
  misc_feature: GYAE6OF02FY42X.21.30.C08.1.454.CMB.1.raw
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagcccaccctcggtgtcagtcgtccccgaggacaaacggccaggactcacctgctctggagattcagttcgaccaaaagaatatacttgttcggttcagcagatcagccacggcccctgtactgtcactccgatcgacgccgagtacgatcgacgacgtccgggatcccgngacgagtatttcncgtgccctcgacgctacgacgggactaggtcgccctaccgttcgaacttagtcgtagggtcgggacccgtagggtacggacgtagtagacgtcgtacgactacgttacttcgttacgactaccgagacgtaggtacggtagtacgacgtcgggtagggtttaccggtacgggacgggtacgggtaaccgtaaggttcggtaacccggttccggttacggtaaccgtaccggacccggtaaccggtccgttaccccggtcccccgttacgggttaccccgccggtttaccccggttcccggtttacccccccgg

SEQ ID NO: 112590 - DNA, 955 bp, Homo sapiens
  misc_feature: GYAE6OF02I6L7H.21.30.C08.1.454.CMB.1.raw
  modified_base (169)..(169): a, c, t, g, unknown or other
  misc_feature (169)..(169): n is a, c, g, or t
tcagtcgtcgctcgcacgaccggtgctcgatttagtctgacgtcaaaagggaaagggggtgggctcaggaggcagagctctgggaatctcaccatggcctcgacccctctcctgcctcccccctcctactactttctgcacagtctctggaggtcctctatgagacgtnacacgacgcccaaccgtcggtactcgacgtccggtaaccccgggaactaaaccgggccgtaacggtactacccaaccgttcggctccggttagggacgtcgtacggtactagtttaacccgtaaaacgttaaaaaactttttgggtttttcgggttttttaaccgaactacggtaacggtaaggtaaacgtacggaacgggtacccaacccgggttccccgttaagggttaccggttccgggtaacctcgttaccccggtaagttaccgggaaacggtaaccggaacgggaccggaaccggttaccccggtacccgggtaactcccgggtagtaaggtacgttaccttcgtaccggtcgtaccctctaaacccgtagggaccgggtaacgggtccgtacgttacggttacgtacgttaccggtaggtaaccggggtacgggtccggtaacgggggtagcgggtaaggtacggacggtggttaacggtaacccgttaattaccgttaacttccggtaaacggtaccgtaagttaacggccgtaatacccgggtagtacgtaccgggtacgagggttaacggccggtaacgggtttcggggccggggtaaaccgggttccgggttaaacgggtttacccgggaccgtttaacccggtcgggtaaaccgtacccgggtaaccggaaccgggttccccgggaccccggttacccggtccccttttaacccgggaccccggttttacccggtaccccggtttcccccggtccccgttaaccccgtccccgg

SEQ ID NO: 112591 - DNA, 792 bp, Homo sapiens
  misc_feature: GYAE6OF02HZ2PC.21.30.C08.1.454.CMB.1.raw
  modified_base (178)..(178): a, c, t, g, unknown or other
  misc_feature (178)..(178): n is a, c, g, or t
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
tcagtcgtcgctcgcacgaccggtgctcgatttagtctgacgtcaaagggaaagggggtgggctcaggaggcagagctctgggaatctaaccatggcctggacccctctcctgctccccctcctctactttctcgcacagtcctctgacggcctccttatggacgtctgaccacgacnccctacccgtcggtctcgagtccggtcccggaanaaccggcagtacncactgctntgagntacgtntntnaaactaaaattgtttagttttacgactgactagtacgtacgcggaccgcgtcccgtgttggtcgtacacgtctgacgagacgtacggaccgacccgtacccggtcggtacctccgaggtagttacgaccttcgtactccggactaccgtaggccggtaggggtcggtacgtccggttatacggtctacggtccgtcggggtccggtaaccggtggtaaggggagttagtacggtgtacggtactaacgttcgttaagttcctacgttacacgacgacgttcggacgtacggtagtacgtcggcgtacgggtacggggacgttacgggtacgggtaaccggggtacgtaccgggtttacggtaccggtcccggggtttaaccgtaccgggttaccggacccggtttaacccgggaaccggtccccggtttccccgggtaaccccggttccccggtaccccggttttacccgtttaccccgggggtttaaccccccttttcccccccgggttccccgttttcccccggtttacccgggtttccccg

SEQ ID NO: 112592 - DNA, 849 bp, Homo sapiens
  misc_feature: GYAE6OF02IEU5O.21.30.C08.1.454.CMB.1.raw
  modified_base (670)..(670): a, c, t, g, unknown or other
  misc_feature (670)..(670): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctctctacttctgcacagtctctgagcctctatgacgtctagacacgacgccctaccgtcggtctcgacggtcgtacccgggacaaacggcgaggactccgtaccgtcggcctcgtaggagtacgtagactaagttaccgaaaccttaaaaaaagttttcgtttacggtttttaacggaacctaaggacgtaaggtaacggtccgtaacgggtaccgtaccggtaccccgttaggttcgggttacggttactaacgttacccgtaggttaacgggaaccgggtaacggaaccgggtaaccggtaaccccggtaccccgggttacccggggtaaaccttcccgggtaaacggtaaacgttacgggtaaccgttttcggtaacccggttacggggttaacccctaacggaaaccggtcccgggtaacggggtacccgggtacggtacccgtttaaggtttacggacctttaccggtacgacgggggttaccgggtaccggaaagggttcgggaagtcgtaaggacgtcgtaacgtacttacgtacgtcgtaaccnggacaccgtacgagacgagtagtcgaatacggtagggacggtcgtaggtccgggtaggacggtacagggtaccgtacggtccgtacgtacggacggcggtaccggtaccgtacccggtcccttaccgggtccgtacggtttcccgtaccccggttccctacccccgttcggttaccccg

SEQ ID NO: 112593 - DNA, 754 bp, Homo sapiens
  misc_feature: GYAE6OF02FRUI0.21.30.C08.1.454.CMB.1.raw
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
tcagtcgtcgctcgcacgaccggtgctcgatttagtctgacgtcaaagggaaagggggtgggctcaggaggcagagctctgggaatctcaccatggccctggacacctctcctgcctcccctcctcactttctgcacagtctctagacgcctcctatgagctgacacacgcccaccctcggtctcagtcgtcccggaacaacggccgaggatcacctgctcgtgganatnacattcgaaacctaaaaatttgtttacgtttttagaccagtcaagtacgtcgacggccgtacggtccccgtaggttgttcggtactactcccgattacgggacggtaaccgacgggacggacccctaccccgggtaccgggtacctcccggtagaacgtacgtacgttttcgtcacggtcctaccgaacgtcgggtacgggtacggtcgaccgtacggttatacgtttacgcggtacgggtccgggaccgtaggggttaggggacgtagaaggtaccgtcgttaacgacctaacgttacgttagtaccgtacgtaggcctaaggacgtgaccggtaggtcgaccggttacgacgggggttacgggaccttacgggtccgggggtaacgccggggtaacgttcgggtaaccgtacccgttaggtccgtaacccggccggtacctaaccggggtccctccccgggtcccggttacccgacgttcccggttccgttaccccggtttccccggtccctttacccccgg

SEQ ID NO: 112594 - DNA, 812 bp, Homo sapiens
  misc_feature: GYAE6OF02GU62Q.21.30.C08.1.454.CMB.1.raw
  modified_base (132)..(132): a, c, t, g, unknown or other
  misc_feature (132)..(132): n is a, c, g, or t
  modified_base (472)..(472): a, c, t, g, unknown or other
  misc_feature (472)..(472): n is a, c, g, or t
tcagtcgtcgctcgcacgaccggtgctcgatttagtctgacgtcaaagggaaagggggtgggctcaggaggcagagctctgggaatctcaccatggcctggaccctctcctgctcccctcctcactttctcncacagtctctgacggcctcctatgagctgacacagccacccgtcggtctcagtcgtccccggaacaaacggccaggatccacctgctctgggacagtgacctattcgaaacctaaaaaatttcgtttacggttttttacggtaaccaagtcaaggtagtccgaggcctacggtccccttggtagttcggtcaacttccaagtcggaacgggacacgggaagaccccgtccggtaccggtacctcccgtaggtagaacgttctttccgtcggttcggcctaccgaaacgtccgggtacggggtaccggtcggaacccgtttaggttacgtacgtttcccgngttacggggtccggggtccgtaagggtacgggtacgggtaagtacggtaacgcggttacggttaaacctaaccggttacgtttccggttaaacgttccgaacgtacgtaaccggaaccgtacgggttacgaaacgggtttccgggaccgtacggtttacgggggaaccggggttacgtttacgggggttcccggggagggttaacccgggtaccgggtttacgggtaccggttacccgtccggttaacgtccgtaaccggaccggtacgtcccgggtacccgtccccgtttcgccgttaccctcccggtttccggtaccccgttcccgacccgtacccgg

SEQ ID NO: 112595 - DNA, 858 bp, Homo sapiens
  misc_feature: GYAE6OF02JQ121.21.30.C08.1.454.CMB.1.raw
  modified_base (792)..(792): a, c, t, g, unknown or other
  misc_feature (792)..(792): n is a, c, g, or t
tcagtcgtcgctcgcacgaccggtgctcgatttagtctgacgtcaaagggaaagggggtgggctcaggaggcagagctctgggaatctcaccatggcctcggaccctctctgcctcccctcctctactttctgcacagtctctgagcctcctatcgagctgacacacgccctacccgtcggtctcgtagtcggtaccccggaacgaaaccggccaggactccgactcgctcgtcggagctcgctactacgaaactaaaacttgttttgttttacggaaccacgtagacgtaacgttcgacggtacccgtacggtccccgttaggttcggttacgtacctaacgtcctaaggtacggtaaacggaccggaacggtaaccggaacccgtacccgggtaccggaccgttaccggtaggtaacgtacggttaacgttccttcggtaccgtaccttacccggtaaacctccgggggtaacgggtaccgggttaccggtaccggtttaacggtttaccggtaacgtttcccgggttaaacggttccgggggtaccgggggtaccggttaagggggtccgggtaagtaacggtacggtaaacgttcggtaaccggtacctttaaacgttcgttacccgtaacgtccgtaacggcaaccggtacgttacggaaccgttaggtaccgtaaggttaccggtaaggggtacccgggaccgttagggtaacccgggtcggggtaacgttacccggttaggtaaccccgtcgggttacgtacccgtaacggccgtaaacccggtnttacccgggcccgttcccgtcgtaccgtcgttacccggttcccgcccgttaccctcccggttaccc

SEQ ID NO: 112596 - DNA, 704 bp, Homo sapiens
  misc_feature: GYAE6OF02FL54H.21.30.C08.1.454.CMB.1.raw
  modified_base (228)..(228): a, c, t, g, unknown or other
  misc_feature (228)..(228): n is a, c, g, or t
tcagtcgtcgctcgcacgaccggtgctcgatttagtctgacgtcaaagggaaagggggtgggctcaggaggcagagctctgggaatctcaccatggcctggacccctctcctgctccccctcctcacttctgcacagtctctgacggcctcctatgagctgacacagcccacccgtcggtctcagtcgtccccgggaacaaacggccaggatccaccgtgctctgganagtgcattcgaacctaaaaaatttgttgtttttacggacctagactaagaagtcgaggccgacggtcccctggtacgttggtacatccgatcggaggacgtaggacgaccgtacccgtcgggactccgtaggagagtactctcgtcggtactccactcggagggtacggtcggcctaacgtgtacttactcgtaggtcgggacccgtagggtacgggaggtacgtaggaacgtgtacggtaaccttaacgttacgttaccgttaccacgtacgactaacgacgtacgacgtacggtacgtacgttacggtaccgggacgggtacgtacggtttccggggaacgggtaacggggtaacccgtacgggttacgtacccggttaccggttacgggacgtacccgggacccgaacggttccggacccgtccccgtaacgtctaccgttccgttacccgtccccttaccgcccgtaaccgg

SEQ ID NO: 112597 - DNA, 403 bp, Homo sapiens
  misc_feature: GYAE6OF01DKKVO.8.12.B01.1.454.CMB.1.raw
  modified_base (381)..(403): a, c, t, g, unknown or other
  misc_feature (381)..(403): n is a, c, g, or t
tcagctcgcgtgtccacgaccggtgctcgatttagtagtgtagatttggtgggacgaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaagtgacctctggggccagggaaccctggtcaccgtctcctcagcctccaccaagggcccatcggtcttcccctggcgccctgctccaggacgcacctccgagagcacagccggccctgggctgcctggtcaaggactacttccgacacgcgagctgagcgggctggcaaggcgcatagnnnnnnnnnnnnnnnnnnnnnnn

SEQ ID NO: 112598 - DNA, 382 bp, Homo sapiens
  misc_feature: GYAE6OF01AFCBL.8.12.B01.1.454.CMB.1.raw
  modified_base (376)..(382): a, c, t, g, unknown or other
  misc_feature (376)..(382): n is a, c, g, or t
tcagctcgcgtgtccacgaccggtgctcgatttagtagtgtagatttggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctggggccagggaaccctggtcaccgtctcctcagcctccaccaagggcccatcggtcttcccctggcgccctgctccaggagcacctccgagagcacagcggccctgggctgcctggtcaaggctacttccgacacgcgagctgagcgggctggcaaggcgcatagnnnnnnn

SEQ ID NO: 112599 - DNA, 484 bp, Homo sapiens
  misc_feature: GYAE6OF01ELQUN.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggactcctgagcgattctctggctccaactctgggaacacagccactctgaccatcagcggaccaggctacggatgaggctgactattactgtcgaggcgtgggacagcagcactatgtggtttcggcggaggacagctcgaccgtcttggtcacgccagctcgtccccg

SEQ ID NO: 112600 - DNA, 496 bp, Homo sapiens
  misc_feature: GYAE6OF01D63DK.8.12.B01.1.454.CMB.1.raw
  modified_base (333)..(333): a, c, t, g, unknown or other
  misc_feature (333)..(333): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctntggctccaactctgggaacacagccactctgaccatcacgcggaccaggctacggatgaggctgactattactgtcaggcgtgggacagcagcacctagtgttggtttcggcggagggaccaagcgtgacccgtcgttcggtcagcccaaggctggtcccccg

SEQ ID NO: 112601 - DNA, 773 bp, Homo sapiens
  misc_feature: GYAE6OF01CJA48.8.12.B01.1.454.CMB.1.raw
  modified_base (755)..(755): a, c, t, g, unknown or other
  misc_feature (755)..(755): n is a, c, g, or t
tcagctcgcgtgtccacgaccggtgctcgatttagtagtgtagatttggtgggacaacaggattacgccgcgtctggtgaaaggcaggaccttcaccatctccaaggagactgattccaaaagcgatccgccgtttctaccaaatggacagcctgaaaacccgaggacacacggcgtgtacttactcgccaacaggtttggttcgggaaattccgcgaaaaagtgacctcgtggggcccaacgggaaccctggtactaccggttcgtcctacgaggccctacccaacctaaaggggccccaagtccggttcctttccccccgtgggtccggccccttaggcccttacccgtaacgggaaaccggccggaaaccccgttcccccggaaacgtaccggccaacctacggtccgggtaccccttgggggcccttcggaccctttacggggtacccaaaaggggtacccgttaaccctttaccccggaaccgtaaccgggttcccggaaagggtcccgttacggaaacgggtccggggggtaccttcgggggaccggaaaacggggccggtaccgttaaacgttaacgggcctacgaccgagtacgagtccgaggtcctggacctacctaggaacgtcttacgactacttatacgtcgacgactaggtactacgtccgtacccgtctaccggtcggacggtaacggacgaggtaggactacgacgaccgtacgtagtcggagactcgaccactcgtccngttcacgtctacccgtcc

SEQ ID NO: 112602 - DNA, 568 bp, Homo sapiens
  misc_feature: GYAE6OF01A8V93.8.12.B01.1.454.CMB.1.raw
  modified_base (318)..(318): a, c, t, g, unknown or other
  misc_feature (318)..(318): n is a, c, g, or t
tcagctcgcgtgtccacgaccggtgctcgatttagtagtgtagattccgcgggggctgggccgtcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactcggtcagtctatcaagataacaagcggtaccctnagggactcctgacgcgattctctggctccactcgtagggaacacacgccactctcgaccagtccacgccggacccacggacctacggatcggaggctagacttacttactgtcaggtcggtagggaccagcagctaccgtagttgttcgggtttcggacgggtaacgggtaccaacggtcgtccggaacccgttccgttacgggtacccacggtaccccgtaacgggcccgtcccgggtacccccccggg

SEQ ID NO: 112603 - DNA, 492 bp, Homo sapiens
  misc_feature: GYAE6OF01D1AQZ.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggccatctatcaagataacaagcggccctcagggactcctgagcgattctctggctccaactcgtagggaacacacgccactctgaccatcagcggaccaggcacggatgaggctgactattactgtcagggcgtgggacagcagcacctatggtggtttcggcggagggaccaagctgaccgtctcggtcacgccaaggcgtcgccccg

SEQ ID NO: 112604 - DNA, 505 bp, Homo sapiens
  misc_feature: GYAE6OF01EIQQ8.8.12.B01.1.454.CMB.1.raw
  modified_base (457)..(457): a, c, t, g, unknown or other
  misc_feature (457)..(457): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataaacaagcggccctcagggactccctgagcgattctctggctccaactctgggaacacagcccactctcgaccatcgacgccgggacccaggcgtaacggatgaggctgacttattactgtcgaggtcggtggacgagcagcacgtatggtggtttcggnggacgggacaagctgaccgtctcggtcacgcccaaggctcgtcccccg

SEQ ID NO: 112605 - DNA, 507 bp, Homo sapiens
  misc_feature: GYAE6OF01AU2HQ.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcgccctcagggactccctgagcgattctctggctccaactctgggaacacagccactctgaccatcagcggacccaggctacggatgaggctgactattactgtcgaggtcggtgggacagcagcctactagtgtgggttttcggcggagggaccaaggcgtgacccgttcttcggtcaggacccaaggcctcggtccccccg

SEQ ID NO: 112606 - DNA, 489 bp, Homo sapiens
  misc_feature: GYAE6OF01EGDVU.8.12.B01.1.454.CMB.1.raw
  modified_base (445)..(445): a, c, t, g, unknown or other
  misc_feature (445)..(445): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcgaggcgtgggacagcagcacctatgtggtttcggnggagggaccagctgaccgtctggtcagcccaggctcgtcccccg

SEQ ID NO: 112607 - DNA, 558 bp, Homo sapiens
  misc_feature: GYAE6OF01DCVVR.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggcaagacagccaggatcacctgctctggagataaagttgggggaataaatatgcttgctggtatcagcagaggccaggccacgtccctgtacctggtcatctatcaagataaacaagcggccctacgagggactccctgacgcgtattcgtctggcctccaactcgtagggaacacgacgaccactactacgaccatcgaacggccggacccagggcgtaacggatggacggctgactattactgtcgaggcggtggacgagcagcaccgtagtcggttaggtttcgggcggagggaaccaaggtccgtcgtacccggtccgttagggtaccacggtaccccgaaagggccgtaccggtccccccgg

SEQ ID NO: 112608 - DNA, 425 bp, Homo sapiens
  misc_feature: GYAE6OF01DYSIT.8.12.B01.1.454.CMB.1.raw
  modified_base (398)..(398): a, c, t, g, unknown or other
  misc_feature (398)..(398): n is a, c, g, or t
  modified_base (408)..(409): a, c, t, g, unknown or other
  misc_feature (408)..(409): n is a, c, g, or t
  modified_base (411)..(425): a, c, t, g, unknown or other
  misc_feature (411)..(425): n is a, c, g, or t
tcagctcgcgtgtccacgaccggtgctcgatttagtagtgtagatttggtgggacaacagattacgccgcgtctgtgaaaggcagattcaccatctcaagagatgattaccaaaaagcatcgcctttctaacaaatggacagcctagaaaaccgaggacacaggcgtgtattactgcaactaggtttggtacggaaatccgacaaaaatcgacctcgtggggccacgggaaccctggtcaccgtctcctcagcctccaccaaggcccagtccggtccttccccgtggccgcccctgcctccgagggacgccaccctccgagacgccacagccggcccgtgggctgcctggcaaggtactacttccgacacgcgagcgtgacgcgggctggacaaggcnccgaagtagnngnnnnnnnnnnnnnnn

SEQ ID NO: 112609 - DNA, 524 bp, Homo sapiens
  misc_feature: GYAE6OF01DHZPQ.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcgccctacgagggactccctgagcgattctctcggctccaactctgggaacacagccactctgaccatcacggcggacccgaggctacggatgagctgactattactgtcgaaggcgtaggacagcagctactagtggtcggtttcgggcggacgggaccgaagtccgtcgacccgtccgttcggtaccgacgacccgaacggtccgtccgtccccccgg

SEQ ID NO: 112610 - DNA, 586 bp, Homo sapiens
  misc_feature: GYAE6OF01BMYTE.8.12.B01.1.454.CMB.1.raw
  modified_base (313)..(313): a, c, t, g, unknown or other
  misc_feature (313)..(313): n is a, c, g, or t
tcagctcgcgtgtccacgaccggtgctcgatttagtagtgtagattccgcggggctgggcctcaggaagcagcatcggaggtgcctcaggccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctnacgggactccctgagcgattctctggcctaccaactcgtacgggaacacacgccacgtcctacgacctatccgaacggccgggaacccagggacgtaaccgggagtcggacggcgtgacttattaccgtgtcgagggcgtggggacagcgaacgccaccgttagtcggttcgggttttcggaccgggtacgggaaccgaaggtccgttcggaacccggtttcccgttgggtaccgacggaccccgaaacgggtcccgtacccggtccccccgg

SEQ ID NO: 112611 - DNA, 387 bp, Homo sapiens
  misc_feature: GYAE6OF01C48HX.8.12.B01.1.454.CMB.1.raw
  modified_base (292)..(292): a, c, t, g, unknown or other
  misc_feature (292)..(292): n is a, c, g, or t
  modified_base (378)..(387): a, c, t, g, unknown or other
  misc_feature (378)..(387): n is a, c, g, or t
tcagctcgcgtgtccacgaccggtgctcgatttagtagtgtagatttggtgggacaacagattacgccgcgtctgtgaaaggcagattcaccatctcaagagatgattccaaaagcatcgcctttctacaaatggacagccctgaaaaccgaggacacaggcgtgtattactgcaacaggtttggttcgggaaatccgcaaaatgacctctggggccagggaaccctggtcaccgtctcctcagcctccaccaagggcccatcggtcctcccctggcgccctgctccaggancacctccgagagcacagccggccctgggctgccctggtcaaggctactccgacacgcgagctgagcgggctggcaaggcgcatagnnnnnnnnnn

SEQ ID NO: 112612 - DNA, 521 bp, Homo sapiens
  misc_feature: GYAE6OF01BKCJI.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggactccctgagcgattctctggctccaactcgtgggaacacagccactctcgaccatcagcgggacccaggctacggagtgaggctgactattactgtcaggcgtggacagcacgcactagtggttgggttttcggacgggtacgggaccgaaggcgtcgaccgttccgttcggtcacgacccgaaggcccgtcggtaccccccgg

SEQ ID NO: 112613 - DNA, 748 bp, Homo sapiens
  misc_feature: GYAE6OF01AY2B4.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagaggccaggccacgtccctgtactggtcatctatcaagataacaagcgcctcaggactcctgagcgtattctcgtcggctaccaactccgtagggaaacctacgacgccctaactccgtacgaacccagtaccgaacgggtcccggggaaccccgaacgggtacccgttaacgggaacgttacgggaccgggtaccgttaacggtaaccctttaacgtttaccgttacgggttaccggtaacggggtaccgggttaccgggggaaccgtaacgggttaaccgaacgggtaccctaacccggttacggtttaccggggtttaccggggtttttacccgggggaaccgggggttaaaccgggggtaaaccccgtaaaggggtcccggtttaaccgggtacccccgggttttccccggtttacggggttacccgtaacccgggtaacccccggtaaacgggttccccggttccccgggtacccccccccggg

SEQ ID NO: 112614 - DNA, 395 bp, Homo sapiens
  misc_feature: GYAE6OF01CM37F.8.12.B01.1.454.CMB.1.raw
  modified_base (387)..(395): a, c, t, g, unknown or other
  misc_feature (387)..(395): n is a, c, g, or t
tcagctcgcgtgtccacgaccggtgctcgatttagtagtgtagatttggtgggacaacagattacgccgcgtctgtgaaaggcagattcaccatctcaagagatgattccaaaagcatcgcctttctacaaatggacagcctgaaaaccgaggacacaggcgtgtattactgcaacaggttggttcgggaaatccgcaaaatgacctctggggccagggaaccctggtcaccgtctcctcagcctccaccaagggcccatcggtccttcccctggccgccctgctccgaggacgcacctcgagagcacagccggccctgggcctgcctggtcaaggactacttccgacacgcgagctggacgcggggctggcaaagggcgacatagnnnnnnnnn

SEQ ID NO: 112615 - DNA, 610 bp, Homo sapiens
  misc_feature: GYAE6OF01C7361.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataattgggggataaatatgcttgctggtatcagcagaggccaggccagtccctgtactggtcatctatcaagataaacaagccggccctacgagggactcccgtgagcgtattcctcgtcggctaccaactcgtacgggaacacacgccactctcgaccactcacggaccgggacccagggacgttacggatggaggctggaacttattacgtggtacgagggtcggtagggacaggtaccgacgtaccgaccgttaagttcgggttcgggttttccggggacgggtacggggtaacccgtaagggtccgttaccgggaacccggttccgtttacgggtcccgtaaccggtacccccgaaagggtccccgtcccggttacccccccgg

SEQ ID NO: 112616 - DNA, 544 bp, Homo sapiens
  misc_feature: GYAE6OF01B55A1.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagccggccctcgagggactccctgacgcgattctctggcctccaactcgtagggaaccacgacgaccactctcgacccatccaggcccgggacccgacggcgtacggagtaggaggcgtagacttattactgtcgacggcggtcggacgagcacgcaccgtagttggttggtttcggcgggtaggaccgagcgttcgaccgttccgttacggtcgacgcccgaacggtcgtcccgtcccccg

SEQ ID NO: 112617 - DNA, 574 bp, Homo sapiens
  misc_feature: GYAE6OF01ARADS.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagccggccctcgagggactcccgtgagcgattctctcggctccaactctacgggaacacagcccactctcgaccatccgacggccgggaaccctaggaccgtacggagtggaggctagaacttagttactgtcgaggtcggtagggacgacgtcgagaccaccgttagtcggttagggttttccggaggggtacgggtacccaaggtcgtaccggtacccgttccgttacggtaccgacggtacccgaacgggtcccgtcggtcccccccg

SEQ ID NO: 112618 - DNA, 498 bp, Homo sapiens
  misc_feature: GYAE6OF01BVRY8.8.12.B01.1.454.CMB.1.raw
  modified_base (311)..(311): a, c, t, g, unknown or other
  misc_feature (311)..(311): n is a, c, g, or t
  modified_base (490)..(490): a, c, t, g, unknown or other
  misc_feature (490)..(490): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcgccctnagggactcctgagcgattctctggctccaactcgtagggaacacacgccactctacgaccatcacggaccggacccaggctacggatggaggctgacttattacgtgtcgaggcgtagggacagcagcactatggtggtttcggcggaggacagcgtcgaccgtcgtggtcacgaccangcgtcccg

SEQ ID NO: 112619 - DNA, 792 bp, Homo sapiens
  misc_feature: GYAE6OF01AZR0W.8.12.B01.1.454.CMB.1.raw
tcagctcgcgtgtccacgaccggtgctcgatttagtagtgtagattccgcggggctgggcctcaggaagcagccatcggaggtgcctcagccatggcatggatccctctcttcctcggcgtccgttgcttactgtcacaggatccgtggcctcctatgagctgactcagccaccctcagtgtccgtggtccccaggacagacagccaggagtccacctgctctggagtataatggggaataaagtatgcttgctggtatcagcctagagctaggccacgtccctcgtactggtcgatcgtatcgaagtataaacgaagccggccctacgaggggtactcccgttagaacgtaccgtaagtttcctcgtacgggaccttaaccgaacgtaccgttacggggaaacctaaccgaacgtaccccgtaacgtacccgttacggaacccgtaacgttacccgtaacgggtaccccggggtaaccccgaacggggtacccgttaaccgggtaacgttacgggtaacgggtacccggtacggtaacccgtttaacgtttaacgtaccgggtttacgaacggggtacccgggttacggggaaccgttaacgggaccgtaaacggtaccccgtaacgttacggtttacgggtttacggggttttttaccggggaccgggggttaaaccgggtacccggttaaacgggtccggttccgggtaaaccccggtttacccggttaccggttacggtaacccggttacccgttaaaccgggtcccgtcccgggtaacccccccggg

SEQ ID NO: 112620 - DNA, 638 bp, Homo sapiens
  misc_feature: GYAE6OF01AILHT.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctcgtggagaataaagtgggggaataaatatgcttgctggtatcagcagacggccacggccacgtcccctgtacgtggtcatctatacaagataacacgccgaccctcgacgggtactcccgtgacgtcgtattcctcgtcggcctaccgtactcgtacgggtaaccacgacgccctactccgtacgacccagtccgacgggcccgggaacccgacgggtccgtaacgggactacgggagtaccgttaggaactttacgtttacgtggtacgtagggacgtacgggacgacgacgacgcccttaacggtacgttgggtttacgggtttaccgggacgggaaacggggaccctaaggccggttcccggaacccggtttcgttacggtaccgaccgacccgtacggtcccgtacccggtccccccgg

SEQ ID NO: 112621 - DNA, 577 bp, Homo sapiens
  misc_feature: GYAE6OF01ASDXA.8.12.B01.1.454.CMB.1.raw
  modified_base (131)..(131): a, c, t, g, unknown or other
  misc_feature (131)..(131): n is a, c, g, or t
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (250)..(250): a, c, t, g, unknown or other
  misc_feature (250)..(250): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (532)..(532): a, c, t, g, unknown or other
  misc_feature (532)..(532): n is a, c, g, or t
  modified_base (537)..(537): a, c, t, g, unknown or other
  misc_feature (537)..(537): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (558)..(559): a, c, t, g, unknown or other
  misc_feature (558)..(559): n is a, c, g, or t
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
  modified_base (569)..(570): a, c, t, g, unknown or other
  misc_feature (569)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
tcagctcgcgtgtccacgaccggtgctcgatttagtagtgtagatttggtgggacaacgagattacgccgcgtctgtgaaaggcagattcaccatctcaagagatgattaccaaaagcatcgactttctanaaatggacagcctgaaaaccgnggacacaggcgtagtattactgcaacaggtttggttcggaaatcccganaaaaatcgaccttgtgggccaagggaacctggtcaccgtctcctgacncccgtccacgaagggcccatccggtccttcccctcggaccgtccctgcctaccgcggacgtcacccgtccaacggagccaacgcggtccgacccgtcggaccgtcggcccttggtaccgaaggcctttaaccgtccggactaccgcgacgcgtacgaggtaccgggctcgggactaacggggcctacggacttaaacggcgtcgaacgtcgcgactcggaacgntaccggngtccgagcgtcgacgtcncgacttgccgngacncgaacnccgnttcgagcncgagncgcgcgcncgcgngcgcgcgnngcncnngcanncngngng

SEQ ID NO: 112622 - DNA, 528 bp, Homo sapiens
  misc_feature: GYAE6OF01EM8HL.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccacgtcccctgtactggtcatctatcaagataacaagcggccctcgagggactccgtgagcgattctcgtcggcctaccaactcgtacgggaacacgacgacctactctacgaccatcgacggcccggaccgaggctacggagtgaggtctagacttagttactgtcgaggtcgtgggactagacacgctacgtagtggttcggtttcgggcggacggacaggctcgaccgtcgtacggtcacgccgagcctcgtccccg

SEQ ID NO: 112623 - DNA, 630 bp, Homo sapiens
  misc_feature: GYAE6OF01D8MVQ.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatcacctgctctggagataaagtggggataaatatgcttgcgtggtatcagcagacggccaggccacgtccctgtactggtacagtctatacaagaactaacaacgccggaccctacgacggtactccgtagacgcgtacttcgtcgtcggacctaccaactcgtacgggaaccacgacgacctacctcgtacgaacctagtaccgacgggtacccgggaacccgacggccgtaacgggagtacggacggtctagtaaccttacgtttacgtcgtacgacgggtacggtacggaccgtagacgacgtccgtacgttaggttcggttcgggtttccgggacgggtaacgggacccgtagtccggtcgtacccgttccgttacgggtacccaccggacccgtaacggtcccgtccccggtcccccg

SEQ ID NO: 112624 - DNA, 622 bp, Homo sapiens
  misc_feature: GYAE6OF01ARBO9.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgtcacaggatccgtggcctcctatgagctgactcagccaccctcagtcgtccgtcgtccccaggaccagaccagccaggatcaccctgcctctggagataaagttgggggaataaagtatagacttgctaggtatacagctagaggacaggccacgtccccgtgtacgtaggtctagtctatacaacgattaaacaaggaccgccctacgaggactcctaggacgtcgtactacgtcgtcgcctaccaactcgtacgggaaccacgacgacctacgtctacggacccagttaccgacgtacccgggaacccaacgggtcctaacgggaacgtcggaacggtcctacggtacttaacgttactcggtacgaacgggtcggttacgggaacgtcgacacggtcaccgtaagttggtcgggttcggaccgggtacggacgtacgcgtcgaccggttacgttcggtactacggaccgcggtcctcggtacccccg

SEQ ID NO: 112625 - DNA, 611 bp, Homo sapiens
  misc_feature: GYAE6OF01CN9Q6.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagacggccaggccacgtcccctgtacgtggtcatctatacaagactaacaagcgccctcgacgggactcccgtgacgcgagttctcgtcggtcctacctaactcgtagggaacacgacgccctactctagacctagtaccgacgccgggacccaggcctaacggatgacggtctagtacttagttactaggtcaacggggtcgtagggacgacgctaacgcctacctagttcggttcgggtttaccggggccggaaggggtaccctaagggtccggttcccggaacccggtttcccggttacgggtacccgaacggaccccggtaaacgggcccgttccccggtaccccccgg

SEQ ID NO: 112626 - DNA, 646 bp, Homo sapiens
  misc_feature: GYAE6OF01EEM9Q.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataattgggggaataaatatgcttgctggtatcagcagaggccacggccagtcccctgtactggtcatctatcaagataacaagccggaccctcgaggggactcccctagacgcgtagttcctcgtggtcctaccgaaacctcgtagggaaaccaactacgcccaaccttctcgaacccacgtaccagggacccgggaacccgacgggtccgtaacgggactaggaacggctacgtactaacgttacgtcgtacgacggtacgggtgggacgtacgaccgagaccgaccgttagtggttagggttttccgggacggggtacggggtaacccgtaaagggaccgttaccgggtacccggttcccggtttcgggtaccgtacccgggaccccggtaaacgggtcccgtcccggtacccccccccggg

SEQ ID NO: 112627 - DNA, 540 bp, Homo sapiens
  misc_feature: GYAE6OF01BYGM9.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccaggtcccctgtacgtggtcatctatacaagaataacgaagccggccctacgagggactccgtgagcgattctctcggctaccaactctacgggaacacacgccactctacgaccatcgacgccggaccgaggctacggatggaggctagactagttactgtcgaggtcgtgggacacgcacgactacctagtggttcggtttacggcgggtaggaccgtagcgtcggaccgttccgttcggtcacgacccgacggtcctccggtcccccg

SEQ ID NO: 112628 - DNA, 566 bp, Homo sapiens
  misc_feature: GYAE6OF01C9Z25.8.12.B01.1.454.CMB.1.raw
  modified_base (405)..(405): a, c, t, g, unknown or other
  misc_feature (405)..(405): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccacgtccctgtactggtcatctatcaagataaacagccggccctcgagggactccctgagcgattctctggcctaccaactcgtagggaacacacgccactctagaccatcgacggcccggaccaggactacgganggacggactcggtacttattacgtgtcgaggcggtagggacagcagcctacgtagttggttcgggtttcgggacgggaacgggtaccgaaggtcggtaccggtacccgttccgttacggtaccgacggaccccgaacgggtcccgtcccggtaccccccgg

SEQ ID NO: 112629 - DNA, 557 bp, Homo sapiens
  misc_feature: GYAE6OF01EOMP5.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccacgtcccctgtactggtcatctatacaagaataaacaagccggccctacgagggactcactgagcgtattctcgtggcctacctaacgtcgtagggaacacacgcctactctacgaccatcgaggaccgggacccagggcctacggatggacgctagacttacttactgtcgagggcggtagggacgagcacgacctacgtagtggttgggtttccgggagggtacgggaccaacggtcgtacggtcccgtacggttcggtacgaccggccgaaggccgtacccccgg

SEQ ID NO: 112630 - DNA, 227 bp, Homo sapiens
  misc_feature: GYAE6OF01B80CR.8.12.B01.1.454.CMB.1.raw
  modified_base (220)..(220): a, c, t, g, unknown or other
  misc_feature (220)..(220): n is a, c, g, or t
  modified_base (225)..(227): a, c, t, g, unknown or other
  misc_feature (225)..(227): n is a, c, g, or t
tcagctcgcgtgtccacgaccggtgctcgatttagtagtgtagattcgcagcctgcagcctgatgatttttctacttattactgccaacagtatagtactttttctccggacacttttggccgggggaccaagctggagatcaaacgaactgtggctgcaccatctgtcttcatccttcccgcatctgagacacgcgagctgagcgggctggcaaggcgnatagnnn

SEQ ID NO: 112631 - DNA, 525 bp, Homo sapiens
  misc_feature: GYAE6OF01BJBOI.8.12.B01.1.454.CMB.1.raw
  modified_base (298)..(298): a, c, t, g, unknown or other
  misc_feature (298)..(298): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccaggatcacctgctctggagataaattgggggataaatatgcttgctggtatcagcagaggccaggccagtcccctgtactggtcatctatcaagntaaacaagcgccctcagggatcctgagcgattctcgtcggctccaactctgggaacacagccactctgaccatcacgcgggacccaggctacggatcgaggctgactattactgtcaggacgtcggacagcagcaccgtatggtggttttcggcggtacgggtaccaggcgtcggaccgttcccgttcggttaccgacggaccccgtaacgggccgtcgtcccccgg

SEQ ID NO: 112632 - DNA, 603 bp, Homo sapiens
  misc_feature: GYAE6OF01CSRM3.8.12.B01.1.454.CMB.1.raw
  modified_base (425)..(425): a, c, t, g, unknown or other
  misc_feature (425)..(425): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataatatagcttgctggtatcagcgagacggccaggccacgtccctgtactggtcatctatacaagactaaacaacggccgaccctacgaggactccgtgagctacttctacgtcggcctacctaacgtcgtacggaacacacgccactctacaccatcgaacggcccggacccgaggtaccgacggtanaggacggtctagtaacttagttacgtacggtcgaggtcggtacggacaggacacggacctacgttaggtggttacgggtttacgggacgggacgggaaacccgtaggtccgtaccggtacccgtcccgttacgggacccaccggtacccgaaacggtcccgtcccggttaccccccgg

SEQ ID NO: 112633 - DNA, 641 bp, Homo sapiens
  misc_feature: GYAE6OF01A20IN.8.12.B01.1.454.CMB.1.raw
  modified_base (286)..(286): a, c, t, g, unknown or other
  misc_feature (286)..(286): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtcccaggacagacagccaggactcacctgctctggagataagttggggaataatatgcttgctgtactcagcagacgcaggccacgtccctgtactgtcntctatcaagataacagccgccctagacggactccgagacgccgtattcctcgtcggtacctacctaacgttccgtaacgggaaccaacgtacgaccctacttccgtacgaaccctagtccgtaacggggacccggtaacccgacggtaccggtaacggcgttacggacggtcgtacgaactttacgttatcgggtactacggggtacgtaggacgaggaccgtagacccgtacgttggttaccggttgggtttaccgggacggggtacgggaacctagggcccgttacgggaccccgtttcgttaccgggtcgtacccggacccgtaaccgggtcccgttccccggtacccccgg

SEQ ID NO: 112634 - DNA, 669 bp, Homo sapiens
  misc_feature: GYAE6OF01CUCTU.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagatcacctgctctggagataaagtggggaataatatgcttgctggtatcagcagacgccgaggccacgtccctgtacgtgtcatactatacaagataaacgaacgaccggccctacgaacgggtacctcccgtagtacgacgttacttccttcgtcggtaccctaccgtaaacgtccgtacgggaacaacgacgaaccctctaccgtacgacctaacgtaccggaaccgggaccccgggtaacccgacgggtaccgtaacgggacgtacggacggtactacggtacttaacgttactcggtaacggagggtccgggacggaactagaccgaacgaccctaccgttagttcgggtttcgggttaccggggcgggtaaaccgggaccgtaacggtcgtaaccggttacccggttccggttacgtaccggacccgtacccgaacgggtcccgtccccggtaccccccgg

SEQ ID NO: 112635 - DNA, 385 bp, Homo sapiens
  misc_feature: GYAE6OF01BOK5J.8.12.B01.1.454.CMB.1.raw
  modified_base (279)..(279): a, c, t, g, unknown or other
  misc_feature (279)..(279): n is a, c, g, or t
  modified_base (356)..(356): a, c, t, g, unknown or other
  misc_feature (356)..(356): n is a, c, g, or t
  modified_base (378)..(385): a, c, t, g, unknown or other
  misc_feature (378)..(385): n is a, c, g, or t
tcagctcgcgtgtccacgaccggtgctcgatttagtagtgtagatttggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggtcgggaaatccgcaaaatgacctctggggccagggaaccctggtcaccgtctcctcagccctccaccaagggccccatcggtcttcccctggccnccctgctccaggagccacctccgagagcacagcggccctggctgcctggtcaaggctacttccgacacgcgagctgngcgggctggcaaggcgcatagnnnnnnnn

SEQ ID NO: 112636 - DNA, 741 bp, Homo sapiens
  misc_feature: GYAE6OF01BWSPH.8.12.B01.1.454.CMB.1.raw
  modified_base (448)..(448): a, c, t, g, unknown or other
  misc_feature (448)..(448): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggactcacctgctcgtggagtataaggtggggaataatagtgtcttgcgttaggtactacgacgacgaaggaccggtaccgacggcctaccgtcccgtagtacgtcggtactactactagtacgaacgtaactaacgacggtcccggtacctacgaacgggtacctaccgtaggacgtcgtacttccgtcgtcgtacctacctacgtccgtaaggaaccaccgacgaccctactcgacgaaccnctacggacgggacccggaccgacggtaccgtaggagtacggacgtcgtactaacgttacttacggtcggtaacggcgggtacgggtacggaaccgtaggccgtacggtacccttacggttacgggtttcggggtttaccggggttacccggggaacggggttaacccggtaaccggtaacccggttccgggttaacccggtttaccccggtttcccggttttaaccggacccgtaaccccgggtaccccggttaacccgggttccccgtaaccccccgggtttaccccccggg

SEQ ID NO: 112637 - DNA, 696 bp, Homo sapiens
  misc_feature: GYAE6OF01AHQM0.8.12.B01.1.454.CMB.1.raw
  modified_base (508)..(508): a, c, t, g, unknown or other
  misc_feature (508)..(508): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccaggactccacctgctcgtggagaagtaaaggttagggggaattaaatagtgtcgttgctaggtatcgagcgaggacggcgacggccgtacgtcccgtagtacgtgtactatctatacaagtaactaacgacggccggcctacgaggtacctccgtagacgtacgtacttcgtcgtcgcctaccgtactcgtacgggaacaccgacgtcccacgtctacggaccctagtccgtacgggaccccgggtacccgagggtaccgtaagggacgtaggaacggtctaaccgttaacttagttaccgngtaacggcgggtacggtacgggactacggacgtacgaccgttaccgttaggttccgggttacggggttaccgggacgggtaaccgggtacccgtaaggtcccggttacgggttacccccggtttacggtaccgggtaccccgtaaccgggaccccggtaccgggtccccgttcccccggtacccccgg

SEQ ID NO: 112638 - DNA, 384 bp, Homo sapiens
  misc_feature: GYAE6OF01A7PJ3.8.12.B01.1.454.CMB.1.raw
  modified_base (372)..(372): a, c, t, g, unknown or other
  misc_feature (372)..(372): n is a, c, g, or t
  modified_base (377)..(384): a, c, t, g, unknown or other
  misc_feature (377)..(384): n is a, c, g, or t
tcagctcgcgtgtccacgaccggtgctcgatttagtagtgtagatttggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctggggccagggaaccctggtcaccgtctcctcacgcctccaccaagggcccatcggtcttcccctggcgccctgctccaggagcacctccgagagcacagcggccctgggctgcctggtcaaggactacttccgacacgcgagctgagcgggctggcaaggcnatagnnnnnnnn

SEQ ID NO: 112639 - DNA, 641 bp, Homo sapiens
  misc_feature: GYAE6OF01AU5ZI.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagttggggataaatatgcttagctggtatcagcagacggccacggccacgtcccgtgtacctggtcatctatacaagataacagaccgcctacgagggtactcccgtgacgacgtattcgtcgtacggtcctaccgtaacgtccgtaacgggaaaccaccgaccggtaccctacgtccgtacggacctacgtacgacgggtacccgggaacccgagggtaccgaacggtagtacgggacggtaccgttacgaacctttacgttacgtacggtaccgtagggtccggtaagggacaccggcacggaccgtaacgtcgttggttacgggtttcggacgggtaccgggtaacgtaagtcgtacgttccgttacccgttcgggtaccaccggtacccaacggtccgtcccggtacccccgg

SEQ ID NO: 112640 - DNA, 746 bp, Homo sapiens
  misc_feature: GYAE6OF01AO2NH.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccaggactccacctgctcgtggaacgtaagttaaaggttagggggtaattaaaagttagtcggtctttacggccgttagggtactaccgagacgaaggacggaccgaccggtaccctaccggttcccccgttagtaccgtcggtactacgttcctaataccgaaagtaactaacgaaccggtccgggtaccctacgggacggtacctccgtagacgtacgttacttctcgtacgtcctaccaacgtccgacggaacctacgaccacctacgtccgtaccgaacctacgtaccggacgggtacccgggaaccgtacggtaccggtacggtacgacgggtacgtacgttacgtaaccttacgtttacggacggtacggacgggtacgggtacggtaacacggtacgtaccgtacgttaccgttagggttcgggttacgggttacgggaccgggtaacggtaccgtaggtacccggtacggtacccgttcgggttaccgaccgtaacccggtaccgaccggttcccggtccccggttaccccggg

SEQ ID NO: 112641 - DNA, 749 bp, Homo sapiens
  misc_feature: GYAE6OF01D8ACA.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtcccaggacagacagccaggactcacctgctcgtaggagtaagtaaaggttaggggaattaaatagtgtcttgcgttggtatcagcgaggacggccacggcctaccgtccctgtacgtcggtactactctatacaaagaactaacgaacgccggtaccctacggacggtacctccgtaggacgtacgtacttcctcgtcggtacctaccgtaacgtcgtacggaaaccaccgacgtaccctactccgtacgaaccctaacgtaccgaccgggacccgggtaaccccgacgggtaccgtaacggtagtacggtacggtacgtacgtaacctttaacgtttacgtacggtacgggacgggtacgggttacgggaacgtaccggacgtacgaccctaccggtttaggttacggggtttccggggtttaacccggggaacggggttaacccgggaaacccgtaacgggttaccggttaacccggttaccccgggtttaccgttaccggggtacccaacccgggtaccccggtaaaccggtccccggttacccccggttccccccgg

SEQ ID NO: 112642 - DNA, 578 bp, Homo sapiens
  misc_feature: GYAE6OF01B4BVI.8.12.B01.1.454.CMB.1.raw
  modified_base (418)..(418): a, c, t, g, unknown or other
  misc_feature (418)..(418): n is a, c, g, or t
tcagctcgcgtgtccacgaccggtgctcgatttagtagtgtagattccgcggggctgggcctcaggaagcagcatcggaggtgcctcagccatggcatggatcctctcttcctcggcgtccttgcttactgcacaggatccgtggcctcctatgagctgactcagccaccctcagtgtccgtgtccccaggacagacagaccaggatcacctgctctggagagtaaagttggggaataatatgcttgctggtatcagcagacggaccgaggccacgtccctgtacgtggtcatctatcaagactaacagcgaccctacgaggtctccgtgacgtcgattcgtcgtcggcctaccaacgtcgtacgggaacacgacgaccactccgacgacctatccgaacgggtcccgggaaacccgngggtacctaacgggacgtggaacggtctacggaacttagttaccgtgtacgaacggggtcgtacgggactagccacgtcaccgtgtacggttgggttcggacggtacggaccaagtcgacgtccggtcttcggaccagacccgagtccgtccgtccccgg

SEQ ID NO: 112643 - DNA, 548 bp, Homo sapiens
  misc_feature: GYAE6OF01A8OHU.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcggccctcagggatccctgagcgtattctctcggctccaactctggaacacagcctactctagaccatcgacggtaccgggacccagggacctaacgggataggaggctacggactaattactgtcgagggtcggtagggacagcagcctacctaagtggttcgggtttccgggacgggaagggtaccgaaggccgtgacccgttccttagggtccacgcccaagggcctccggtccccccgg

SEQ ID NO: 112644 - DNA, 696 bp, Homo sapiens
  misc_feature: GYAE6OF01DBOAK.8.12.B01.1.454.CMB.1.raw
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcactgctntgganaataaagtggggaataaatatgtcttgcgtggtactcagcaggacggccgacggccacgtcccctgtactggtcatctatacaagtaactaacgaacgccggaccctacggacgggacttcccgagacgacgtacttctcgtcgtcctacctaacgtcgtacgggaaacaccgacgacccacttcgacgaaccacgtacgacggacccgggaacccgacgggtacgtaacggacgtagggacgtaccgtagtaacctttacgtttaacgtcggtaacgggtacgggaccgggttaacgggaaccgaacggtaccgaaccggtaacccgttaacgttaacgggtttcggggttttaccggggttttcgggaacccggggtaacgggtaaccgtacgggttacccgtacggttacccggttccggtttacggacccgtaaccggaccccgacggtcccgtcccggttaccccccgg

SEQ ID NO: 112645 - DNA, 628 bp, Homo sapiens
  misc_feature: GYAE6OF01CMWEH.8.12.B01.1.454.CMB.1.raw
tcagctcgcgtgtccacgaccggtgctcgatttagtagtgtagattccgctgggctgggcctcaggaagcagcatcggaggtgcctcagccatggcatggatccctctcttcctcggcgtccttgcttactgcacaggatccgtggcctcctatgagctgactcagtcaccctcagtgtccgtgtcccaggacagacagccaggatcacctgctctggagataaagttggggataaatatgcttgctggtatcgagcagaggccgacggccacgtccccgtgtactggtcatctatacaagataacgaacgccggaccctacgaggtactcccgtgacgcgtacttcgtcgtcgccttacactcgttacggaaccacgaccgacctaccgtctacgtacccagtccgaacggacccggggtaaccccgagggtacccgtaacgggacgtagggacggtccgtacggtaaccttaacgtttaccgttacggtaccgtacgggtcgggtacgggacgacgctacgacctaccgtacgttggttccgggtttacgggacggtacgggtacccaaggtccgtacggtacccgttcggttacggacccaggtaccccgaggtcccgtccccgg

SEQ ID NO: 112646 - DNA, 395 bp, Homo sapiens
  misc_feature: GYAE6OF01CYM6C.8.12.B01.1.454.CMB.1.raw
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
  modified_base (380)..(395): a, c, t, g, unknown or other
  misc_feature (380)..(395): n is a, c, g, or t
tcagctcgcgtgtccacgaccggtgctcgatttagtagtgtagatttggtgggacaacagattacgccgcgtctgtgaaaggcagattcaccatctcaagagatgattccaaaaagcatcgcctttctacaaatggacagcctgaaaaaccgaggacacaggcgtgtattactgcaacaggtttggttcgggaaaatccgcaaaaatgacctctggggccagggaaccctggtcaccgtcncctcagcctccaccaaggcccatcggtctccccnggcgccctgctccaggacgcacctccgagagcacagcgcctgggctgcctggtcaaggactacttccgacacgcgagctgacgcgggctggcaaaggcgcatagnnnnnnnnnnnnnnnn

SEQ ID NO: 112647 - DNA, 663 bp, Homo sapiens
  misc_feature: GYAE6OF01AL65E.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagacggccaggccacgtcccctgtactcggtcacttctatacgaagaactaaacaacggccggtacccctcgacggggtactccccgtaggtacggccgtacttccgtcgtcggcctaccgtaactccggtacgggaaaccaccgacggaccctaaccgtccgtacgaaccctagtccgaacgggcccgggaaccccgtagggaccgttaacggacgtggacggtctagtaccttacgttactcgtacggagggtccggtacgggaacctaggaccgacgtccgtaaccgttaggttgggttaccgggttttccgggacggggtaacgggtacccgaaggtccgtacggtacccggttcgttcgggtaccgaccgacccggtaacggtccctcccggtacccccgg

SEQ ID NO: 112648 - DNA, 471 bp, Homo sapiens
  misc_feature: GYAE6OF01EZHQ9.8.12.B01.1.454.CMB.1.raw
  modified_base (87)..(87): a, c, t, g, unknown or other
  misc_feature (87)..(87): n is a, c, g, or t
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (333)..(333): a, c, t, g, unknown or other
  misc_feature (333)..(333): n is a, c, g, or t
  modified_base (450)..(471): a, c, t, g, unknown or other
  misc_feature (450)..(471): n is a, c, g, or t
tcagctcgcgtgtccacgaccggtgctcgatttagtagtgtagatttgggtggggacaacagattacgccgcgtctgtgaaaggcanattcaccatctcaagagatgattaccaaaagcatcgcctttctaacaaatgggacagcctagaaaaccgagacacaggcgtgtatactgacaacgtaggttggtacggaaatccganaaaaatcgacctcggtggggccgtaacgggaaccctggtaccaaccgttcctcctacacgtccctaccaacccgaagggccctagttccggtccttccctcgtcggaccncccgtncctccgagggacnccaaccgtccgagacgccaacacgggtccggcccgtgggctcggcctaggacaagacgtttattccgaacacggcgagctaggacggccgggcgtggacgaacgcgtacgaatacgnnnnnnnnnnnnnnnnnnnnnn

SEQ ID NO: 112649 - DNA, 817 bp, Homo sapiens
  misc_feature: GYAE6OF01DBOOU.8.12.B01.1.454.CMB.1.raw
  modified_base (538)..(538): a, c, t, g, unknown or other
  misc_feature (538)..(538): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctctatgagctgactcagcccacctcagtcgtccgtcgtccccaggacacgacagaccgaggacttccaacctcgtcctggtaggaagaagttaaaaggtagggggtaaaattaaagtaagtggttacgttggtacgttaggttaattacggacgaccggaaggaccggaccgacgggaccctaccggtcccgttagtactcggttacctaataccttaataaccgaagttaaacaaaccgaccgggacccgtacccgtaacggacgggtaccttacccgtacggacgttacgtacttccgtaccgttacggtaccctaaccgtaacgtttaccgggaaaccgggaacctaccgtaacccgtacctacccgtacccgttaccgtaaacccncgtaaccgggtaacccgggaacccccgggtaccggtaacgggaacccggttaggaaccgtgggtaaccggttacgtacgttaaccgttacgttactcggggtaacggtcgggttacggacggaacgtaccgaacgttaccggactttacggtacggttccgggttaggggtacccggggaagtacccgggtaccgtacggtaccgtccggttacccggttacggttaccggtaccgtacccggaacccggttccggtcccgtaaccccggttcccccgg

SEQ ID NO: 112650 - DNA, 679 bp, Homo sapiens
  misc_feature: GYAE6OF01EC6PS.8.12.B01.1.454.CMB.1.raw
tcagctcgcgtgtccacgaccggtgctcgatttagtagtgtagattccgcgggctgggcctcaggaagcagcatcggaggtgcctcagccatggcatggatccctctcttcctcggcgtccttgcttactgcacaggatccgtggcctctatgagctgactcacgccaccctcagtcgtccgtcgtccccaggacagacagccaggactcacctgctcgtggagagtaaagtggggaataatagtgtcttgcgtggtatcagcagacggcgacgcctacgtccctgtacgtgacatactactacaagtaactaacgaacgccgacctacgacggtacctccgtagacgcgttattcctacgcggtcctaccacgtcgtacgggtacacacgcctaccgtctacgaccctacgtaccgaacgggtacccggaacccgtacggtaccggttaacggcgtacgggtacggtaccgttagtaaccgtttaacgttacgttcggtaccggaacgggtaccgggtacgggaaccgtacggaccgttacgacccgttacggttacgttcgggtttcgggtttaccgggacgggtaaccgggtaaccgtaggcccgttacggtaccccggttaccgttacggtacccgtacggtaaccccgtacgtcccggtccccgtacccccggg

SEQ ID NO: 112651 - DNA, 811 bp, Homo sapiens
  misc_feature: GYAE6OF01DMQRJ.8.12.B01.1.454.CMB.1.raw
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
tcagctcgcgtgtccacgaccggtgctcgatttagtagtgtagattccgcggggctgggcctcaggaagcagcatcggaggtgcctcagccagtggcatggactccctctcttccgtcggcgtccttgctttactgacacgaggactccggtcggccttacctagtggacgtctagactcgacgcccaccctagagtccgtccggtccgtaccccgagggaaccacggacgacgaccgaggtaactccaccgtcgtctaggtaggaaagtaaggttaaagggtagggaaattaaagtntcggtacttggacgttacgggtanaccgagccggaacggtacggaccgaccggaccgttaacccggttcccgtaggtacctcggttacctaagtactaactaagaaacgtaactaaccgacggtcccgtaccctaaggacggtactaccgagtaccgcgttatccgtcgaccgtacctaaccgtaaggtcgtaacgaaccgtacgtacccaaccgttctacgtaaccgaacgtaccggaccggaacccgggtacccggaaccgtacggaaccgggtaacgacgtaacggtaacgtacgtaacgttaccgtacgttacggtacgggtaacggacggggttacgaccgggtaacgacggtaccgtaaccggttcgttaaccggttacgggttgggtttaacccgggacgggggtaaaccgtaccggggaaccttacggtccggttaccggtaccccgggttcggaacggtacccggaccgtaaccggacccgggttcccacccccggttaccggg

SEQ ID NO: 112652 - DNA, 670 bp, Homo sapiens
  misc_feature: GYAE6OF01BD6AW.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacacgccaggactccacctgctcgtggaagataaagttggggaataaagtatgacttgcgtggtactcgagcaggacggccacggccacgtcccctgtacgtcggtcagtctatacaagaactaacgacgccgcctacgacggtactcccgtagacgtacgtacttccgtcgtacggtcctaccgaaccgttcgtaacggtaaccaccgaaccgtacccgtacttacccgtacgaaccctacgtaccggaacgggtaccccgggaaccccgtagggtacccgtaaccggagttacggacggtcctaacggtaaccttacgtttacgtcggtcgaacgggtcggtacgggacacggacacgtaccaacgttcggtggttcgggttccggacgggtacggactacggcgttaccggacccgttggttaccggcgtaaccccgaccggaacgtccccgtcccggtccccccgg

SEQ ID NO: 112653 - DNA, 658 bp, Homo sapiens
  misc_feature: GYAE6OF01CR06O.8.12.B01.1.454.CMB.1.raw
  modified_base (175)..(175): a, c, t, g, unknown or other
  misc_feature (175)..(175): n is a, c, g, or t
  modified_base (322)..(322): a, c, t, g, unknown or other
  misc_feature (322)..(322): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctnagtcgtccgtcgtcccaggacagacagccaggataccacctgcgtacgtagggataagttaaaaggttgggggaaattaaagtatggtacttgctggtactcgagcaagcggaccacggccagtcccctagtacgtgtacatactanacgaagtaacaacgaacgcggaccctgaaggctccgagagcgtattcacgtcgacctactaacttcggaggaaccagtaccgactacctacgtaccgactagtaccgaacgggaccggaccaacgggtacgtacgggagtcggacgtctacgtaacgtttataacggtgtaaccgggagtccgggtaggaacacggtacgacgttaccgaacgttacggtacgggtttacgggttccggggaacgggtaaccgggaccgtaaggttccggtaccggtaacccttccggtacggtacccgaacggacccgttaacggcccggtcccgttaaccccgg

SEQ ID NO: 112654 - DNA, 831 bp, Homo sapiens
  misc_feature: GYAE6OF01B6BU8.8.12.B01.1.454.CMB.1.raw
  modified_base (761)..(761): a, c, t, g, unknown or other
  misc_feature (761)..(761): n is a, c, g, or t
  modified_base (770)..(770): a, c, t, g, unknown or other
  misc_feature (770)..(770): n is a, c, g, or t
  modified_base (812)..(812): a, c, t, g, unknown or other
  misc_feature (812)..(812): n is a, c, g, or t
tcagctcgcgtgtccacgaccggtgctcgatttagtagtgtagattccgcggggctgggcctcaggaagcagcatcggaggtgcctcagccatggcatggactccctcttcttcctcggcgttccttgcttactgcacaggtatccggtggtcctacctagtggacgtctacgacctaccgacgtcccctaccctcgtacggttccggttcccggtacgtacccccgaggaaccagacgacgaccgtaggaacttccacgtcgtcgtacgtaggtaagtaaagttaaagggttaggggtaaattaaagttacgttcgtcgttagtacgttacggtactacggacggaccgaagggaccggaccggaccggtacccgtaacccggttccccgttacggttaccgtacggttaccttacttaactttaacgaacgtaaagtaaccgtaaacggacccgggtcccgtaaccgtaagggtaaccggtccttaccggtacggacggttacgtacgttaccgtccgtacggtacccttaaccgtaacgtacggtaaccggaaccacgtaccgtacccgtaccgtcctaaccggtacctaacggggtaccgaaccccgggggaacggttaacccgacgggtttaaccgaccggtaaggtccgggaaacttcgtaaccttaaggtttaacctttggaacccggttggtaacgggcggtaacgactcgaccgtgacctttaggtacgggttgtaccgggttcgggaacgngtaacccgngttaccggtcgttacccgtgttaacggccgaccgtacccggngtccccggtaccgttcccg

SEQ ID NO: 112655 - DNA, 686 bp, Homo sapiens
  misc_feature: GYAE6OF01BAOSI.8.12.B01.1.454.CMB.1.raw
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatcacctgctctggagataagttggggataatatgctgctgtatcagnagngcgacggccacgtccctgtacgtgtcactctatanaagataacgaggccgccctcgaggactccgtagacgcgtacttccgtcgtcggtacctaccgtaacgtccggtaacgggaaaccaccgacggacccaccttccgtacgaccacgtaccgaccgggacccgggaacccgacgggtaccgtaacgggacgttacgggacggtaccgtacgtaccgttaagttacgttacgtacgggtaacgggaccgggttacggaccgtaacgacgaacgtacccgtacgttacggtttacggggttaccgggttttacggggaccggggtacgggtaacccgtaacgggtacccggttaccgggtaccccgtttaccggttccgggtaccgtaccggaccccggtacgggtcccgtcccccggttccccccggg

SEQ ID NO: 112656 - DNA, 642 bp, Homo sapiens
  misc_feature: GYAE6OF01DO80I.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtcgtccccaggacagacagccaggactcacctgctctggagtataaagttggggaataatatgacttgctggtactcagtcaggaggaccgaggccacgtcccgtgtacgtggtcatctatacgaaagactaaacacggccggaccctacgacgggactccgtgacgcgtattcctcgtcggccctaccaacgtcgtaacgggaacacgacgacctacttaccgtacgaacccactaccggaacggaccccgggaaccgacgggtaccgtaaggacgtaggacgtcgtacgaactttacgtacgtacgcggtacgggtacggtacgggacacggactacgtaccgtacgttaaggttcgggtttacgggttcgggacgggaaccggtaacgacgtcggttacggacccgtttaccggtacgtcccgaaacgcccgtaacggccccttcccggtacccccgg

SEQ ID NO: 112657 - DNA, 875 bp, Homo sapiens
  misc_feature: GYAE6OF01C36E9.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccacctcagtcgtccgtcgtccccaggacagacagccaggatccacctgctctggagataaagttaggggaattaagtagtgtcttgacgttggtataccgtagacgaaggacggaccgacggacccgtaccggtcccccgttaggtaccgttacggtacctaattccttaacgtaccgaaaggtaactaaaaccgaacgggtacccggaccccgttacgaacggggtaccttaccccggtagaacggtacgttaacgtttccgtaccgttacggtacccttaacccgtaaaccggttcccggttaacggggaaacccctaccgtaaaccggtaccccttaaccgtttaccgttaacccgggaaacccctaacggtaccccgaaacccgggggacccccggggaaccccggtaagggtaaccccggtaaccgggggtattacggggtaaccgggtaccgtttagtaacccgtttttaaacgttacccggttacgggttaccgggaacgggtaccgggttaaggggacccgtacggtacggaaccgttacccgttaaccgttagggttttccggggttttacggggtttaccggggaaccggggtaacgggaaccccgttaaagggcccggtttacggaccccggtttccggttacggtacccgttaaccggaccccgtaacgggtcccgtccccgggtaccccccggg

SEQ ID NO: 112658 - DNA, 899 bp, Homo sapiens
  misc_feature: GYAE6OF01AY79H.8.12.B01.1.454.CMB.1.raw
tcagctcgcgtgtccacgaccggtgctcgatttagtagtgtagattccgcgggcgtgggcctcaggaagcagcatcggaggtgcctcagccatggcatggatccctctcttcctcggcgtccttgcttactgcacaggatccgtggcctcctatgagctgacctcgacgcccaccctcagtcgtccgtcgtccccaggaccagacacgcctaggactcacctgcctcgtaggagtaagttaaggttggggaattaaatagtcggtcttaggtcgttagtacgtcgaggacgaacggacggccgaacgggtccctaaccggtccccgtagttaccgtcgggtactacgttacgtaacgacgtaaaacgaacgtaaaccggaacgccccgggtaacccttaacgggaccgggtaacccgttacccggtaggtaccgttaccggtaacttccgttcgtacgtacccgtaaccgtacgtaccgggtaccgggaaacaaccgcccgttaacctaccgtactaaccggtaacctaacgtccccggaaaggggtacccccggtaaacggtaccgggaaccgttaaccgggacggttacggtaaacccggggtcttaccggtaacctttaaccgtttcgtacccgggtagggaccggtttaacccggggacgtaacccgaacgggaccgttaccgtacccggtttaacggttaaccggggtttcccggtttaacggggggtaccccggggtaaaacccggggttaccggggtaaactaacccccgggggttcgtttaaacgggttaccccccgggttaaacgggttttccggggaaacccccggttacccggggtaaccccggtttaaaccccggggtcccggtttccccccccggtaacccggggg

SEQ ID NO: 112659 - DNA, 763 bp, Homo sapiens
  misc_feature: GYAE6OF01D7HKV.8.12.B01.1.454.CMB.1.raw
  modified_base (733)..(733): a, c, t, g, unknown or other
  misc_feature (733)..(733): n is a, c, g, or t
tcagctcgcgtgtccacgaccggtgctcgatttagtagtgtagattccgcggggctgggcctcaggaagcagcatcggaggtgcctcagccatggcatggactccctctcttcctcggcgtccttgcttactgcacgaggatccgtggcctcctatgagctcgactcacgcccaccctctacgtcgtccgtcgtaccccgaggacgacggacacgaccgaggactccacctgcctcgtaggaagtaagtaaaggttagggggtaaattaaagttacgtacgttcgttggccgttaggtactacgagacgacggacggaccggaccggccgtaaccggttcccctaggtttaccgttgggtacctacttctaactacgaaagtaacgtaaacgaacggcccggtaccgtacggacggtactccggtacggacgtacgttcttaccgttcggtcgacccttaccgtacgtacggacggtaaccacgtacccgacctacctacgtaccgaacctcgaaccggacccgggccccggaacccgagtaccggtaggagacggtaccggcttacgtaaccttacgtttcgacgttccgagggttaccgggacgaacggtcgaaccgcttacccggtaaggtttggttcggggtttaccgggggttaccggaggggaacccgtaaccggtcgtacccggtcgggttaccccggttgttaccgggaccgtaccccggggtanaccccgggttctccccccggttacccccgg

SEQ ID NO: 112660 - DNA, 707 bp, Homo sapiens
  misc_feature: GYAE6OF01ANOEB.8.12.B01.1.454.CMB.1.raw
  modified_base (337)..(337): a, c, t, g, unknown or other
  misc_feature (337)..(337): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtgtccgtgtccccaggacagacagccgagactcacctgctctggagataagtaggggataaatatgcttgctgtatcagcagacggcacgccacgtccccttggacgtaggtctatctaatacgaagaactaacaacgtcggaccctagacggactccgngacgcgtactctcgtcggcctacctaacgtcgtacggaacacacggtacccactctacgaccacgtcgacggtacccgggacctacgggaccgtaacggagtacggacggtacgtacgtaacgttaactttacctaccggtttacgggaacgggttaccggggacgggaacggtaaccggtccggaagtaccccgttaaccgtttaaaggttccggggtttacgggggtttaccggggaaccggggggaaccggggttaacccggaaacccgggttacgtacccgggttacccggttacgggtttaccggtaaccggtacccgtaaacccgggttacgggtacccccgttccccggttaaccccccgggg

SEQ ID NO: 112661 - DNA, 764 bp, Homo sapiens
  misc_feature: GYAE6OF01DGDLG.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtcccgaggacagacgacgccaggactccacctcgctcgtaggagtaagtaaaggttggggaataaatagtgtcttgcgttaggtatcgagacgacggacggaccgtacggacccgtaccggttccccgttaggtaccgttggtactacgttacttaactacgtaaagtaacgtaaaccgaaccggtaccggtaccccgtacggtaaccgggtacctacccggtgacggtacgttacttcgtccggtcgtcctacctaaccgtcggtaacggaaccacgcctacctctaccgtaccgaccacgtacggacccgggacccgggaacccgacgggtaaccgtacgggtagtacggtaccgggtacgtaacgttaaccttttaagtaccgttacgttacgggaacgggttccggggtaaggaccgaccggtaccgacgttacccgttaccggtttacggttaggggtttaccggggtccggggacgggtaaccggtaaacgtacggttccggtaccgttacccggttcggtacgtaccggtaacccggccgtaaccgggtccccgtacccggtcccccgg

SEQ ID NO: 112662 - DNA, 787 bp, Homo sapiens
  misc_feature: GYAE6OF01BY39X.8.12.B01.1.454.CMB.1.raw
  modified_base (146)..(146): a, c, t, g, unknown or other
  misc_feature (146)..(146): n is a, c, g, or t
tcagctcgcgtgtccacgaccggtgctcgatttagtagtgtagattccgcggggctgggcctcgaggaagcagcatcggaggtgcctcagcccatgtcatggatccctctcttcctcggcgtcctgcttactgcacgaggatccgnggccctcctatgagctgactcacgcccaccctcagtcgtccgtcgtcccacggacacgacgacgccgaggtactaccaccgtcgccttcgtagggtaagtaagttaaaagggttagggggtaaattaaacttagtagtccgtttaggtccgttaggttaacaccgtacgtcgaacggcggaccgtccggacccgtaccccgtcccccgttaggtaccggttacggttacctaacgttacgttaacgtaacgtaacgtaaacgaaccgaccggtaccccggtacccgtaccggtacgggtacccgtcccggtaggtaccggtacgtctttaccgtcgtcggtccctaaccgtacccgtacggacggtaaccaccgtcacccgtactccgtaacgaccctaggccgaccgggtaccccgggaccgacgggtaccggacggtagtccggtaagtccgttaagtccttacgtttacgcggttacgaggtaccggtacggacacggtacctaacgtcgtttacgttagggttcgggttaccgggtcgggaacggtaccggaccgttaccgggtcccggttacgttcccgggtacgttcgggaaccccgacggtaacccgtccggtacccctcccgggtacccccgg

SEQ ID NO: 112663 - DNA, 652 bp, Homo sapiens
  misc_feature: GYAE6OF01CEQMA.8.12.B01.1.454.CMB.1.raw
  modified_base (275)..(275): a, c, t, g, unknown or other
  misc_feature (275)..(275): n is a, c, g, or t
  modified_base (441)..(441): a, c, t, g, unknown or other
  misc_feature (441)..(441): n is a, c, g, or t
  modified_base (482)..(482): a, c, t, g, unknown or other
  misc_feature (482)..(482): n is a, c, g, or t
  modified_base (503)..(503): a, c, t, g, unknown or other
  misc_feature (503)..(503): n is a, c, g, or t
  modified_base (529)..(529): a, c, t, g, unknown or other
  misc_feature (529)..(529): n is a, c, g, or t
  modified_base (542)..(542): a, c, t, g, unknown or other
  misc_feature (542)..(542): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctctatgagctgactcagcccaccctcagttcgtccgtcgtcccccgaaggaccagaccacgccaggactccgacctcgctctaggagaagtaaagttggggaataaagtatagtcttagcttggtanacagacaggacgaccgacggaccaccgtcccgtgtaccgtggtcactctacacgaagtaactaacgtaacggccgtacccgacgtacgggtactccggtaggacgtcggtactttaccggtcgtacgggtccctaccgtaaccgtacggtaacggaacaccgtacnccaacgttccaggacctacgtacgacgggaccccggtaacncgggtacaccggtataacggngactaggactttacgtacgtgtacgngggtccacggacngacgcgtacctattcggtaggtttccgtacggggctaacggcgaaccgttcggtgtacccggccgtttacggaccgttacccgaggacgtccccgtcccggttaccccgg

SEQ ID NO: 112664 - DNA, 635 bp, Homo sapiens
  misc_feature: GYAE6OF01EOWXK.8.12.B01.1.454.CMB.1.raw
  modified_base (291)..(291): a, c, t, g, unknown or other
  misc_feature (291)..(291): n is a, c, g, or t
  modified_base (470)..(470): a, c, t, g, unknown or other
  misc_feature (470)..(470): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctagtgagctgactcagccaccctcagtgtccgtgtcccccaggacagacagccaggatcacctgctctggagataaattgggggataaatatgcttgctggtatcagcagaggccaggccagtcccctgtactggttcanctatcaagataacaagcgaccctacagggatccctgacgtacgattcctactcgggaccttacccgaacttccgtagggaaaccaccgtacggacccaacgttctcgaaacccagtaccacggacccgggaacccaagggtcctaaccggatacggaaggctaggacttaatttaccgngtacgacggtacgggtcggacgaggacacgaccgtaacccgttatcgggtttcggttttacggggccggtaacgggaacccgtaaaggcggttaccgtaaacccggttcccgttacggttccgacggtaaccccgtaacgggccgttaaccggtaccccccccgg

SEQ ID NO: 112665 - DNA, 651 bp, Homo sapiens
  misc_feature: GYAE6OF01AHJN1.8.12.B01.1.454.CMB.1.raw
  modified_base (137)..(137): a, c, t, g, unknown or other
  misc_feature (137)..(137): n is a, c, g, or t
  modified_base (210)..(210): a, c, t, g, unknown or other
  misc_feature (210)..(210): n is a, c, g, or t
  modified_base (448)..(448): a, c, t, g, unknown or other
  misc_feature (448)..(448): n is a, c, g, or t
  modified_base (530)..(530): a, c, t, g, unknown or other
  misc_feature (530)..(530): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
  modified_base (559)..(559): a, c, t, g, unknown or other
  misc_feature (559)..(559): n is a, c, g, or t
tcagctcgcgtgtccacgaccggtgctcgatttagtagtgtagattccgcggggctgggcctcgaggaagcagcagtcggaggtgcctcagccatggcatggatcctctcttcctcggcgtccttgcttactgcacnggatccgtcggcctccgtatgacgcttgactcagccaccctcagtcgtcccgtgtccccgaggacgacgaccncgcccgaggactccaccgtgctcgtaggacgaagtaagttgggggaattaaacttagtcggtcgttcgtcgttggtactccgagacgagacggccgtacggccctacgttccccgtgttaccgtggtctacttctactacaagtaactaacgtaacggtccggacccttacggacgggtacctcccgtagacgccgttacttcgtcgtacgtcgtaccactcgtacggaacctcgacncctactcgtcaacctgaccgacggccccggaaccgcggtaccgtaacgcggtacggaggtccgtacgaccgttacgttacgngtacggcggtccggtggaanaccgngacncctacggttgttaggttcgggtacggtcgggacgtaccgaggtcgtccggtccggttcgtcggaccgtccgaaccggctccgtccgtccccg

SEQ ID NO: 112666 - DNA, 784 bp, Homo sapiens
  misc_feature: GYAE6OF01B4WMP.8.12.B01.1.454.CMB.1.raw
  modified_base (217)..(217): a, c, t, g, unknown or other
  misc_feature (217)..(217): n is a, c, g, or t
  modified_base (287)..(287): a, c, t, g, unknown or other
  misc_feature (287)..(287): n is a, c, g, or t
tcagctcgcgtgtccacgaccggtgctcgatttagtagtgtagattccgcggggctgggcctcaggaagcagcatcggaggtgcctcagccatggcatggatccctctccttcctcggcgtccttgcgttactgcacaggatccgtggcctcctatgagctgactcacgccgaccctcagtcgtccgtcgtcccgaggacgagaccacgccaggacnccaccgtggtctccgtaggagtaagtaaagttagggggaataaatagtagtcttggcttggtactcaggngaggacggcgaccggccgtacccgtcccttcggtcgtacggtctacttcgactacgtaagaacgtaacgtaaccggacccggtccccgtacggacgggtacccgtaccgttacggacggttaccgtacgtttcccgtacgtcccgggtaccttaccccggtaacgtaccggtaaccgggaaccgtaaccgcccgtaaccttacccgtaccggtacctacccgtaacgtccggaacccggggtccggaacccgaccgtacggtaacgggacgttacgggaaccggttcctaacgtaccgtttacgttccggtacgtaccgggtgggaccgggttaggaacccggtgacgtacgtacgttaccgttggttcggggtacgggttcggaaccggggtaccggtaaccgttacggtacccgtcgggttaccccgttcccgggttacccggtagtaccccgggaacccgttcccggggtcccgtccccccggttaccccgggg

SEQ ID NO: 112667 - DNA, 787 bp, Homo sapiens
  misc_feature: GYAE6OF01A4PCD.8.12.B01.1.454.CMB.1.raw
  modified_base (131)..(131): a, c, t, g, unknown or other
  misc_feature (131)..(131): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttacngcacaggctccgtgcctcctatgagctagactcacgcccacccctcgtacggttccgttcccggtaccggtaccccccgaggaaccgaacgaaccgacggacccgaagggtactacccacccgtgtccgttcggtaggtaagtaaagttaaagggttagggggtaaattaaagttagtcgtccgttggtcgttggtatacgaggacgagaccggccgacggcccgtaccgtcccgtgttacgtcggtactactactacaacaaagtaacgaaaccgaacggtcccggtacccgtacggacggtacctccgtacgacgtcgtagttccgtccgtacgtacctacccgtaaccgttacggaaccgtaaccgaccgtacgtaccgtaacctcgtaaccgaaccgtacggacccgtaaccggggacccggtaacccgacgggtacgtaaacgggacgtaccgggtacgtaccgtaacggttacttaacggttcgacggttcgggaccggtagggtaccgaggaacctcgaacgtacccggttagttcgggttacggggttcggttacgggaccgggtaacgggtactcgggtccggtcccggttacggttacggtaccgtcccgggtaccgacccgtcggtccccgtccccgggtccccg

SEQ ID NO: 112668 - DNA, 795 bp, Homo sapiens
  misc_feature: GYAE6OF01CMU7L.8.12.B01.1.454.CMB.1.raw
  modified_base (227)..(227): a, c, t, g, unknown or other
  misc_feature (227)..(227): n is a, c, g, or t
  modified_base (292)..(292): a, c, t, g, unknown or other
  misc_feature (292)..(292): n is a, c, g, or t
tcagctcgcgtgtccacgaccggtgctcgatttagtagtgtagattccgcggggctgggcctcaggaagcagcatcggaggtgcctcagccatggcatggatccctctccttcctcggcgtccttgcttactgaccacgaggactccggtggcccttcctatgagtctgactcacgcccacctcaggttcgtcccgtcgtcccgaggacagacgacgccgaggtacncctaccgtgccttgtacggaagtaagttaaaggttagggggtaaataaacgtattggtcttacgngttagtaactcgagacgaaggaccggaccggacggtccgtaccgtcccgttaggtaccgtggtactacgttacctaacgtaacgaaagtaacgtaaacgaaccggcccggtacccgacggaacggtacttcccgaggtaccgacgtttacgttccgtacgtccgtacccgtacctaacgttcggaacggaaccaacgtaccgtacctacgtaccgtaccgtaaccgtaccgtacggaccggggtaccccggaaccggtaacgggtaccgtaaccgggtacgtcgggttaaccgacgttaacccgttacgtttaacgttaccggtacggtacgggtacgggttaccgggtaccgggacgacggacggtccgtaacgttacggttacgggttcggtttacgggttacgggtaccgggtaacccggtaaccgggtaggttacccggttccgtacccggttcgcgtaccgtacccggaccggtaccgtccccggtccccgtaccccg

SEQ ID NO: 112669 - DNA, 809 bp, Homo sapiens
  misc_feature: GYAE6OF01BU2V3.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtgcctcgtatgagctgactcacgcccaccctcaggtcgtccgtcgtcccccaggacacgacagccaggtactacctaccgtgccgttcgtagggaacgtaagttaaaaggtttggggggaaacttaaaagttagttggtactttggtccttagggttaactcgtaggaccaaggacggtacccgaccggaccctaccggttccccccgttaggtaccgttacgggttactaacgttaccttaaacttaccgaaaacggtaacttaaaccggaaacgggtcccccgggtaaccccgttaccggaacggggtaacccttacccgtacgggaacgtaccgtaactttccgtacggtcggtaccctaccgaaccgttaggtaaccgggaactaccgacctacccgtaactccgtacgaacctaccgtcccggaacggggtcccccggaaccgacgggtaccgaaaccggtgacgggtagtaccgtaggttaacctttacgtttaccggtggtaacggccggttagggggtacggcgttaccgaccgaacgtacccgtaccggttagtttcgggttacggggtttccgggaacgggtaacgaccggtagtcccgtacggttccgttacgtcggtacgacccgtccggaacgttccccggcccggttccccg

SEQ ID NO: 112670 - DNA, 707 bp, Homo sapiens
  misc_feature: GYAE6OF01DNNYJ.8.12.B01.1.454.CMB.1.raw
  modified_base (142)..(142): a, c, t, g, unknown or other
  misc_feature (142)..(142): n is a, c, g, or t
  modified_base (469)..(469): a, c, t, g, unknown or other
  misc_feature (469)..(469): n is a, c, g, or t
tcagctcgcgtgtccacgaccggtgctcgatttagtagtgtagattccgcggggctgggcctcaggaagcagcatcggaggtgcctcagccatggcatggactccctctcttccctcggccgtccttgcttactgcacaggntccgtggcctcctatgagctgactcacgcccaccctctagtcggtccgtccgtacccccgaggacagaccagcccaaggactcacctgctcgtagagtattaaggtaggggaataatagttgcttgcgttaggtactagacggacgacggacggacccgacggacccgtaccgtccccgttaggtaccttcggtactaccgtacctaatacgaaagtaactaaccgacggtccggtaccccaggtaccggtactccgtagtaacgtcgttacgttcctacggtcggtaccacccgtacgtacgacggaaacctacgacgaccttacncctaacgcctactaccggacggcccggaccgacggtacggtaggtacggtaggacggtcgtacgtacttaacgttacgttcgcgggacgcgggtaacggacgcgacgtaccgacgtaccgttggttaccggtttcggggttacggggtccggtaaccgggtacgacggttcccgtaacgttacccggttcgttacgtaccggacggtaccccgtacgtcccggttcccggtacccccg

SEQ ID NO: 112671 - DNA, 527 bp, Homo sapiens
  misc_feature: GYAE6OF01CA0V7.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtccctgtactggtcatctatcaagataacaagccggccctcgagggactccctgacgcgtattctctcggctaccaactcgtgggaacacacgccactctcgaccatcacggccgggacccaggctacggatggacggctagactattactgtcgaggcgtgggacagcagcacctagtcggttggtttcggcggtagggaccaggcgtcggaccgttccgttcggtccacgacccgaacggcctccggtcccccg

SEQ ID NO: 112672 - DNA, 751 bp, Homo sapiens
  misc_feature: GYAE6OF01BDRI2.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgccttactgcacgaggctcgtggcctcctatgagctcgactcacgccacctcagtcgtccgtcgtacccaggacagacagccaggactaccactcgtctacgtaggaatagttaaggttagggggtaataaagtactgtcgttgcggttaggtactacacggacgagacggaccacggccgtaccgtccccgttagtacgtcggtactacgttactaactacgaaataactaacgaacggtcccggtacccgtacggtacggtacctacccgaggtaccgtccgtttactccgttcggtaccggttacccgtaaccctaaccgttacggaacccgggaaactacccgtaccgaccctaacgttaccgtaaccgtaaccggtaccaacccgggtacccgggaccccgggaaccggtacggtaccggtaacgggagtacggtacggtacgtacgttaacgttacttacggtacgtcggaacgggtacgggtaggacgaccgcgacgtaccgtacggtttcgtcgggttccgggttaggaccggggtaaccggacgtaacgggcgttccgtacccgtcggttaccggtaccggtcgtaaaccccggtcgtcccggtccccgtacccccgg

SEQ ID NO: 112673 - DNA, 852 bp, Homo sapiens
  misc_feature: GYAE6OF01BBXMD.8.12.B01.1.454.CMB.1.raw
  modified_base (185)..(185): a, c, t, g, unknown or other
  misc_feature (185)..(185): n is a, c, g, or t
  modified_base (237)..(237): a, c, t, g, unknown or other
  misc_feature (237)..(237): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgccttactcgacacgtaggatccggtcggcctcctagtgagtctagactcacgcccacctnagtcgtccgtcgtaccccaggacagccgacgcgaggctaccacctgcttcgnggaataagttaacggttaggggaaattaaagtagtcgtacttcggtacggtacgtagtccgacgtacggaagggtacccggaccgtacggggtccctaaccggttccccgttacggttactcgggttaactacgttacttagactaaacggtaactaaaccgacggtacccggtccctacggtaacgggtaccttcccgtaggtaaccggtcttaaacggttccttccggttaaccggtacccttaacccgtaacggttaaccggttaaccgggaaaccacccggtacggaccctaacccgttcgttaacccggaactaacgtcccgtaccggggtaccccggaacccgtaacggggtacccggtagggtaaccgtcggaaccggtacgttacggttaaccttaacggttacccggtttaggggaaccgtccgggggtaacgttacgggaaccctaaggtaccgaacgttcccttaagggttacggtttcggggtttaccggggttacccggggacgggttaaccggtaacccgtcggtaccggttcccggttacccgttaggttacccgggacgtaaccccgacgggtttaccgccccgttccgttacccccgg

SEQ ID NO: 112674 - DNA, 608 bp, Homo sapiens
  misc_feature: GYAE6OF01AXNCC.8.12.B01.1.454.CMB.1.raw
  modified_base (470)..(470): a, c, t, g, unknown or other
  misc_feature (470)..(470): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (545)..(545): a, c, t, g, unknown or other
  misc_feature (545)..(545): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (576)..(577): a, c, t, g, unknown or other
  misc_feature (576)..(577): n is a, c, g, or t
  modified_base (581)..(583): a, c, t, g, unknown or other
  misc_feature (581)..(583): n is a, c, g, or t
  modified_base (586)..(587): a, c, t, g, unknown or other
  misc_feature (586)..(587): n is a, c, g, or t
  modified_base (592)..(595): a, c, t, g, unknown or other
  misc_feature (592)..(595): n is a, c, g, or t
  modified_base (597)..(599): a, c, t, g, unknown or other
  misc_feature (597)..(599): n is a, c, g, or t
  modified_base (601)..(602): a, c, t, g, unknown or other
  misc_feature (601)..(602): n is a, c, g, or t
  modified_base (604)..(605): a, c, t, g, unknown or other
  misc_feature (604)..(605): n is a, c, g, or t
  modified_base (607)..(607): a, c, t, g, unknown or other
  misc_feature (607)..(607): n is a, c, g, or t
tcagctcgcgtgtccacgaccggtgctcgatttagtagtgtagatttggtgggacaacagattacgccgcgtctgtgaaaggcagattcaccatctcaagagatgattaccaaaagcatccgcctttactacaaatggaacagcctacgaaaaccgaggacacaggtcgtagttattactgacaacgtagggttttgggtacgggaaatccgaactaaaatcgaaccttcgtacggggaccgaacgggtaacccgtggtaccgaacccttccgtacccgttacgaccgccccgtacccaacccgtaacggggcccctagtaccccggtttccttaccccccgtcggcccgtcccgtacggtcctaccggacgggacaccacccgtccgacgacgccaccgacgccggtcccgtggccgtacgcggtacgtacgaacggtacctaccgttccgacgtacgccgcgtaccgnggacggcggtccggtacgacgaacgggcgacgtcgtagcacgcgatcgacgngngngacnctcnacgatcgcgcncgtagcgtncnctnagcncgtctagtacgannagcnnnacnngactnnnngnnngnntnncnc

SEQ ID NO: 112675 - DNA, 805 bp, Homo sapiens
  misc_feature: GYAE6OF01EABK3.8.12.B01.1.454.CMB.1.raw
  modified_base (605)..(605): a, c, t, g, unknown or other
  misc_feature (605)..(605): n is a, c, g, or t
tcagctcgcgtgtccacgaccggtgctcgatttagtagtgtagattccgcggggctgggcctcaggaagcagcatcggaggtgcctcagccatggcatggatcctctcttcctcggcgtcctgcttactgcacaggatccgtgcctcctatgagctgactcacgcccaccctcacgtgtccgtcgtcccaggacacgacacgccagactccacctgctcgtaggagtaagttaaggttaggggtaaattaactagtacgtcgttcgtaccgttaggttactgaacgacgaggacggaccgacggccctaccgttccccgtagttaccgtacggtacctaacttactaactaacgaaagtaactaaaccgaaccggtccggtacccgtacggaaccgggtacctacccggtaggacgtccgttaaccttaccgtccgtaccggtaccttaaccccgtaacgtaccggtaacggaaccgacctaaccggtcctaaccgttcaaccgtaccacggtccgaaacgggtaccccggacccggaacggttacggtacggtagtaaccggttacggattaacggttacctttaagtccgtaacggtaccggnggggtaccggtaaggacctacgacggtacgtacccttagggtacccgggtttagggtttaccggggttaaaccggggaccggtaaaccgggtacccggttaacggttaccccgggtacgtttaccccgggtcccggtaaccggtaacccgaacccggaacccccggttaccggggccccgtttacccccggtaaccccgg

SEQ ID NO: 112676 - DNA, 383 bp, Homo sapiens
  misc_feature: GYAE6OF02HXGDR.8.12.B01.1.454.CMB.1.raw
  modified_base (377)..(383): a, c, t, g, unknown or other
  misc_feature (377)..(383): n is a, c, g, or t
tcagctcgcgtgtccacgaccggtgctcgatttagtagtgtagatttggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctggggccagggaaccctggtcaccgtctcctcagcctccaccaagggcccatcggtcttcccctggcgccctgctccaggagcacctccgagagcacagcggccctgggctgcctggtcaaggactacttccgacacgcgagctgagcgggctggcaaggcgcatagnnnnnnn

SEQ ID NO: 112677 - DNA, 490 bp, Homo sapiens
  misc_feature: GYAE6OF02ITLSK.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggaccaggctacggatgaggctgactattactgtcaggcgtgggacagcagcactatgtggtttcggcggagggccaagctgaccgtcgttcggtcagcccaaggcctcgtccccg

SEQ ID NO: 112678 - DNA, 489 bp, Homo sapiens
  misc_feature: GYAE6OF02GM0O4.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggcctcagggatccctgagcgattctctggctccaactctgggaacacagccactctgaccatcagcgggacccaggctacggatgaggctgactattactgtcaggcgtgggacagcagcacctatgtggtttcggcggagggaccagctgaccgtcgtggtcagcccaaggcctgtcccccg

SEQ ID NO: 112679 - DNA, 486 bp, Homo sapiens
  misc_feature: GYAE6OF02GI245.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggaccaggctacggatgagctgactattactgtcaggcgtgggacagcagcactatgtggtttcgcggagggacaagcgtgaccgtcttggtcagcccaaggcctgtcccccg

SEQ ID NO: 112680 - DNA, 502 bp, Homo sapiens
  misc_feature: GYAE6OF02IFMJB.8.12.B01.1.454.CMB.1.raw
  modified_base (345)..(345): a, c, t, g, unknown or other
  misc_feature (345)..(345): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcgccctcagggatccctgagcgattctctggctccaactcngggaacacagccactctgaccatcagcgggacccaggctacggatgaggctgactattactgtcaggcgtgggacagcagcactatgtggtttcggcgggaggaccaagcgtcgaccgtccgttcggtccgacgcccgaaggccgtacgtcccccgg

SEQ ID NO: 112681 - DNA, 383 bp, Homo sapiens; identical to SEQ ID NO: 112676
  misc_feature: GYAE6OF02GLPXF.8.12.B01.1.454.CMB.1.raw
  modified_base (377)..(383): a, c, t, g, unknown or other
  misc_feature (377)..(383): n is a, c, g, or t

SEQ ID NO: 112682 - DNA, 542 bp, Homo sapiens
  misc_feature: GYAE6OF02I5Y1S.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcgagggatcccgtgagcattctcgtcggcctaccaactcgtacgggaaccacgacgccctactcgtacgaaccactcgacgccgggaacccaggactacggagtcggaggctagactattacgtgtcagggcgtaggacgagcgagcgacctagtgttcgggtttacggcgggtacgggaaccaggtcgtcgtacccgttccttggcgtacgcccgaaggcctccgtccccg

SEQ ID NO: 112683 - DNA, 509 bp, Homo sapiens
  misc_feature: GYAE6OF02HHQ3A.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcggaccaggcacggatgagctgactatactgtcaggtcgtgggacagcacgcactagtgttggtttcggcggtacgggacaaggtcctaggacccgttcgttacggtccacggtcccgaaggccgtaccgtcccccg

SEQ ID NO: 112684 - DNA, 486 bp, Homo sapiens
  misc_feature: GYAE6OF02G65QS.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggaccaggctacggatgaggctgactattactgtcaggcgtgggacagcagcacctatgtggtttcggcggagggacaagctgaccgtctggtcagccgaggctcgtccccg

SEQ ID NO: 112685 - DNA, 699 bp, Homo sapiens
  misc_feature: GYAE6OF02IGZYA.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggaataaagtatagcttgctggtatcagcagaggccaggccacgtcccctgtacgtggtcagtctatcaagataacaagccggaccctcgaggtactcccgtagacgacgtaacttccgtacgtcggacctacctaacttcgtacgggaaaccacgacgaccaacttcgtacgaacccataccgacgggtacccgggaacccgacgggtacccgtaaacgggacgtacgggaacggtaccgtacggtaacctttaacgtttaaccgtggtaaccggagggtaccgggttacgggaaccgtaaggccgaacgtaccgtaaacccgttagttcgggtttacggggttttaccgggacggggtaaccggggaaccggttaacggccgttaacgggtaccccgtttaccggttcgggtacccgaaccgggttaccccggaaacgggtcccgttacccgggtaccccccccgg

SEQ ID NO: 112686 - DNA, 507 bp, Homo sapiens
  misc_feature: GYAE6OF02JETWE.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggactcctgagcgattctctggctccaactctgggaacacacgccactctcgaccatcagccgggaccaggctacggatgaggctgactattactgtcaggcgtagggacagcagcactatgttggtttcggcggacgggaccaaggctacggaccgttccgttggtcacggcccaagggcctcgtcccccgg

SEQ ID NO: 112687 - DNA, 665 bp, Homo sapiens
  misc_feature: GYAE6OF02H4GRM.8.12.B01.1.454.CMB.1.raw
  modified_base (330)..(330): a, c, t, g, unknown or other
  misc_feature (330)..(330): n is a, c, g, or t
tcagctcgcgtgtccacgaccggtgctcgatttagtagtgtagattccgcggggcgtgggccgtcaggaagcagcatcggaggtcgcctcagccatggcatggatccctctcgttcctcggcgtccgttgcttactgcacaggatccgtggcctcctatgagctgactcagccaccctcagtgtccgtgtccccaggacagacgagccaggatcaccgtgctctggagataaattggggataatatgcttgctggtatcagcagagccagccacgtcccctgtacgtggtcagtctatcaagataacaagcggcctcgagggactcccgngacgccgattctctcggcctaccaacgtcgtagggaaccacgagcccactctcgaccagtacacggaccgggaccacggacctacgggtactcggagccgtagaaccgttattaacgcgttacgaacgggtcggttacggggaacacggggaccaacggtcccgtaaaccgttagtttacgggttacggggtttttcccggggaccggggtttaacggggacccgtaaaacgggttcccgtccgggttaaccccggttcccgggtttccgggttaaccggtaacccgggcccccgggtaaagggttcccccggtacccggttcccccccccgggg

SEQ ID NO: 112688 - DNA, 507 bp, Homo sapiens
  misc_feature: GYAE6OF02JB31P.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggcctcagggactcccgtgagcgattctctggctccaactctagggaacacacgccactcacgacatcgagccggaccaggctacggatgacgctgacttattactgtcaggcgtcgggacagcagccactagtcgttggtttcggcggtaggaccaagccgtgacccgttcgttcggcgacgcccgaacggcctcgtccccg

SEQ ID NO: 112689 - DNA, 534 bp, Homo sapiens
  misc_feature: GYAE6OF02GJO1F.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacagcggcctcagggactccctgagcgattctctggctccaactctgggaacacagccactctcgaccatcacggcggacccgaggccgtacggatggagcgtgaccttattactcgtcgaggcggtcgggacaggcgagcaaccgtagtcggttcggttttcgggcgggacgggtaccgaagtccgtaggtacccgtccgttcggtccgacggccgaacggtcctacgtcccccg

SEQ ID NO: 112690 - DNA, 619 bp, Homo sapiens
  misc_feature: GYAE6OF02F584Q.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgtcttgcgtggtatcagacaggacggccgacggcctacgtcccctgtacttgtacatctatacaagataacaacggccgccctagacgggactccgtagacgcgtattccgtcgtggcctacctaactcgtaacggaacacgaccgacctactcctacgacctactcgacgggacccggacccgaggtaccgtacggagtgggaacgcgttacgtaacttacttacgtgtacgagggtccggtagggacacggtcgaacgccgtaacgtgttcggggtttcgggtttcggggacgggacgggtaacgacggttccgtacggttacccggttcgttcggtacgaccggtaccccgaaggtccctaccggtccccccgg

SEQ ID NO: 112691 - DNA, 544 bp, Homo sapiens
  misc_feature: GYAE6OF02F5WQS.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcagaggccaggccagtcccctgtactggtcatctatcaagataacaagcggccctcgagggactcccgtgagcgattctctgctccaactcgtagggaacacacgccactctgaccatcgagccgggacccaggactacggatggaggctagacttattactgtcgaggcgtgggacaggcagccaactgtgttcgggtttcggcggtaagggaccgaaggtccgtacggtacccgttccgttacgggtccgtaaccggacccgacggtcccgtccggtccccccg

SEQ ID NO: 112692 - DNA, 388 bp, Homo sapiens
  misc_feature: GYAE6OF02GRXGN.8.12.B01.1.454.CMB.1.raw
  modified_base (378)..(388): a, c, t, g, unknown or other
  misc_feature (378)..(388): n is a, c, g, or t
tcagctcgcgtgtccacgaccggtgctcgatttagtagtgtagatttggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctggggccagggaaccctggtcaccgtctcctcagcctccaccaagggcccatcggtccttcccctggcgcccctgctccaggagcacctccgagagcacagcggccctgggctgcctggtcaaggctacttccgacacgcgagctgagcgggctggcaaggcgcatagnnnnnnnnnnn

SEQ ID NO: 112693 - DNA, 543 bp, Homo sapiens
  misc_feature: GYAE6OF02JANMQ.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagacggccaggccacgtcccctgtactggtcatcctatcaagataaacaacgcggccctcagggactccctgacgcgattctctggctccaactcgtaggaaccacacgccactctacgaccatacgacgccgggaccaggactaacgggatacggagctagactacttactgtcgaggcggtagggacagacacgtcacttaacgtggttggtttcgggcggacgggacaacggtcgtcgtaccgtccgttacggtcgacgcccgaacggccgtccgtcccccgg

SEQ ID NO: 112694 - DNA, 546 bp, Homo sapiens
  misc_feature: GYAE6OF02G42CV.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcgagggatccctgagcgattctctggctccaactctgggaacacagcccactctcgaccatcaggcgggacccaggctacggagtgaggtctgactattactgtcgaggcgtagggacagcacgccacgtatggttcgggttttacggcgggtacgggaccgtaaggccgtacggtacccgttccgtttgggtaccgtacggaccccgtaacgggtccctacggtacccccccgg

SEQ ID NO: 112695 - DNA, 544 bp, Homo sapiens
  misc_feature: GYAE6OF02I34VJ.8.12.B01.1.454.CMB.1.raw
  modified_base (221)..(221): a, c, t, g, unknown or other
  misc_feature (221)..(221): n is a, c, g, or t
  modified_base (422)..(422): a, c, t, g, unknown or other
  misc_feature (422)..(422): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctgganataaattggggataaatatgcttagctggtatcagcagaggccaggccagtcccctgtactggtcatctatcaagataacaagcggacctcagggatccctagacgcatctctggctccaactctagggaacacagccactctgaccatcagcggaccaggctacggatgaggtctgacttatactgtcaggtcgtggganacgcgagcaacctagttaggttcggtttacgggcgggtaacggggacctaaggccgtaggacccggttcctttacgggccgtaaccggccccgaacgggtcccgttaccgtacccccccggg

SEQ ID NO: 112696 - DNA, 721 bp, Homo sapiens
  misc_feature: GYAE6OF02I4551.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggcaggccagtcccctgtacgtggtcatctatacaagaactaaacgaaaggccggacccctacgaacggggactccccgtaggacggtcgtaactttccgtcgttcgggaccttaccgaaaccttcgtacggggaaaccaaccgaccggacccaaccgttccgtacggaaccctaacgtccgaacgggacccggggaacccgagggtacccgtaaccgggtacgttcgggaacgggtcttacggtaacctttaacgttaccgttaggtaacgtacgggtaccgggtacggggaccaggtccgaacggtcctaaacccgttagttacgggtttcgggttttaccgggaccggggtacgggtaacccggaaggtcccggttaaccggtacccggtttcccggtttcgggtaccgtaacccggtaccccgtaacgggtccccttaccccggttacccccccggg

SEQ ID NO: 112697 - DNA, 494 bp, Homo sapiens
  misc_feature: GYAE6OF02IU2U2.8.12.B01.1.454.CMB.1.raw
  modified_base (430)..(430): a, c, t, g, unknown or other
  misc_feature (430)..(430): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagccggccctcgagggactcccgtagacgcgacttctctggctccaactctgggaacacacgccactctgaccatcacgccggaccaggctacggatggagctagactattactgtcaggcgtggacngcagcactgtgtggttcggcggaggacagctcgaccgtcgtcgcacgcccaggcctcgtccccg

SEQ ID NO: 112698 - DNA, 659 bp, Homo sapiens
  misc_feature: GYAE6OF02IHBL4.8.12.B01.1.454.CMB.1.raw
tcagctcgcgtgtccacgaccggtgctcgatttagtagtgtagattccgcggggctgggcctcaggaagcgaggcatcggagggtgcctcagccatggcatggataccctctcttcctcggcgtccttgcttactggcacaggatccgtggcctcctatgagctgactcagccaccctcagtgtccgtgtccccaggacagacgagccaggatcacctgctcgtggagaataagtggggataaatatgcttgcttggtatcaggtcgagaggccgacggccacgttcccctgtaccgtcgggtacactctaactacaagtactaacgtaacgccggacccctcgacggtacctccctggacgcgtattccgtcgcggtcctacctaacctcgtaccgggaacaccgacggaccctacgtccgtacgaaccctaacgttaccgaacggccggggtaacccgacgggtaccgtaacggtaacgtacgggacgggtcgtacggaacttaacgttaacgtcggtacgacgggtcgggtcgggaaccgacggtacgacggacctaaccgtgttcgggtttaggtttccgggacggggtaggaccggtacgcgtacgtacccgttcgttacggctacgcccggaaggtcccgtccgtacccccgg

SEQ ID NO: 112699 - DNA, 626 bp, Homo sapiens
  misc_feature: GYAE6OF02H38IL.8.12.B01.1.454.CMB.1.raw
  modified_base (276)..(276): a, c, t, g, unknown or other
  misc_feature (276)..(276): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtccccngtactggtcatctatcaagataaacaacgcggccctacgacgggactccctgacgcgtattctctaggctaccaactctagggaacacagcctactcgtacgaccatccgaggccgggaacccgacggtaccgtaacgggataggacgggtactaggtaaccttaattacgtacgtacgaacgggtcggttacggggaccgtaaggccgaacgtcctaaccgttaagttagggttcgggtttttaccggggacgggtacggggtaaccctaacggtaccgttacgtacccggtttccgttacgggtaccgtaccggaccccggaacgggtcccgtccggtacccccccgg

SEQ ID NO: 112700 - DNA, 655 bp, Homo sapiens
  misc_feature: GYAE6OF02JC0IR.8.12.B01.1.454.CMB.1.raw
  modified_base (221)..(221): a, c, t, g, unknown or other
  misc_feature (221)..(221): n is a, c, g, or t
  modified_base (293)..(293): a, c, t, g, unknown or other
  misc_feature (293)..(293): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctgganataaagttggggataaatatgcttgctggtatcagcagaggccaggccagtcccctgtactcggtcatctancaagtactaaacaagccgtcctcgagggtactcccgagacggcgtacttccgtcgttcggccttacccgaacgtcgttaacggggaaccaaccgacggaccctaacgttcgtaacggtaacccctagttaccgaacggccgggtaaacccacgggtacctaacgggatcgggaacgtccgtagtaaccttcgttaacgtcgtacgaacgggtccggtagggtaccgaagtccgacggtacctaccggttagttcgggtttacgggtttcgggacgggtaacgggtaacccgaaggtccgttacggtaaccgttccggttacggacgtaccggaccccggtaagtcccgttccgtacccccgg

SEQ ID NO: 112701 - DNA, 644 bp, Homo sapiens
  misc_feature: GYAE6OF02I8RX7.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtccctgtactggtcatctatcaagataacaagccgccctcgagggactccctgagcgattctctggctaccaactcgtagggaacacgacgccactctacgaccactcgacggccgggaacccacgggaccgtaaccgggtaagtcgggacggtacctacggtaaaccttagtttaacctgggttaccgacggggtccggttacggggaaccaggaccgaacgtacccgtaaccgttaaggttcgggtttacggggttttccgggacggggtaacggggtaacccgtaaacgggtccgttaccgggtacccgtttaccggttacgggtaccacccggtacccggaaccggtcccgttaccccggtaccccccgg

SEQ ID NO: 112702 - DNA, 711 bp, Homo sapiens
  misc_feature: GYAE6OF02F4IQS.8.12.B01.1.454.CMB.1.raw
  modified_base (260)..(260): a, c, t, g, unknown or other
  misc_feature (260)..(260): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagnggccaggccagtcccctgtactggtcatctatcaagataacaagccggccctacgagggactcccgtgacgcgtagttcctcgtcggcttcccaaacgttccgtacggggaaacctaccgacggaccctaaccttccgtacggaaccctaactccgaaacgggcccggggtaacccgacggggtaccgtaaccgggactacgggaacgggtccttaggtaaccttaacgttaccgtggtaccgaaggggtccgtacggggacgtacgccgtacggcctaaaccgttagttcgggttttacgggtttttaccggggaccgggtaaccggggtaacccgtaaacgggtacccggttaccgggttaaccccggtttcccggtttacggggttacccgtacccggggtaacccccggtaaacgggtccccgttaccccgggttaccccccccggg

SEQ ID NO: 112703 - DNA, 503 bp, Homo sapiens
  misc_feature: GYAE6OF02GIHEB.8.12.B01.1.454.CMB.1.raw
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcggccctnagggactcccngagcgattctctggctccactcnggaacacagccactcncgaccatccaggcggaccaggcctacggatggagtctagactatactgtcagggcgtggacngcngcactagtgttggtttcggcggtagggacctaaggctacgccgttcgtggtccacgaccgacggctcgtcccccg

SEQ ID NO: 112704 - DNA, 603 bp, Homo sapiens
  misc_feature: GYAE6OF02H9T7S.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccacgtccctgtactggtcatctatcaagataacaagccggccctcagggactccctagacgcgtatctcgtggcctaccaacgtctagggaacctacacgcccactctacgaccctaagtcaacggccgggacccacgggaccgtacgggtagtcggaagggcctaggaccttattaccgtagtccgagggtacggtgggaaccgtggccgaagtacccacgtagttgggttgggtttaccgggacgggtaacggggaccaacggtcgtaccggtaccggttcccgttgggtccgaccggtaccccggaacgggtccctcggttaccccccccgg

SEQ ID NO: 112705 - DNA, 657 bp, Homo sapiens
  misc_feature: GYAE6OF02I8MJD.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccacgtccctgtactggtcatctatacaagactaaacgaacgccgacctacgagggactcccgtaggacgcgtacttccgtacgtcggcctacccaaacgttcgtacggggaaacctacgacggtccctacgttaccgtacgaacctacgtaccgacgggtacccggggaacccgagggtaccgtaaccgggtagtacgggacggtcgtacgtaacgttaacttaccggtagtacgagggtccggtacggggacaggacgacgtccgtaacccttaggttcggtttcgggtttccgggacgggtaacgggtaacccgaagtccggtaccggtacccgttccggttcggtaccgtaccggacccgtaacggtcccgtcccggtacccccgg

SEQ ID NO: 112706 - DNA, 735 bp, Homo sapiens
  misc_feature: GYAE6OF02IAVX5.8.12.B01.1.454.CMB.1.raw
tcagctcgcgtgtccacgaccggtgctcgatttagtagtgtagattccgcggggctggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatagcttgctggtatcagcagaggccaggccacgtccctgtacgtggtcatctatcaagataacgaagccggaccctagacgggtactcccgtaggacgtcgtacttaccgtcgtcggtcctacccgtacgttacgtacgggaaacctaccgacggtcccctaacgttcgtacgaaccctaacgtccgaacggggtcccgggaaaccctacggggtacccgttaacgggacgttacgggaacgggtccttacgggtaaaccttttaagttaccgtacggttaccggaaggggttaccgggttacggaacccgtaggaccgtaacggcccgttaaacgtcggtttacgggtttccggggttttaccggggaaccggggtacgggtaacccggtaaggttccggtaacccgggttaccccggtttccggttaacgggtacccgtaaacccgggtacccccggtaacgggttcccccggttacccggttaccccccccggg

SEQ ID NO: 112707 - DNA, 609 bp, Homo sapiens
  misc_feature: GYAE6OF02GMU15.8.12.B01.1.454.CMB.1.raw
  modified_base (459)..(459): a, c, t, g, unknown or other
  misc_feature (459)..(459): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatccacctgctctggagataaagttggggataaatatgcttgctggtatcagcagaggccaggccacgtcccctgtaccgtggtcatctatcaagaataacgaacgcgaccctgacggactcctgagcgattctctggctaccaactcgtagggaacacgacgccactctacgacctatcgacggccgggaccagggcctaacggagtcggacggtctagtacttattacgtgtacgtagggcggtacgggacnggacacgccaccgtagttcgggttcgggtttacgggacgggtacgggaaccgtaacggtcccggttaacggtacccgggtttccgtttaccgggtacccgtaaccgggtaccccggtaacgggtccccgttaccccggtacccccccggg

SEQ ID NO: 112708 - DNA, 796 bp, Homo sapiens
  misc_feature: GYAE6OF02FF64Y.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgacctcagcccaccctcagtcgtccgtcgtccccaggacagacagccaggactccacctgcctcgtaggagtaagttaaagttggggaacttaatatcggtcttgcttggtactgacgacgacggacggccgacggccctacgtccccgtagttacgtcggtactacgttactaagtaccaaagtaacgtaaaccgaacggcccggtacccgtacggtaacgggtaccttacccgtcggacgtaccgtacttccgttccgtaccggtacctacctaaccgttaccgtaacgggaaccctaccgaccgtaccctaacgtaccgtacgaccctaacgaccggaccgggacccggacccgtacggtaccgtacggtagtacggtacgtacgttacgtaacgttacgtttaccgtacgggtaccgtacgggtaccgggttacggaaccgtacggtaacccgttaacggaacccttttaaccgggtacggttttacggggttacccggggttttaccgggaaccgggtaaccgggttaaccgaaaccggtcccggttaaccggtacccggtttacggttacccggtaacccggtaccggtaccccggacccgggttaccccgttccccggttaaccccccgg

SEQ ID NO: 112709 - DNA, 668 bp, Homo sapiens
  misc_feature: GYAE6OF02HT9M3.8.12.B01.1.454.CMB.1.raw
  modified_base (398)..(398): a, c, t, g, unknown or other
  misc_feature (398)..(398): n is a, c, g, or t
tcagctcgcgtgtccacgaccggtgctcgatttagtagtgtagattccgcgggcgtgggcctcaggaagcagcatcggaggtgcctcagccatggcatggatccctctcttcctcggcgtccttgcttactgcacagatcgtggcctcctatgagctgactcagccaccctcagtgtccgtgtccccgaggacagacacgccgaggatcacctcgctcgtggagaagtaagtggggtaaataataatggtacttgcgtggtatcgagcaggacgcgacggcacgtccctgtacgtggtactacgtcttactacgaaagtaacaaacgtaacgccggacccctagacgggtactcccaggacgacgtacttctcgttagctaccgtatcgtacggaacncacgcctatccgtcgacctagtcgaacggtccgggaacccgacggtaccgtaaccgggatacggaacggtcttacggaacttagttaacctcggtacggacgggtccggtacggggaccctaagaccgaacgtaccggtacgtttaagttcggggtttcggtttacccggggaagggtaccggggtaaccgaacgcggttacctaccccggggttcgttacggacccggaaccgttacccggtaacggcccggttcccgtaccccccggg

SEQ ID NO: 112710 - DNA, 699 bp, Homo sapiens
  misc_feature: GYAE6OF02FQPII.8.12.B01.1.454.CMB.1.raw
  modified_base (240)..(240): a, c, t, g, unknown or other
  misc_feature (240)..(240): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatntgcttgctggtatcagcagaggccaggccagtcccctgtactggtcatctatcaagactaacgacgccggccctcgacgggactcccgtagacgtccgatttcctcgtcggcctaccaacgttccgtaggggaaaccacgacgaccctacgtccttacgaccctacgttccgacgggtacccgggaacccgtacgggacctaaccggggtagtacgggtaggccgttacggtaacttacgtttaccggtgtaccggaacgggtccgggttacggggaacctaggaccgtaaccggacccgtaacccgttagttacgggtttaccggggtttttaccggggaccggggtaaccggggtaaccggtaaaccgggtccgtaaccgggttacccggttaccggtttacgggtccggtaaccgggaccccggtaacgggtccccgtacccgggtacccccccgg

SEQ ID NO: 112711 - DNA, 592 bp, Homo sapiens
  misc_feature: GYAE6OF02IV7XF.8.12.B01.1.454.CMB.1.raw
  modified_base (300)..(300): a, c, t, g, unknown or other
  misc_feature (300)..(300): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccgaggccacgtcccctgtactggtcatctatacgaanaactaaacaagccgccctcgaacgggactcccgtgacgcgtacttctcgtggcctaccaactcgtacggaacacacgcctacgtcctagaccagtcgacgggccggacccagggcctaacgggatggaacggtcttacgaacttacgttactcggtacgagggcggtaggactacggcacgcctacttagttcgggttagggtttccgggacgggtacgggaaccgtacggtcgtaccggacccgtttacggtcggaccgaccggtacccgtaacggtcgttccgtcccccg

SEQ ID NO: 112712 - DNA, 618 bp, Homo sapiens
  misc_feature: GYAE6OF02JB7FZ.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagaggccaggccagtcccctgtactggtcattctatcaagataacgaacgccgccctacgaggactcccgtgacgtcgtacttctcgtcggacctaccaacgtcgtacgggaacacgacgccactcgtacgacctactcgacggaccggacccgacgggaccgtacggagtacggacggtactacgaacttacttacgtcgtacgacgggtcggtacgggacacggcgacgcctaccgtagttcggttcgggtttaccgggacgggtacgggtaaccgacggtaccgttaccggtacccggttccggttcgggtaccgtaccgggtacccgtaacgggtcccgtaccccggtacccccgg

SEQ ID NO: 112713 - DNA, 669 bp, Homo sapiens
  misc_feature: GYAE6OF02IM1E1.8.12.B01.1.454.CMB.1.raw
  modified_base (220)..(220): a, c, t, g, unknown or other
  misc_feature (220)..(220): n is a, c, g, or t
  modified_base (440)..(440): a, c, t, g, unknown or other
  misc_feature (440)..(440): n is a, c, g, or t
tcagctcgcgtgtccacgaccggtgctcgatttagtagtgtagattccgcgggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatcacctgctcgnggagtaataagttgggggaataaatagtgcttgcgttggtaatcgaggcaggacggtaccgacggccgacgttccccctagttacgttcggtctactacttataccaaacggaataaacgaacggccgtaccctacgaagggtacctccgtagacgaccgtagtttccgtacgtcggtctaccctaacgtcgtacggaacacgacgcccactcgcgaacntccgacggaccggaccgagggctaaccggagtaggcggtacacgttacgttattaacgttggaccgtagggtccgggttacggaacgtacggtaccacgtaaccgtaccgttagttcgggtttacgggtttccggggacgggtaaccgggaccgtacggccgttaccggtaccgttcccggttacggtacggtcccgacccggtaccggttcccgcccgttacccccgg

SEQ ID NO: 112714 - DNA, 691 bp, Homo sapiens
  misc_feature: GYAE6OF02J0YWK.8.12.B01.1.454.CMB.1.raw
tcagctcgcgtgtccacgaccggtgctcgatttagtagtgtagattccgcgggcgtgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggaccagacacgccaggatccacctgcctctggagataaagttggggaataaatagtgtcttgacttggtaatcagacgagacggtccacgggcccacggttcccccgtaggtaccgtggtacctatctactactaaacggtaactaaacgaacggccggtacccctacggaacgggtacctccccgagtaccggctaagttccttcgtcggtccttaccgaacgttcgtacgggaaactaccgcgtaccctacgtccacggtacctacgtcgaaccggccggaacccgaacggtccgtacggtagacggacggtcaacgtacgttacttacgtacgtacggaggtccgggtacggtaaccgagaccgacgaccgtaacgtagttcgggttacggttccgggacgggtacgggaacctaacggtccggttaaccgtaccggttaccgttacgggtaccgaaccggttacccggaacggttcccgacccggtcccccggg

SEQ ID NO: 112715 - DNA, 696 bp, Homo sapiens
  misc_feature: GYAE6OF02HNOV5.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggactccgtggcctcctatgagctgactcacgcccaccctcagtcgtccgtcgtccccaggacagacagccagatcacctgctcgtaggataataagttggggaataatagtgtcttgtcgtgtatcgagacgagacgaccgacggcctaccgtccctagtacgtcggtactactactatacaagtaataacgaacggccgtacccgtacgaacgggtactccgtagacgtcgtacgttctacgtcgtacctacctacgtacgtaacggaaccaccgtacgaccctaccgtcgtaccgtaacctacgtaccgaaccgggtacccgggaaccgtacgggacccgtaacggtgtacggacggtccgttagaacctttacgttacgacggttacggtaaccgggtcggttaacggggaccaacggaccgtaagtacccgtacgtaaggtttcggggtttacgggtccgggtaccggaacgggttaacaaccggtcgttaccggtaccccgtttcggtaccggacgtaccggaccccggtacggcccgttcccggtacccccgg

SEQ ID NO: 112716 - DNA, 628 bp, Homo sapiens
  misc_feature: GYAE6OF02JLCC6.8.12.B01.1.454.CMB.1.raw
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggatcacctgctctggagataagttagggggaataaatagtgcttagctaggtatcgagcagaggccaggcacgtccctgtacnggtcatactancaagataacagcgaccncgacggactcccaggacgcgtacttctcgtcggactcctaaccgtcgtacggggaacaccgtacgaccctaactcgacgaaccctagtaccgacggacccgggaaccacgggcgtaaaccgtagtacgggagtaccttaggacttaacgtacttcggtacgacggggttcgtagggaccgaggtaccaggtaccaccgttagtgggttttaccgggttaggaccggggaacggtaaccctaagggtccgtacggacccgtttacggtacggtccaccggttacccggaacgtcccgtacccggtcccccggg

SEQ ID NO: 112717 - DNA, 642 bp, Homo sapiens
  misc_feature: GYAE6OF02JXYB0.8.12.B01.1.454.CMB.1.raw
  modified_base (423)..(423): a, c, t, g, unknown or other
  misc_feature (423)..(423): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcaggaggccgaggccacgtcccctgtacgtggtcatctatacaagaactaacaagccggccctacgacggactccgtagacgacgtacttcgtcgtcggcctacctaacgtcgtacgggtaaccacgacgccactcgacgacctagtccgacggccggtaaccgnggtaccgtacggatacggacggtactacggtaacttacgttaacgtggtaccgagggtccgtacgggaacacgaccgacacccgtaccgtttaggttcggtttaccggggttccgggaacgggacgggtaaccgtaaccggtccgttaccggtacccggtttacggttacggtacccggtaccgaacccggtaacggtcccgttccccggtacccccgg

SEQ ID NO: 112718 - DNA, 705 bp, Homo sapiens
  misc_feature: GYAE6OF02GFQR3.8.12.B01.1.454.CMB.1.raw
  modified_base (239)..(239): a, c, t, g, unknown or other
  misc_feature (239)..(239): n is a, c, g, or t
  modified_base (334)..(334): a, c, t, g, unknown or other
  misc_feature (334)..(334): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggatcactgctctggagatgaattgacaaagaatntcgcttattggtaccagcagaagtcaggccacggccccttgtcctggtcctatttacgtgaggacaacgaaccgccctccgggactcccccgaancacctcgtctcggactccgagtcctacggagggactacggtacggcctaaccgtttgaaccttatcgtaacggtcggggaccccagggttacgggaaggtagtaaggaacgggacggtaaccttaacgtttaacgttcggtttaacctcctaaccgtaaggtaaggtaacgggagttacgggtactacgtacgttacgggtttaggggttacggtttaccggggacgggtaacgggtaacccgtaacggtcccggtaaccgggtaccccggggtttacccttaaacggggtaccgaaacggttacccccggaaggtccccgttaccccggtcccccggtttacccgggtaccctaaccccggttttccccg

SEQ ID NO: 112719 - DNA, 688 bp, Homo sapiens
  misc_feature: GYAE6OF02HNZUS.8.12.B01.1.454.CMB.1.raw
  modified_base (208)..(208): a, c, t, g, unknown or other
  misc_feature (208)..(208): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggacncacctgctctggagaattaaagttggggaataaatatgtcttgcgtggtatcaggacaggacggccgacggcctaccgtccccgttagtacgtcggtacgtactctaatacaaagaataaacgaaacggtccggacctacgaacgggactacccgtaggacgcgtattcgtcgtacggtcctacctactcgtacggaaccaccgaacaccctactactacgaaccacgtaccggacgacccggggaaccacggtaccgtaaccggagacgggacggacgtacgtaacgttacttacgtagtaccggtgggtacggtacgggacgtagaccgaacgtaccgtaacgttaggttacgggtttacgggtttaccgggacgggttaaccgggtaaccgtaacggtaccggtccggtacccggttaccggttcgggtaccgaaccggtaccccggtaacgggttcccgtacccccggtaccccgg

SEQ ID NO: 112720 - DNA, 643 bp, Homo sapiens
  misc_feature: GYAE6OF02FYB3E.8.12.B01.1.454.CMB.1.raw
  modified_base (301)..(301): a, c, t, g, unknown or other
  misc_feature (301)..(301): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggactcacctgctctggagaattaagtgggggaataaatagtgtcttgctggtatcgtagcagaggccaggcccacgtccctgtactggtcatctacncaaagactaagaacgccgaccctacggacgactccgtgacgcgtattctacgtcggtaccttaccaactcgtacggggaaccacgtaccgcctactcgtacgaccactcgacggtaccccgggtaccgacggtaccgaacgggacgtcggacggtcgtacgtaacttaacgtacgttggtaccgtagggtaccgggtcggaacgcggactaacggacctaccgtgtttaccgtttcggggtttacgggacgggtaccggtaacggtaacgtccggtaccggtaaccgttccggttacggtaccaccgggttacccgaacgggtccctaccgggtaccccccg

SEQ ID NO: 112721 - DNA, 882 bp, Homo sapiens
  misc_feature: GYAE6OF02GGH81.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggccctcctatgagctgacctcacgccaccctcagttcgtccgtcgtcccaggacagacacgaccaggactccacctgcctacgtaggaagtaacttaaaggttaggggaattaaatagttacgtacttaggtacttaggtactacgacggtaccgaaggtaaccggaccgtaacggtacccgtaccggttaccccccgtaggttaaccgttcgggttaacctaacgtttaacccgttaaagttaaccgaaaaacggtaaacgtaaaaaccgtaaacggggtaccccggtaaccccgttaaccgggaaacggggtacccttacccggtaacggaaccggtaccgtttaacgtttcccgtacgttaccgggttacccctttaacccgtaaaccgtttccgggtaaaccgggtaaacctaaccgtaccgggtaccctaacccgttacctaacccgtaacccgtaacgtaccggaacccgggtacccggggtacccgaacgggtaaccggtacgggtacgtacgggtaacggtacgttacgtaaaccttaacgttacgtacgggtaccgtacgggtacgggttacggaaccgtaggacctaacgtaccgttaaccggttaggttacgggtttacgggtttccggggacgggtaacggtaaccgtaacggccggttacccggtacccggttagttaccggtaccgtaccggaaccggtaccggtccgtaccccggtaccccg

SEQ ID NO: 112722 - DNA, 845 bp, Homo sapiens
  misc_feature: GYAE6OF02HN34X.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccaggactcacctgctctagggagaagtaaagttgggggtaataaagtatagcttgctggtatcgagcagaggccaggccacgtccctagtctggtctatctatacaagaacgtaacaacgccggcctacggagggacctcctaggacgtcgtacttacgtcgtacgcttacccgaaccgtacgtaccggtaaccacggtaccgtacccgtaccttccggaacgtaccctaacgtacccgaggtacccccggggaaccgacgggtacccgtaaacgggtactacgggtacggtaccgtacgttaaaccgttaccgttaaccgttcgggttaccggtaacggggtcccgggtttaacggggaaaccgtacgggtaaccccgtaaagggtcccccgtttaaaaccggtttaggggtttaccggggttttcggggggttttaaccccgggggaacccgggggggttaaaccgggtaacccccgggtttaaacgggttaccccgggggttaaccccgggtttaacccccggggttttaaccccgtttacggggggttaaccccccgggtaaccggggttaccccccgggggtttaaacccggggttacccccccggttacccccgggttttcccccccccccggggg

SEQ ID NO: 112723 - DNA, 835 bp, Homo sapiens
  misc_feature: GYAE6OF02IYHXE.8.12.B01.1.454.CMB.1.raw
  modified_base (235)..(235): a, c, t, g, unknown or other
  misc_feature (235)..(235): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagttcgtccgtcgtccccgaggaccagacacgccaggactccacctcgctcgtaggaanaagttaaaggttggggtaattaaagtagttgtaccgttggtacgttaggttactacgaacgtacgaacggacggaccgaccgggaccctaaccggttccccgtaggttaccggttcggttactacgttacctacgttaacgaaacgtaaactaaaccggaaccggtcccggtacccgtacggtaacgggtacccttccgtaaggtaccgtacgttaccttcgtacgtcggtacccttacccgtaacgtccggttaaaccggaacctaccgacccgtaccctaacgttccgaaccgtaacctacggtaccgaaccggggtacccgggtaacccggtaacgggttaaccggtaacgggtaacgttaccggggaacggttaccttaacggttaaaccgtttaaccgttacggttacggtccgggtacggggttaaccgggtacggaccgaagtacccgtgttaacccgttaacttgggtttcgggtttacgggttaccggggacggtacggaaacccgtggtaccgttacccgggttcccggtttaccggtacgtacccggtacccggtacccggtaccgggttcccctaccccggtccccgg

SEQ ID NO: 112724 - DNA, 638 bp, Homo sapiens
  misc_feature: GYAE6OF02F1REF.8.12.B01.1.454.CMB.1.raw
  modified_base (139)..(139): a, c, t, g, unknown or other
  misc_feature (139)..(139): n is a, c, g, or t
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (317)..(317): a, c, t, g, unknown or other
  misc_feature (317)..(317): n is a, c, g, or t
  modified_base (515)..(515): a, c, t, g, unknown or other
  misc_feature (515)..(515): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggntccgtggcctctatgagctgactnacgccaccctcagtntccgtgtccccaggacagacagccaggactcaccgtgactcgtaggagaataaagttggggataaatagtgcttaggactggtactcagcaggacggccgaaggtcccgacgtcccctggtaccgtggtcatcgtatanaaggtaactaacgaacgtccggcctacggacgggtactcccgtagacggtacgtattcccgacgttcggacctaccgtaacgtccggtaacggaaacctaacgccgtacctccgttcaaaccggcctaacggcgaacggcccgggtaaccacgggtaccgaagtcgttacggacggtcttaacggacttaagttacgntaccgaggccgggttacgactcggactacgtaactccgtaaggttgttccgggtttcggacggacggtaccagtccgtacgttccgtgttcggctaaccggcgtacggtccttcccgcccccg

SEQ ID NO: 112725 - DNA, 692 bp, Homo sapiens
  misc_feature: GYAE6OF02IQACU.8.12.B01.1.454.CMB.1.raw
  modified_base (282)..(282): a, c, t, g, unknown or other
  misc_feature (282)..(282): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtgtccgtgtccccaggacacgacagacaaggatcacctgctctggagataagttggggaataaatatgcgtgctgtatacgagacagaggacacggcacgtcccngtacgtggtcatctatacaagtataacgaacggccggtccctcggaacgggtacctccgacggacgccgtattccgttcgtacggtacctacccgtaaacgtcgtaacggtaaaccaccgacgaccctacgtaccgtaccgtaaccacgtacgaccgggacccggtaaccggacggaccggttaacggcgtaggacgggtaccgttaacgtaccttaacgtttaaccgtccgggttaacgtacggggtacggtacggggaactcgggtacgaaccgttacaccgtttaggtttacggggtttaccgggtttacggggaaccgggtaaggggtaccctaacgtccggttacggacccggtttcgttaccgaccggaccgtaccccggaacggtccgtccccggtacccccg

SEQ ID NO: 112726 - DNA, 628 bp, Homo sapiens
  misc_feature: GYAE6OF02ILUWK.8.12.B01.1.454.CMB.1.raw
  modified_base (265)..(265): a, c, t, g, unknown or other
  misc_feature (265)..(265): n is a, c, g, or t
  modified_base (516)..(516): a, c, t, g, unknown or other
  misc_feature (516)..(516): n is a, c, g, or t
tcagctcgcgtgtccacgaccggtgctcgattttagtagtgtagattccgcgggggctgggcctcaggaagcagcatcggaggtgcctcagccatggcatggatccctctcttcctcggcgtccttgcttactgcacaggatccgtggcctcctatgagctgactcacgccaccctcagtgtccgtgtaccccaggacagacagccaggatcacctgctctaggagaataaagttaggggaataatatgcttgcgttgtatcganacgaggacgccaggccactccctggtaacttggtacagtctaatacaagaataaccgagaccggcctacgagggactacgtactacggaattccgagttctacgtcggtacctaccaacttcgaaacggacccaacgtacgaccacgttactacgaactactacggacggccggaaccacgggtaacgtacgacggtagacgcgtaacacgttatacgttagcgtagggaccgtggacgacgacgaaccgntaaccgtgttaccggttacgttcggggacggttaaacgggaccctaaaggccgtttaaccgacccggttcgttacggacctaaccgggtacccaggttccccgtaccccggg

SEQ ID NO: 112727 - DNA, 820 bp, Homo sapiens
  misc_feature: GYAE6OF02ITJ79.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggactccgtggcctcctatgagctgactcacgcccaccctcagtcgtcccgtcgtccccgacggacacgacgacgacccgaggactccacctcgctcgtaggaagaagttaaaggttggggaaataaaagtacgtgtccttaggtactggtactacgtagaccaaggacggacccgtacggccaaccggttccccgtacggtaacgtcggtacctattccgtaactaaccgtaaaggtaacctaaaacgtaacgggccccggtacccgtacgtaacgggtaccgtacccgttcgaccggtacgtaccgtttcgtaccgtacggtcccgtaaacccggtaaccttaccgggttaaacgggaaacccgtaacggacccggtaaccctaccgtttaaccgaaccgttaacccggtaaccttcccgggtaaaccgggggaccccgggttaaacccgggtaccgggtaccgtaaaccgggtacgtaacgggtaccggtacgttacgtaaaccgttctaacggtccgacgggtcgacgggtacgaacgtagacgtacgcgtacctaggttcggtacgggtttaccggacggggtacctaacggtaccggaccgttaccggtaccgttcccgggttaacggtacccggtagtaaccccggtaacggtccccggtacccggttacccccggg

SEQ ID NO: 112728 - DNA, 721 bp, Homo sapiens
  misc_feature: GYAE6OF02JF4WC.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggctccttgcttactgcacaggactccgtggcctcctatgagctgactcacgccacctcagtcgtccgtcgtcccgaggacacgacacgaccgaggacacacctgtctacgtaggtagtaagttaaggtaggggtaataaacgtatacgtcgttagtacgttggtatacgagtacgaacggacgaccgacggaccgtacgttcccgtagttaccgtacgtactactactaacgtacaaagtaactaaccgaaccgtccgtaccgtacggaacggacctaccgtacggacgtacgtacgttcgtacgtcgacctactaacgtaccgtaacggactaacgacgtacctacgtacctacgaactccggacggaccggaccggtacgtacggtacgaacggttgacgtacgtaactcggtaacttaaccgttacgtccgtacggacgggtaccgtacgggaactacgaccgtacgaaccgttacggttagttccggggttaacgggttaccgggaacgggaaccgtaacggtaccggttaccggtacgttaaccccggtcgttacggtaccaacccgggtacaccccgggttcctacccccggttaccgg

SEQ ID NO: 112729 - DNA, 610 bp, Homo sapiens
  misc_feature: GYAE6OF02H1KBD.8.12.B01.1.454.CMB.1.raw
  modified_base (174)..(174): a, c, t, g, unknown or other
  misc_feature (174)..(174): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
  modified_base (288)..(288): a, c, t, g, unknown or other
  misc_feature (288)..(288): n is a, c, g, or t
  modified_base (365)..(365): a, c, t, g, unknown or other
  misc_feature (365)..(365): n is a, c, g, or t
  modified_base (445)..(445): a, c, t, g, unknown or other
  misc_feature (445)..(445): n is a, c, g, or t
tcagctcgcgtgtccacgaccggtgctcgatttagtagtgtagattccgcggggctgggcctcaggaagcagcatcggaggtgcctcagccatggcatgtatccctctcttcctcggcgtccttgcttactgcacaggatccgtggcctctatgagctgactcagccaccctcngtcgtccgtgccccaggacagacacgccaggatcacctgctntagganattaagtgggataatatgcttagctggtacnagcagagcncggcacgtccctgctgtacatcttanacaagacaacagccggtcctagaggactccgtagacgtacgtctcttccgcggttcaaccgaacgtcaacgggaacnccaatcccgacgttcgacctacacgtacaccgggtacggaacccaggacgtacgagtaggaacgctaaggtccttaagtntacgcggtaacggtcggacgacgtagacgacgtacgtactaaggttcgttaccgggtttacgggacgggtaaccggaaccggttaaacgcgttaccggtacccgtttacggttccgggtaccaaccggtaaccccggtggtaccccgttcccgtaaccccccggg

SEQ ID NO: 112730 - DNA, 699 bp, Homo sapiens
  misc_feature: GYAE6OF02FYCK7.8.12.B01.1.454.CMB.1.raw
  modified_base (299)..(299): a, c, t, g, unknown or other
  misc_feature (299)..(299): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtcccaggacagacagccaggatcacctgctctggagataaagttggggaataaatagtgcttgctggtatcgagcgagaggccagccacgtcccctaggtactggtctatctanacaagataaacgacgccggtccctacggagggtacctacccgtaggacgtacgtacttcctcgtcggtccttacccgtaaccttcgtaacggggaaactaccgacggtccctactcgtaccgacctacgtacgacgggacccgggacccgtaacgggccgtaacggtagtcggacgggtcctagtaaccgttacttaacgtcggtacggtacgggcgggttacgggacgtacggacaccgaaccgttaaccggttcggttacgggttttccgggtttacggggacccggggtaacggggaacccgtaagggtaccgtcccgggttaacccgttccggtttacgggtacccggtaaccggaaccccggtaccgggtacccgttccccgggtaccccccggg

SEQ ID NO: 112731 - DNA, 659 bp, Homo sapiens
  misc_feature: GYAE6OF02I3V4F.8.12.B01.1.454.CMB.1.raw
  modified_base (258)..(258): a, c, t, g, unknown or other
  misc_feature (258)..(258): n is a, c, g, or t
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggactccgtggcctcgtatgagctgactcacgcccaccctcagtcgtccgtcgtcccaggacagacagaccaggacttcacctgcctctggactaagtaaaggttggggaataatagttcgnttggcgttagtactcgagacaaggcgtaccgaacgggtcccaccggttccccttaggtaccgttcggtctactacgtactaaccaagtaacgtaaaccgacggtacccgccgtacgaccggtacttcccggagacgacgtcttcgtctccgtactaccgacgtacgaggtaaccacgtacgtaccncgttcacgtacancgaacggccgacctaggaccgagtctaggacgtacacgttactagttccgtaggacggacggtacggtacggccgtagccgttaacacgtacgttgtacggtttccgggtagccgggtaccggtaaccgtaacgtcgggaaccgttcggttaccgtaggtacccgtacggacccgttacccggcccggttcccgtaccccgg

SEQ ID NO: 112732 - DNA, 705 bp, Homo sapiens
  misc_feature: GYAE6OF02JG24L.8.12.B01.1.454.CMB.1.raw
  modified_base (466)..(466): a, c, t, g, unknown or other
  misc_feature (466)..(466): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacacgccgaggactccgacctcgctcgtaggagtaataaaggttggggaattaaagtagtaggtcttagtcgtggtaatcgagcgaggacggccacggccaccgtcccctgtacgtggtacactactagtacaaagtaactaaacgaacggcccgtacccgtacgaacgggtacctcccgaggaacgtcgtacttccgttacgtcggaccttaccgacgttacgacggtaacaccgaccgtaccaccgttaccgcgtaaccctacnccggaaccgggtacccgggaacccgtacggtacggtaaccggtagtaccggacggtaccttacgtaccttaacgttcgtcgtacggtagggacggtacggaacgactaccggaagttcccgaagtttacggtgggtttaccgggttcgggaacgggtaacggtcccgtaaggtcccgtaccggttcggttccgtacggtaccgacccgtaccggaccggtcccgtaccccggtccccgg

SEQ ID NO: 112733 - DNA, 712 bp, Homo sapiens
  misc_feature: GYAE6OF02JWC35.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtgtcctcgtccccaggacagacacgccaggatccacctgactctggagaataagtggggtaataaatagagtcgttgacgttaggtactacgagacgacggaggcccaagggccctaccgttccctcggttacgtggttacctacttcgtataacaataacaacgtacggaacccggtccctacgtaacgggacccttccgaggtacggaccttacgtccgttactaccggttacttaaccaaaccgttccggtaacgggtaaacccaccggaactacccgtaaccggtcctaaccggacctaacctacggaccggggaaccccgacgttaccggaaacgtccgggaagttcggaacggtcgtacgtaacgttcgttaccgtaggtacccgtagggtacggttaccgggacgtaccgtagtacctaacggtacccgtttaggtcggtttacgggttacggtacggaaccggtcggtaacgtcggtccgtacggtttaccgcggtacgaccgccggtaccggtctcccgggtaccc

SEQ ID NO: 112734 - DNA, 732 bp, Homo sapiens
  misc_feature: GYAE6OF02HU5GJ.8.12.B01.1.454.CMB.1.raw
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
tcagctcgcgtgtccacgaccggtgctcgatttagtagtgtagattccgcgggctgggcctcaggaagcagcatcggaggtgcctcagccatggcatggatcctctcttcctcggcgtcctgcttactgcacagactccgtcggcctacctatgagctgactcacgcccaccctcgagtggtcccgtcgccccgaaggacaggacacgccaggactcaccgtgctgtaggagaataaggttaggggaataaagtagtntcgttagctaggtactcacggnaggacgaccgaggtacctacggtcccgtagtaccgtggtacctatcttaacgacaagtaacaacgacggaccgtaccgacgtacggaccttcgaggtacgcgtaactccgtggtacccgtagtaccaacgttccggaacggaaccacggacctaccgtaactacgtacgtaacctaacggttacgaacgggccgtaaaccgcggtaaccgggagtacgaagtccggtaacgtagtaaccttaaccggttatacggtacggaacgggtaccggtaacggggacaaaccggtacgtaggtaccccgtttaacgttacgggtaggtttaccggggttacccgggaaccggggtacgtaaacccgggtacgttcggaaccggtttacccggttaccggttagtaccccgggaacgtacccgggtaaccgttaccccggccggtttaacccccccgg

SEQ ID NO: 112735 - DNA, 749 bp, Homo sapiens
  misc_feature: GYAE6OF02IX715.8.12.B01.1.454.CMB.1.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccatggcctcctatgagctgactcacgcccaccctcagtcgtccgtcgtccccgacggacaggacgagaccgaggactcacctgcgtcgtaggaagtacgttaaaggttagggggaattaaagtagtgtcgttggtcgttaggtatacgagcgagacggaccgaggacccacgtccccgtaggtacgtcggtacacttactatacaacgtaactaacgaacggccggaccgtacggacgggacctaccgtaggacgtacgtacttccgtcgtacggtcctaccgaacttacggacggtaaaccgacgaccggtaccctatacccgtacgtaaccctacgtacgacccgggaccggtaacccgaacgggtccgtaaacgggtacggaccggtacggttccgttaacgtaacgtttacgttaaccgtgggtaaacgtacggggtcgtaaggggacaacgtaccggtacgtactaaccgggttaggttcgggttttaccgggttccgggaacgggggtaaccggtaacctcgggtaacccggttaccggtacccggtttaccggttcgggaccctaaccggggaccccgttaccggggtccttacccccggg

SEQ ID NO: 112736 - DNA, 849 bp, Homo sapiens
  misc_feature: GYAE6OF02H0FW7.8.12.B01.1.454.CMB.1.raw
  modified_base (136)..(136): a, c, t, g, unknown or other
  misc_feature (136)..(136): n is a, c, g, or t
tcagctcgcgtgtccacgaccggtgctcgatttagtagtgtagattccgcggggctgggcctcaggaagcagcatcggaggtgcctcagccatggcatggactcctctcttccgtcggtcgtcttgcttactgcanaggctcgtgcctctatgagctgactcacgcccacctcagtcgtccgtcgtcccaggacagacacgcaggactcactgctcaggagtaataaggtggggaataagtactggtaccgttgacgtttaggtactcacgacggacggaacggcccgaacggacccgtaccggtaccccttacgggttacgttaccggtaccttaaggttaccttaacgttaacgaaaacgtaaacgtaaccaaaccgggcccggttacccgtaccggggtaaaccggttccctacccggtagtaacccggtcgtttacgttaccggttaccggtccgttaacccgttacccgtaaaccggtttaccggggttaaaaccggtaacccgtaccggacccgtttacccgttaacccgttttaccggaaccgtaacccggtacggttaccccgggaaaccgggttcccgggaaaacccgggtcgggtaacccgttacgggtacgtaacggtacccgggttattacccggttaacgttacgtacgtcggttacggcggtaccgggtacggaactacggaccgtaccgtacggttaactcgggtttacggtttccgggttaccgggggtaaccgtacgggtaacccgttaacggcccgttaaccgggtccgttcgtttacccgggaaccgttaccccggaccccgggttactcccggaccccggtttccccgg

SEQ ID NO: 112737 - DNA, 818 bp, Homo sapiens
  misc_feature: GYAE6OF02I04MD.8.12.B01.1.454.CMB.1.raw
  modified_base (140)..(140): a, c, t, g, unknown or other
  misc_feature (140)..(140): n is a, c, g, or t
  modified_base (371)..(371): a, c, t, g, unknown or other
  misc_feature (371)..(371): n is a, c, g, or t
  modified_base (643)..(643): a, c, t, g, unknown or other
  misc_feature (643)..(643): n is a, c, g, or t
  modified_base (791)..(791): a, c, t, g, unknown or other
  misc_feature (791)..(791): n is a, c, g, or t
tcagctcgcgtgtccacgaccggtgctcgatttagtagtgtagattccgcggggctgggcctcaggaagcagcatcgggaggtgcctcagccatggcatggatccctctcttcctcggcgtccttgcttactgcacaggntccgtcgtcctacctagtggacgtctcgtactaccacgcccctaccctcgtacggtcgtccgtccgtaccccgaggaacagacgacgaccgagactacaccgtcgactcgtaggaagtaagttaaagggttaacggggaattaaatacgttagtctaggtcgtagtactacgacgacggtaacggcgaccggaccgtaccgcccgttccgtagtcgtgtactacgtactanacgtaaagactaaacgaccgccgtaccgtagtaccggtactaccgaaggtccgtacgttacctcgtcgtacgttaccctacgtaacgtacggtaacgacccaaagcccgttaacctacgtaaccgttaccgaaactacggtacccggtaacgggaccccgggtaaccgtaaccggttaacggaacggttaccgggtaacggaaacgtttaccggtaacggtaaaccgtttagttcccgggtaacgggtaccgggtacggtacccggggtaanaccggtaaacgacgggtaacccgtacgggttaaacgtttggggttttaccggtacggggtttacccggacgggaacccgggtaacggtacccgtaggtttaccccgggtcgttaaccggtcggttaacccggaccggtttaccccggnggttaccccgggtcccgttaaccccgg

SEQ ID NO: 112738 - DNA, 866 bp, Homo sapiens
  misc_feature: GYAE6OF02H9LMK.8.12.B01.1.454.CMB.1.raw
tcagctcgcgtgtccacgaccggtgctcgatttagtagtgtagattccgcggggcgtgggcctcaggaagcagcatcggaggtgcctcagccatggcatggatccctctcttcctcgcgtctgcttactgcacaggactccgtcggcctcctatgacgtctagactcgacgcccaccctcgagtcgtccgttcgtcccgaggacagacacgtcaggactccacctgcctacgtcggagaagttaagttgggggaaataaagttatgtacgttcgtacgttaggtactcgtacgacgacggtacggacccgacgggcccttaacccggttcccgtacggtttacccgtagggttacctaccgtactacgtaccgtaaaagtaaccgttaaaccgaaacggtccccggtaccgttaaccggaacgggttaccgtaccccgtaggtaaccggtaccgtttacgttcccgttacggttacggtacccgtaacccgtaccggtttaccggtaaccgggtaaaccgtacccgtaccgtacccccggttaaccttccgtaacccgttaacccgaacgggtttaaccggtaacccgggacccgggtaaacccgaccgggttaacccggtaacggtacggtacgtacgggttcttaacgtaccttacgttaccggtgtaccggtacgggttcggtacgggaactaccgggtacgtaaccgtccgttaaccgttcggttacgggtttacggggttccggaccggggtaacccgtccgggtaaaccgggttccggtacccgggttaacccgtttcgggttaaccgtcccggtaaccggtccccggtacgggtacccccgttaccccggttccccggg

SEQ ID NO: 112739 - DNA, 688 bp, Homo sapiens
  misc_feature: GYAE6OF02FU2N1.8.12.B01.1.454.CMB.1.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (304)..(304): a, c, t, g, unknown or other
  misc_feature (304)..(304): n is a, c, g, or t
tcagctcgcgtgtccacgaccggtgctcgatttagtagtgtagattccgcggggctgggcctcaggaagcagcatcggaggtgcctcagccatggcatggatccctcttcttcctcggcgtccttgcttactgcacaggatccgtggcctcctatgagctgactcacgccaccctcagtcgtccgtcgtccccaggacagacagccaggactcacctnctctgagataagtggggataanatgcttgctgtatcgagtcgacgagccaggcctagtcccctagtactggtcatactatacgaanactaacacgccgcctacggacggtactcccgtagacgtcgtacttcgtcgtacgcctaccgaccgtacgtacggaacgttaccaccgtaccaccgttactaccggaaccacgttacgaaccgggcccgggtaaacccgcgggtaacccgtaaggggtactagggaaccggtgttaaccgttccgttaaagtttccggtacgtacggtaacgggtacggttaccggggactacggccgaccgggttactaaccggtagtttacggggtttacgggtttaccgggacggtaaccgggtaacgtaacggtacggttacccgtaccggttcggttacccggtccggtaaccgtcccggaccgggtttacccgccccggttacccccgg

SEQ ID NO: 112740 - DNA, 238 bp, Homo sapiens
  misc_feature: GYAE6OF01C2P3D.3.38.D05.1.454.CMB.1.raw
  modified_base (235)..(238): a, c, t, g, unknown or other
  misc_feature (235)..(238): n is a, c, g, or t
tcagagacgcactccacgaccggtgctcgatttagtatctgatagttggttggagtggattaacgttgacgactgggccaggagcctggtcaccgtctcctcagcctccaccaagggcccatcggtcttccctggcacctcctccaagagcacctctggggcacagcggccctgggctgcctggtcaaggactacttccgagtgcgtctctgagcgggctggcaaggcgcatagnnnn

SEQ ID NO: 112741 - DNA, 250 bp, Homo sapiens
  misc_feature: GYAE6OF01BPW9Y.3.38.D05.1.454.CMB.1.raw
  modified_base (245)..(250): a, c, t, g, unknown or other
  misc_feature (245)..(250): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttcccctggcaccctcctccaagagcacctctgggggcacagcggccctgggctgcctggtcaaggactacttccgagtgcgtctctgagcgggctggcaaggcgcatagnnnnnn

SEQ ID NO: 112742 - DNA, 260 bp, Homo sapiens
  misc_feature: GYAE6OF01DCK8J.3.38.D05.1.454.CMB.1.raw
  modified_base (249)..(260): a, c, t, g, unknown or other
  misc_feature (249)..(260): n is a, c, g, or t
tcagagacgcactccacgaccggtgctcgatttagtatctgatagttgggtttgggagtggattaacgtttgacgactggggccagggagccctggtcaccgtctcctcagcctccgaccaagggcccatcggtcttccccgtggcaccctcctccaagagcacctctgggggcacagcggccctgggctgcctggtcaaggctacttccgagtgcgtctcgtggagcgggctgggcaaggcgcatagnnnnnnnnnnnn

SEQ ID NO: 112743 - DNA, 246 bp, Homo sapiens
  misc_feature: GYAE6OF01A5B3A.3.38.D05.1.454.CMB.1.raw
  modified_base (245)..(246): a, c, t, g, unknown or other
  misc_feature (245)..(246): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttcccctggcaccctcctccaagagcacctctgggggcacagcggccctgggctgcctggtcaaggactacttccgagtgcgtctctgagcgggctggcaaggcgcatagnn

SEQ ID NO: 112744 - DNA, 245 bp, Homo sapiens
  misc_feature: GYAE6OF01AW3ED.3.38.D05.1.454.CMB.1.raw
  modified_base (244)..(245): a, c, t, g, unknown or other
  misc_feature (244)..(245): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttcccctggcaccctcctccaagagcacctctggggcacagcggccctgggctgcctggtcaaggactacttccgagtgcgtctctgagcgggctggcaaggcgcatagnn

SEQ ID NO: 112745 - DNA, 247 bp, Homo sapiens
  misc_feature: GYAE6OF01C9I65.3.38.D05.1.454.CMB.1.raw
  modified_base (243)..(247): a, c, t, g, unknown or other
  misc_feature (243)..(247): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccctggcacctcctccaagagcacctctgggggcacagcggccctgggctgcctggtcaaggactacttccgagtgcgtctctgagcgggctggcaaggcgcatagnnnnn

SEQ ID NO: 112746 - DNA, 251 bp, Homo sapiens
  misc_feature: GYAE6OF01EJ4ZD.3.38.D05.1.454.CMB.1.raw
  modified_base (244)..(251): a, c, t, g, unknown or other
  misc_feature (244)..(251): n is a, c, g, or t
tcagagacgcactccacgaccggtgctcgatttagtatctgatagttgggtttgggagtggattaacgtttgacgactggggccagggagccctggtcaccgtctcctcagcctccaccaaggcccatcggtcttcccctggcaccctcctccaagagcacctctgggggcacagcggccctgggctgcctggtcaaggactacttccgagtgcgtctctgagcgggctggcaaggcgcatagnnnnnnnn

SEQ ID NO: 112747 - DNA, 246 bp, Homo sapiens; identical to SEQ ID NO: 112743
  misc_feature: GYAE6OF01EFXYK.3.38.D05.1.454.CMB.1.raw
  modified_base (245)..(246): a, c, t, g, unknown or other
  misc_feature (245)..(246): n is a, c, g, or t

SEQ ID NO: 112748 - DNA, 248 bp, Homo sapiens
  misc_feature: GYAE6OF01EXMJZ.3.38.D05.1.454.CMB.1.raw
  modified_base (244)..(248): a, c, t, g, unknown or other
  misc_feature (244)..(248): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttcccctggcaccctcctccaagagcacctctggggcacagcggccctgggctgcctggtcaaggactacttccgagtgcgtctctgagcgggctggcaaggcgcatagnnnnn

SEQ ID NO: 112749 - DNA, 246 bp, Homo sapiens
  misc_feature: GYAE6OF01E4ITM.3.38.D05.1.454.CMB.1.raw
  modified_base (245)..(246): a, c, t, g, unknown or other
  misc_feature (245)..(246): n is a, c, g, or t
tcagagacgcactccacgaccggtgctcgatttagtatctgatagttgggtttgggagtggattaacgtttgacgactgggccagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnn

SEQ ID NO: 112750 - DNA, 246 bp, Homo sapiens; identical to SEQ ID NO: 112743
  misc_feature: GYAE6OF01CXUAU.3.38.D05.1.454.CMB.1.raw
  modified_base (245)..(246): a, c, t, g, unknown or other
  misc_feature (245)..(246): n is a, c, g, or t

SEQ ID NO: 112751 - DNA, 247 bp, Homo sapiens
  misc_feature: GYAE6OF01DFX1Y.3.38.D05.1.454.CMB.1.raw
  modified_base (244)..(247): a, c, t, g, unknown or other
  misc_feature (244)..(247): n is a, c, g, or t
tcagagacgcactccacgaccggtgctcgatttagtatctgatagttgggtttgggagtggattaacgtttgacgactgggccagggagccctggtcaccgtctcctcagcctccaccaagggcccatcggtcttcccctggcaccctcctccaagagcacctctgggggcacagcggccctgggctgcctggtcaaggactacttccgagtgcgtctctgagcgggctggcaaggcgcatagnnnn

SEQ ID NO: 112752 - DNA, 249 bp, Homo sapiens
  misc_feature: GYAE6OF01B85WL.3.38.D05.1.454.CMB.1.raw
  modified_base (245)..(249): a, c, t, g, unknown or other
  misc_feature (245)..(249): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttcccctggcaccctcctccaagagcacctctgggggcacagcggccctgggctgcctggtcaaggactacttccgagtgcgtctctgagcgggctggcaaggcgcatagnnnnn

SEQ ID NO: 112753 - DNA, 249 bp, Homo sapiens
  misc_feature: GYAE6OF01CAEZT.3.38.D05.1.454.CMB.1.raw
  modified_base (246)..(249): a, c, t, g, unknown or other
  misc_feature (246)..(249): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnn

SEQ ID NO: 112754 - DNA, 260 bp, Homo sapiens
  misc_feature: GYAE6OF01B7RLE.3.38.D05.1.454.CMB.1.raw
  modified_base (246)..(260): a, c, t, g, unknown or other
  misc_feature (246)..(260): n is a, c, g, or t
tcagagacgcactccacgaccggtgctcgatttagtatctgataggttgggtttgggagtggattaacgtttgacgactggggccagggagccctggtcaccgtctcctcagcctccaccaagggcccatcggtcttcccctggcaccctcctccaagagcacctctgggggcacagcggccctgggctgcctggtcaaggactacttccgagtgcgtctctgagcgggctggcaaggcgcatagnnnnnnnnnnnnnnn

SEQ ID NO: 112755 - DNA, 316 bp, Homo sapiens
  misc_feature: GYAE6OF01BWJV6.3.38.D05.1.454.CMB.1.raw
  modified_base (253)..(254): a, c, t, g, unknown or other
  misc_feature (253)..(254): n is a, c, g, or t
  modified_base (256)..(316): a, c, t, g, unknown or other
  misc_feature (256)..(316): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatccggtcttccccctggcaccctcctccaagacgcaccctctgggggcacagcggccctgggctgccctggtcaaggactacttccgagtgcgtctcgtgagcgggctggcgaagggcgcatagnngnnnnnnnnnnnnnnnnnnnnnnnnnnnnnnnnnnnnnnnnnnnnnnnnnnnnnnnnnnnnn

SEQ ID NO: 112756 - DNA, 265 bp, Homo sapiens
  misc_feature: GYAE6OF01BHDVQ.3.38.D05.1.454.CMB.1.raw
  modified_base (245)..(265): a, c, t, g, unknown or other
  misc_feature (245)..(265): n is a, c, g, or t
tcagagacgcactccacgaccggtgctcgatttagtatctgatagttgggtttgggagtggattaacgtttgacgactgggccagggagccctggtcaccgtctcctcagcctccaccaaggcccatcggtcttcccctggcaccctcctccaagagcacctctgggggtcacagcggccctgggctgcctggtcaaggactacttccgagtggcgtctctgagcgggctggcaaggcgcatagnnnnnnnnnnnnnnnnnnnnn

SEQ ID NO: 112757 - DNA, 246 bp, Homo sapiens; identical to SEQ ID NO: 112743
  misc_feature: GYAE6OF01C8H54.3.38.D05.1.454.CMB.1.raw
  modified_base (245)..(246): a, c, t, g, unknown or other
  misc_feature (245)..(246): n is a, c, g, or t

SEQ ID NO: 112758 - DNA, 247 bp, Homo sapiens
  misc_feature: GYAE6OF01DF1EJ.3.38.D05.1.454.CMB.1.raw
  modified_base (246)..(247): a, c, t, g, unknown or other
  misc_feature (246)..(247): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnn

SEQ ID NO: 112759 - DNA, 247 bp, Homo sapiens; identical to SEQ ID NO: 112758
  misc_feature: GYAE6OF01ENTLM.3.38.D05.1.454.CMB.1.raw
  modified_base (246)..(247): a, c, t, g, unknown or other
  misc_feature (246)..(247): n is a, c, g, or t

SEQ ID NO: 112760 - DNA, 246 bp, Homo sapiens
  misc_feature: GYAE6OF01E2NUL.3.38.D05.1.454.CMB.1.raw
  modified_base (246)..(246): a, c, t, g, unknown or other
  misc_feature (246)..(246): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagn

SEQ ID NO: 112761 - DNA, 249 bp, Homo sapiens; identical to SEQ ID NO: 112752
  misc_feature: GYAE6OF01DIF9Z.3.38.D05.1.454.CMB.1.raw
  modified_base (245)..(249): a, c, t, g, unknown or other
  misc_feature (245)..(249): n is a, c, g, or t

SEQ ID NO: 112762 - DNA, 248 bp, Homo sapiens
  misc_feature: GYAE6OF01B9KXQ.3.38.D05.1.454.CMB.1.raw
  modified_base (245)..(248): a, c, t, g, unknown or other
  misc_feature (245)..(248): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcacctcctccaagagcacctctgggggcacagcggccctgggctgcctggtcaaggactacttccgagtgcgtctctgagcgggctggcaaggcgcatagnnnn

SEQ ID NO: 112763 - DNA, 264 bp, Homo sapiens
  misc_feature: GYAE6OF02G8M75.3.38.D05.1.454.CMB.1.raw
  modified_base (245)..(264): a, c, t, g, unknown or other
  misc_feature (245)..(264): n is a, c, g, or t
tcagagacgcactccacgaccggtgctcgatttagtatctgatagttgggtttgggagtggattaacgtttgacgactgggccagggagccctggtcaccgtctcctcagcctccaccaagggcccatcggtcttccccctggcaccctcctccaagagcgacctctgggggcacagcggccctgggctgcctggtcaaggctacttccgagtgcgtctctgagcgggctggcaaggcgcatagnnnnnnnnnnnnnnnnnnnn

SEQ ID NO: 112764 - DNA, 250 bp, Homo sapiens
  misc_feature: GYAE6OF02FIYQ9.3.38.D05.1.454.CMB.1.raw
  modified_base (245)..(250): a, c, t, g, unknown or other
  misc_feature (245)..(250): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctggggcacagcggccctgggctgcctggtcaaggactacttccgagtgcgtctctgagcgggctggcaaggcgcatagnnnnnn

SEQ ID NO: 112765 - DNA, 243 bp, Homo sapiens
  misc_feature: GYAE6OF02F11A1.3.38.D05.1.454.CMB.1.raw
  modified_base (242)..(243): a, c, t, g, unknown or other
  misc_feature (242)..(243): n is a, c, g, or t
tcagagacgcactccacgaccggtgctcgatttagtatctgatagttgggtttggagtggattaacgtttgacgactgggccagggagccctggtcaccgtctcctcagcctccaccaagggcccatcggtcttcccctggcaccctcctccaagagcacctctggggcacagcggccctgggctgcctggtcaaggactacttccgagtgcgtctctgagcgggctggcaaggcgcatagnn

SEQ ID NO: 112766 - DNA, 249 bp, Homo sapiens; identical to SEQ ID NO: 112753
  misc_feature: GYAE6OF02G0CFY.3.38.D05.1.454.CMB.1.raw
  modified_base (246)..(249): a, c, t, g, unknown or other
  misc_feature (246)..(249): n is a, c, g, or t

SEQ ID NO: 112767 - DNA, 249 bp, Homo sapiens; identical to SEQ ID NO: 112753
  misc_feature: GYAE6OF02GB1V9.3.38.D05.1.454.CMB.1.raw
  modified_base (246)..(249): a, c, t, g, unknown or other
  misc_feature (246)..(249): n is a, c, g, or t

SEQ ID NO: 112768 - DNA, 249 bp, Homo sapiens; identical to SEQ ID NO: 112753
  misc_feature: GYAE6OF02FL5UG.3.38.D05.1.454.CMB.1.raw
  modified_base (246)..(249): a, c, t, g, unknown or other
  misc_feature (246)..(249): n is a, c, g, or t

SEQ ID NO: 112769 - DNA, 247 bp, Homo sapiens; identical to SEQ ID NO: 112758
  misc_feature: GYAE6OF02HKM04.3.38.D05.1.454.CMB.1.raw
  modified_base (246)..(247): a, c, t, g, unknown or other
  misc_feature (246)..(247): n is a, c, g, or t

SEQ ID NO: 112770 - DNA, 248 bp, Homo sapiens
  misc_feature: GYAE6OF02IXN4F.3.38.D05.1.454.CMB.1.raw
  modified_base (246)..(248): a, c, t, g, unknown or other
  misc_feature (246)..(248): n is a, c, g, or t
tcagagacgcactccacgaccggtgctcgatttagtatctgatagttgggtttgggagtggattaacgtctgacgactggggtcagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnn

SEQ ID NO: 112771 - DNA, 248 bp, Homo sapiens
  misc_feature: GYAE6OF02F37VT.3.38.D05.1.454.CMB.1.raw
  modified_base (246)..(248): a, c, t, g, unknown or other
  misc_feature (246)..(248): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnn

SEQ ID NO: 112772 - DNA, 248 bp, Homo sapiens; identical to SEQ ID NO: 112771
  misc_feature: GYAE6OF02HNXJ3.3.38.D05.1.454.CMB.1.raw
  modified_base (246)..(248): a, c, t, g, unknown or other
  misc_feature (246)..(248): n is a, c, g, or t

SEQ ID NO: 112773 - DNA, 247 bp, Homo sapiens
  misc_feature: GYAE6OF02FJTYH.3.38.D05.1.454.CMB.1.raw
  modified_base (245)..(247): a, c, t, g, unknown or other
  misc_feature (245)..(247): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctgggggcacagcggccctgggctgcctggtcaagactacttccgagtgcgtctctgagcgggctggcaaggcgcatagnnn

SEQ ID NO: 112774 - DNA, 250 bp, Homo sapiens
  misc_feature: GYAE6OF02IY475.3.38.D05.1.454.CMB.1.raw
  modified_base (246)..(250): a, c, t, g, unknown or other
  misc_feature (246)..(250): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnn

SEQ ID NO: 112775 - DNA, 252 bp, Homo sapiens
  misc_feature: GYAE6OF02H8GKG.3.38.D05.1.454.CMB.1.raw
  modified_base (246)..(252): a, c, t, g, unknown or other
  misc_feature (246)..(252): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnn

SEQ ID NO: 112776 - DNA, 247 bp, Homo sapiens; identical to SEQ ID NO: 112758
  misc_feature: GYAE6OF02FLRZM.3.38.D05.1.454.CMB.1.raw
  modified_base (246)..(247): a, c, t, g, unknown or other
  misc_feature (246)..(247): n is a, c, g, or t

SEQ ID NO: 112777 - DNA, 248 bp, Homo sapiens; identical to SEQ ID NO: 112771
  misc_feature: GYAE6OF02ICBIY.3.38.D05.1.454.CMB.1.raw
  modified_base (246)..(248): a, c, t, g, unknown or other
  misc_feature (246)..(248): n is a, c, g, or t

SEQ ID NO: 112778 - DNA, 231 bp, Homo sapiens
  misc_feature: GYAE6OF02F5MMC.3.38.D05.1.454.CMB.1.raw
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggcg

SEQ ID NO: 112779 - DNA, 254 bp, Homo sapiens
  misc_feature: GYAE6OF02HRU3N.3.38.D05.1.454.CMB.1.raw
  modified_base (246)..(254): a, c, t, g, unknown or other
  misc_feature (246)..(254): n is a, c, g, or t
tcagagacgcactccacgaccggtgctcgatttagtatctgatagttgggtttgggagtggattaacgtttgacgactggggccagggagccctggtcaccgtctcctcagcctccaccaagggcccatcggtcttccccctggcaccctcctccaagagcacctctgggggcacagcggccctgggctgcctggtcaaggactacttccgagtgcgtctctgagcgggctggcaaggcgcatagnnnnnnnnn

SEQ ID NO: 112780 - DNA, 677 bp, Homo sapiens
  misc_feature: GYAE6OF02IPSEG.3.38.D05.1.454.CMB.1.raw
  modified_base (389)..(389): a, c, t, g, unknown or other
  misc_feature (389)..(389): n is a, c, g, or t
  modified_base (454)..(454): a, c, t, g, unknown or other
  misc_feature (454)..(454): n is a, c, g, or t
tcagagacgcactccacgaccggtgctcgatttagtatctgatagttgggtttgggggagtcagactcagtcaggacacagcatggacatgagggtccccgctcagctcctggggctcctgctgctctggcctcccaggtcgaccaaatgtgacatccagatcgacccagtcctcccctccaccctgtctgctatctgtaggagacggatcacatcacgtcgccggcagtcagagtattacgtaccgtggttcggccttaggtatcgacggacaaggaacgaccggaacgggaaaccgacccctaacctccgtagactcttagtacgtactccgacctccgtaggtttcggacgtaacggtcgggtcctagtacgtaggttcaggcggngtaggtggtagtcgtagggaatagtacttcgactcctacgacctagtacacgcacggtcctgacnccgcgtagacttcgttatttcgaaccttattacgtaccgtacgtaacctaacggttactaaacgttaccgttaccccggtgttaaccggtaccggttacccgggaagtaaccggggtaacctaagggggttcgtaaacgttcggttaaaccctaacggttaaaccgggttacgtacgggtttaacggcccgttaacggacccgttacccgttacgttaccggg

SEQ ID NO: 112781 - DNA, 250 bp, Homo sapiens; identical to SEQ ID NO: 112774
  misc_feature: GYAE6OF02JAY8T.3.38.D05.1.454.CMB.1.raw
  modified_base (246)..(250): a, c, t, g, unknown or other
  misc_feature (246)..(250): n is a, c, g, or t

SEQ ID NO: 112782 - DNA, 299 bp, Homo sapiens
  misc_feature: GYAE6OF02HHQ1D.3.38.D05.1.454.CMB.1.raw
  modified_base (259)..(299): a, c, t, g, unknown or other
  misc_feature (259)..(299): n is a, c, g, or t
tcagagacgcactccacgaccggtgctcgatttagtatctgataggttgggtttgggagtggattaacgtttgacgacctggggccagggagccccttggtcaccgtctcctcagcctccaccaagggccccatcggtcttccccctggccaccctcctccaagagcacctcgtgggggtcacagcggccctgggctgcctggtcaaggactacttccgagtcgcgtctctgaggcgggctggacaaggccgcgatagnnnnnnnnnnnnnnnnnnnnnnnnnnnnnnnnnnnnnnnnn

SEQ ID NO: 112783 - DNA, 154 bp, Homo sapiens
  misc_feature: GYAE6OF02H7UKI.4.30.C08.1.454.CMB.1.raw
  modified_base (154)..(154): a, c, t, g, unknown or other
  misc_feature (154)..(154): n is a, c, g, or t
tcagagcactgtagcacgaccggtgctcgatttagtctgacgtcaaagggaaagggaccaaggtggaaatcaaacgaactgtggctgcaccatctgtcttcatcttcccgccatctgactacagtgctctgagcgggctggcaaggcgcatagn

SEQ ID NO: 112784 - DNA, 160 bp, Homo sapiens
  misc_feature: GYAE6OF02F440M.4.30.C08.1.454.CMB.1.raw
  modified_base (154)..(160): a, c, t, g, unknown or other
  misc_feature (154)..(160): n is a, c, g, or t
tcagagcactgtagcacgaccggtgctcgatttagtctgacgtcaaagggaaagggaccaaggtggaaatcaaacgaactgtggctgcaccatctgtcttcatcttcccgccatctgactacagtgctctgagcgggctggcaaggcgcatagnnnnnnn

SEQ ID NO: 112785 - DNA, 154 bp, Homo sapiens; identical to SEQ ID NO: 112783
  misc_feature: GYAE6OF02F4ZBV.4.30.C08.1.454.CMB.1.raw
  modified_base (154)..(154): a, c, t, g, unknown or other
  misc_feature (154)..(154): n is a, c, g, or t

SEQ ID NO: 112786 - DNA, 565 bp, Homo sapiens
  misc_feature: GYAE6OF01C2R44.15.86.H09.1.454.CMB.1.raw
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
  modified_base (522)..(522): a, c, t, g, unknown or other
  misc_feature (522)..(522): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtggtttcgtgagtgctatacgtaaagtgtcagtgtgagtgcaggtggtggagtctgggggagccttggtaaagcctggggggtcccttagagtctcctgtgtggcctctggattcactttcagtaatggctggatgagttgggtccgccaggctccagggaaggggctgggagtgggttggacggtttcaaaagtaaaaatgaatggtagagaaaatagactacggtgcacccgtgaaaggaagattcaccatctcaagagaataattacaaaaacgacggttagtaatttgactaaaagtgaaacagcctagaaaaccgagacacagccgtctattacngtaccanagattcgaagtgcatcgacgtaaaggnggtctatgcttttgatagtcgtggggcccaggggcaagtcggg

SEQ ID NO: 112787 - DNA, 168 bp, Homo sapiens
  misc_feature: GYAE6OF01A8APO.15.86.H09.1.454.CMB.1.raw
  modified_base (166)..(168): a, c, t, g, unknown or other
  misc_feature (166)..(168): n is a, c, g, or t
tcagtctacgtagccacgaccggtgctcgatttagtgctatagacttgggtttgggggagaggagccccagccttgggatccccaagtgtttcattcagtgatcaggactgaacacagaggactcaccatggagttcgggctgagcgggctggcaaggcgcatagnnn

SEQ ID NO: 112788 - DNA, 558 bp, Homo sapiens
  misc_feature: GYAE6OF01EUING.15.86.H09.1.454.CMB.1.raw
  modified_base (515)..(515): a, c, t, g, unknown or other
  misc_feature (515)..(515): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcggtggtttcgtgagtgctatacgttaaaggtgtcagtgtgaagtgcaggtggtggagtctgggggagccttggtaaagcctggggggtcccttagagtctcctgtgtggcctctggattcactttcagtaatggctggatgagttgggtccgccaggctccgagggaagggctggagtggggttggacgtttcaaagtaaaatgatggtgagaaaatgactacggtgcacccgtgaaaggagattcacatctacaagagataattacaaaaacgacggtgtatttgacaaatgaacagcctagaaaacccgaggacacagcctatattactgtaccacagattcggaagtgcagtcgaacgtaaaggnggctatggcttttgatattcgnggggacccagggacagtcggg

SEQ ID NO: 112789 - DNA, 166 bp, Homo sapiens
  misc_feature: GYAE6OF01EFEPT.15.86.H09.1.454.CMB.1.raw
  modified_base (166)..(166): a, c, t, g, unknown or other
  misc_feature (166)..(166): n is a, c, g, or t
tcagtctacgtagccacgaccggtgctcgatttagtgctatagacttgggtttgggggagaggagccccagccttgggatccccaagtgtttcattcagtgatcaggactgaacacagaggactcaccatggagttcgggctgagcgggctggcaaggcgcatagn

SEQ ID NO: 112790 - DNA, 622 bp, Homo sapiens
  misc_feature: GYAE6OF01ED348.15.86.H09.1.454.CMB.1.raw
  modified_base (302)..(302): a, c, t, g, unknown or other
  misc_feature (302)..(302): n is a, c, g, or t
  modified_base (342)..(342): a, c, t, g, unknown or other
  misc_feature (342)..(342): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgttgacgtgctatacttaaaggtgtccagtgtgaagtgcaggtggtggagtctgggggagccttggtaaagccgtggggggtcccttagagtctcctgtgtggcctctggattcactttcagtaatggctggatgagttgggtccnccaggctccagggaaggggctggagtgggttggacgtttnaaagtaaaatgatggtgagaaaatgactacggtgacacccgtgaaaggaagattcaccatctacaaagagataattacaaaaacgtcggtatatttgacaaatgaaacagacccgaaaaccgaggaacacagtcccgtactaattactcgtaccaacagattacgggaatgactagtacggaaacgttaaaagggaggactaagttggtacttttttggaaacttagttaccgttaggggggaccccctaagggggaaccctaagttggggttacccggg

SEQ ID NO: 112791 - DNA, 564 bp, Homo sapiens
  misc_feature: GYAE6OF01EITU4.15.86.H09.1.454.CMB.1.raw
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
  modified_base (517)..(517): a, c, t, g, unknown or other
  misc_feature (517)..(517): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggtttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccaggggaaggggctggagtggggttggacgtttcaaagtaaaatgatggtgagaaaatagactacggtgcacccgtgaaaggagattcaccatctcaagagataattcaaaaacgacggtagtatttgactaaatgaacagacctagaaaaccgaggacacagccgtntatactgtaccanagattcggaagtgcatcgacgtaaaggnggctaagtgtctttgattagtcgtggggacccaggggcaagttcggg

SEQ ID NO: 112792 - DNA, 508 bp, Homo sapiens
  misc_feature: GYAE6OF01EWLX1.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacggatccccgatcgcttcatgggctccagttctggggctgaccgctacctcaccatctccaacctccagtctgacgatgaggctgagtatcactgtggagagagccacacaattgatggccaagacggttggtgttcggcggagggaccagctgaccgtctaggtcgacgg

SEQ ID NO: 112793 - DNA, 530 bp, Homo sapiens
  misc_feature: GYAE6OF01DFCBX.15.86.H09.1.454.CMB.1.raw
  modified_base (185)..(185): a, c, t, g, unknown or other
  misc_feature (185)..(185): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctcgatcaagctcacctgccacctaagtgtgagcatcgaacctacaccatcgaatggtatcaacagagaccagggagtccccccaggtatactaatcgaaagttaagagtagatggcagccacaccgaaggggacggatccccgatcgcttcatgggctccagttctggggctgaccgtctacctcaccatcgtaccaaccctcaagtctgacgatgaggctgagtactcacgtgtggagagagccaacacattgatggccaagcggttgggtgttcgggcgggaacggaccgaagtcgtacgaccgtctacggtctaaccggg

SEQ ID NO: 112794 - DNA, 545 bp, Homo sapiens
  misc_feature: GYAE6OF01DZGI0.15.86.H09.1.454.CMB.1.raw
tcagtctacgtagccacgaccggtgctcgatttagtgctatagacttgggtttgggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacgaccaaggggacggatccccgatcgcttcatggctccagtctgggctgaccgctacctcaccatctaccaacctccagtctgacgagtagagctgagtactcactaggtggagagtacgaccacaacagttgagtggaccaaaggtacgggttggggtagttcgggcgggaagggaccgaaaggtccgtaggacccgttaccgtggtccgtaacccgg

SEQ ID NO: 112795 - DNA, 566 bp, Homo sapiens
  misc_feature: GYAE6OF01BOHJ6.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtgggtttccttgctgctatcttaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggagggggctgggagtgggttggacgtttcaaaagtaaaatgatggtagagaaatagactacggtgcacccgtgaaaggagattcacatctcaagagataattacaaaacgacggtagtatttgacaaatgaacagcctagaaaccgaggacacagccgtactattactgtaccacagattcggaagtgacatcggacgtaaaggaggcttagtgtcttttagattagtcgtcggggacccaggggacaagtcggg

SEQ ID NO: 112796 - DNA, 573 bp, Homo sapiens
  misc_feature: GYAE6OF01B3LBB.15.86.H09.1.454.CMB.1.raw
  modified_base (535)..(535): a, c, t, g, unknown or other
  misc_feature (535)..(535): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcgactcacccctgcccccgattaacgttggacaggaacccttggtcttccggcgagcgggcttttcacccgctttatcgttacttatgtcagcattcgcacttctgatacctccagcatgcctcacagcacacccttcacaggcttacagaacgcctcccctacccaacaacgcataagcgtcgctgccgcagcttcggtgcatggtttacgccccgttttnacttccttccccgccactcctgagccttacgtgtaccg

SEQ ID NO: 112797 - DNA, 597 bp, Homo sapiens
  misc_feature: GYAE6OF01DK1UR.15.86.H09.1.454.CMB.1.raw
  modified_base (520)..(520): a, c, t, g, unknown or other
  misc_feature (520)..(520): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggttttccgtgacgtgctaatacgttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggggctggagtgggttggacgtttcaaaagtaaaatgatggtgaagaaaatagactacggtgcacccgtgaaaggaagattcaccatctacaagagataattacaaaaacgcggtagtatttgactaaatagaaacagacctagaaaaccgaggaacacagccgtctattaactgtaaccacagtattacggaagtnacatacgaacgtaaagggaggtactagttgtctttaggattaacgtcgtcggggaccccaagggactaagtaccggg

SEQ ID NO: 112798 - DNA, 586 bp, Homo sapiens
  misc_feature: GYAE6OF01DMEFW.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatgaagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttgggtccgcaggctcgagggaggggctgggagtgggttggacgtttacaaaagtaaaatgatggtagaagaaaatagactacggtgacacccgtagaaaggagattcacatctacaagagataattacaaaaacgacggttagtatttagacaaatgaacagacctaagaaaaccgaggaacacgacgccgtactattacctagtaccaatagattcggaagtgacatcggaacgtaaaggaggtctatgtcttttgattacgtcgtaggggcccaagggtactaagtcggg

SEQ ID NO: 112799 - DNA, 574 bp, Homo sapiens
  misc_feature: GYAE6OF01EIXSX.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaggggctggagtgggttggacgtttacaaagtaaaatgatggtagagaaaatagactacggtgcacccgtgaaaggagattcacatctacaagagaataattacaaaaacgacggtagtatttgacaaatgaaacagacctagaaaaccgaggaacacagccgtatattactgaccacagattcggaagtgacatacgacggtaaaggaggacttagtgtcttttagattagtcgtaggggacccaggggaccaagtcggg

SEQ ID NO: 112800 - DNA, 921 bp, Homo sapiens
  misc_feature: GYAE6OF01CXT3M.15.86.H09.1.454.CMB.1.raw
tcagtctacgtagccacgaccggtgctcgatttagtgctatagacttgggtttgggggagaggagcccagccttggatcccaagtgtttcattcagtgatcaggactgaacacagaggactcaccatggagttcggctgagctgggtttcctgctgctatcttaaaggtgtccagtgtgaagtgcaggtggtggagtcgtggggagtccgttggtaaacgccgtgggggtcccttaggacgtctccgtgtcgtcggcctcgtggacttcgacgttttcacggttaactcggtacgtaggtaacgttcggtaacggtttcggggtacccgtaccgtaacgggtccgttaccggtaagggggtaaacggggtccttacgggtacggttacggggtttacggtaaccggtttttaacgaaaaacggtttaaaaacgttcggtaacgttacgggttacggtaaacggtaaaaacgttacggtaaccgttaacgggtacgtaaccggtaacccggttaaggtaaaacgggtaacgttacgttaccgtaaccgttaagtaccgttaacgaaacggtacgtaacgttaacgttaccgtaaaaaacgggtcggtttacggttaacttttacgggaaccgtaaaagtttcgggaaacctagggtaacccttagggtaaaaaccccggtcggtaacccgttaacggaacggttaccccggttaagttaaccggtttaaccgtacgggttaacccgaccggttaacggttaacgtttccgggtaaacggttcgtaaccgtaacggttacccggtaaacggtaaacgggttaacggtcctttaaggttcggttaccgtttttacgggaactttaccggtacccgggttacgggggtacccccaaggggttaacccgttaaggtttacccgggg

SEQ ID NO: 112801 - DNA, 574 bp, Homo sapiens
  misc_feature: GYAE6OF01DBBAQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccaggggaaggggctggagtgggttggacgtttcaaaagtaaaatgatggtgaagaaaatagactacggtgcacccgtgaaaggagattcacatctacaagagataattacaaaaacgcggtagtatttagacaaatagaaacagcctagaaaacccgaggacacagcctctattactgtaaccacagattacggaagtgacagtacgacgtaaggaggtctatggtctttagattagtcgtacggggacccagggacaagtcggg

SEQ ID NO: 112802 - DNA, 561 bp, Homo sapiens
  misc_feature: GYAE6OF01BM268.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcacttttcagtaatggctggatgagttgggtccgccaggctccagggaaggggctgggagtgggttggacgtttcaaaagtaaaatgatggtgagaaaatagactaggtgcacccgtgaaaggagattcaccatctcaagagataattacaaaacgacggtgtatttgacaaatgaaacagacctagaaaaccgaggacacagccgtctattactgtaccacagattcggaagtgcatcgacgtaaaggaggctatgtctttagattatcgtggggacccagggccaagtcgg

SEQ ID NO: 112803 - DNA, 570 bp, Homo sapiens
  misc_feature: GYAE6OF01ARGUR.15.86.H09.1.454.CMB.1.raw
  modified_base (443)..(443): a, c, t, g, unknown or other
  misc_feature (443)..(443): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcacttttcagtaatggctggatgagttgggtccgccaggctccgagggaaggggctggagtgggttggacgtttacaaaagtaaaatgatggtagaagaaaatagactacggtgcacccgtgaaaggagattcaccatctcaagagataattacaaaacgacggtagtatttganaaatgaacagacctagaaaccgaggacacagcctactattactgtaccacagattacggaagtgacatcgaagtaaaggngtactatgtcttttagattacgtcgtggggacccagggctaagtcgg

SEQ ID NO: 112804 - DNA, 589 bp, Homo sapiens
  misc_feature: GYAE6OF01BQ3OO.15.86.H09.1.454.CMB.1.raw
  modified_base (501)..(501): a, c, t, g, unknown or other
  misc_feature (501)..(501): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaaggggctgggaggtgggttggacgtttacaaaaggtaaaatgatggtagaagaaaatagactacggtgcacccgtagaaaggaagattcaccatctcaagagataattacaaaacgacggtgtatttgacaaatagaacagacctaggaaaacccgagaccacagccgtactattacctagtacccanagtattacgggaagtgcaagtacggaacgtaaaggaggacttatggtcttttagattacgtcgtacggggacccagggacaagtcggg

SEQ ID NO: 112805 - DNA, 607 bp, Homo sapiens
  misc_feature: GYAE6OF01BDXRV.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcacttttcagtaatggctggatgagttgggtccgccaggctccgagggaaggggctggagtgggttggacgtttacaaagtaaaatgatggtgagaaatagactacggtgcacccgtgaaaggagattcacatctcaagagataattacaaaacgacggtgtatttgacaaatgaacagcctagaaaccgagacacagccgtatattactgtacccacgtagtagttacggagtcgactacgtacggtaaacggtaaagggacgtacgttagtcggtttcgttttagattacgttacgggtaccggggacccggtaaggggtaaccgtaaggttaccgggg

SEQ ID NO: 112806 - DNA, 615 bp, Homo sapiens
  misc_feature: GYAE6OF01AR447.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggccgcaggctccagggaaggggctggagtgggttggacgtttacaaagtaaaatgatggtagagaaatagactacggtgcaccgtgaaagagatcacatctacaagagataattacaaaacgtacggtagtagtttgacaaatgaaacagacctaggaaaaccgaggacacacgtccgtacttatactacgtacccaagtagtattacggaagttgactagtacggaacggtaaaagggaggtaccttaagtcggttcttttagaactttagtccggttacggggggacccctaagggggaaccttaaggttccgggg

SEQ ID NO: 112807 - DNA, 576 bp, Homo sapiens
  misc_feature: GYAE6OF01B9N15.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgaggggaaggggctggaggtgggttggacgtttacaaaagtaaaatgatggtagaagaaaatgaactacggtgcacccgtgaaaggagatcacatctacaagagataatacaaaagcgtagtatttgacaaagtgaaacagacctagaaaaccgaggacacagctactattacagtaccacagattacggaagtgacagtcgaacgtaaaggacggtactatgtcttttagattacgtcgtacggggacccaagggtacaagttcggg

SEQ ID NO: 112808 - DNA, 603 bp, Homo sapiens
  misc_feature: GYAE6OF01C6QLK.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactaaacacagaggactcaccatggagttcgggctgagctgggttttccttgctgctatcttaaaaggtgtccagtgtgaagtgcaggtgttggagtcgtgggggagccttggtaaagcctggggggtcccttagagtctcctgtgtggcctctggattcactttcagtaatggctggatgagttgggtccgccaggctccgagggaaggggctggagtgggttggacgtttacaaaagtaaaatgaatggtagagaaaatagactacggtgacaccgtagaaaggagattcactatctacaagagataattacaaaaacgtacggtagtaatttagacaaatgaacagacctagaaaaccgaggaacacagccgtactattactacgtaccacgagtattacggaagtcacaatacgaacgtaaagggaggccttaatgttacttttgaatttagcgtacggggaccccaggggtaaccaagttcggtacgg

SEQ ID NO: 112809 - DNA, 521 bp, Homo sapiens
  misc_feature: GYAE6OF01AN19M.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaggggaagtccccccagtatataatgaaagtttaagagtgatggcagccacaccgaaggggacgggatccccgatcgcttcatgggctccagttctggggctgaccgctacctcaccatcctcccaacctccagtctgacgatgaggctgagtatcactgtaggagagacgccacacattgatggaccaaggacgggttgggtgttcggcgggagggaccagctagacccgtctaggtcacgg

SEQ ID NO: 112810 - DNA, 685 bp, Homo sapiens
  misc_feature: GYAE6OF01EHOVZ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggtttccttgactgctatcttaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaagggggctgggagtggggtgtacggttacgtaaagtaaaaagtaagagtaggtaggtagaaaagtaagtaacgtaacggtacggtcgacccgtacggaaaggaaaggaagttactaccaactactacctaagaaggaataatttaactaaaaccgaaaccggtaggtaatttagttagaaactaagtaacgaacgaccgtacgaaaaccggaaacggacgaacctacgaccgtccgtattactacgtactaccagattcggtaagtacgcagtactaacgggtaaacggtaagggtccgtattacggtcgttttacgttagttaacgttacgttacggggtacccggtaacgggtacggaaagttacgggg

SEQ ID NO: 112811 - DNA, 174 bp, Homo sapiens
  misc_feature: GYAE6OF01CJEU1.15.86.H09.1.454.CMB.1.raw
  modified_base (173)..(174): a, c, t, g, unknown or other
  misc_feature (173)..(174): n is a, c, g, or t
tcagtctacgtagccacgaccggtgctcgatttagtgctatagacttgggtttgggggaagaggaagactgacggtcccccaggagttcaggtgctgggcacagcggccctgggctgcctggtcaaggactacttccgctacgtagactgagcgggctggcaaggcgcatagnn

SEQ ID NO: 112812 - DNA, 618 bp, Homo sapiens
  misc_feature: GYAE6OF01AUJLQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggctgggaggtggggttggacgtttacaaaagtaaaatgatggtagaagaaaatagactacggtgacaccgtagaaaggagattacaccatctacaaagagaataattacaaaaacgtacggtatatttagacaaagtgaaacagacctaaggaaaaccgaggaacacgaacgtcccgtattaacttacctacgtaacccaactagtaacgtttcgggaagtcgacagtacgaaacggtaaagggaggtctagtagtcttttagattacgtcgtacggggacccagggatagtcggg

SEQ ID NO: 112813 - DNA, 599 bp, Homo sapiens
  misc_feature: GYAE6OF01CVVKF.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctcgagggaagggctggagtgggtgacgtttacaaaagtaaaatgatggtagaagaaaatagactacggtgacacccgtagaaaggaagattacactatctacaagagaataattaacaaaaacgtacggtagtatttagactaaatagaaacagacctaaggaaaaccgaggaacaacacgcgtactaattacacgtaccaatagacgttacgaagtcgacagtacgaacgtaaaggaggactatcgtcttttagattacgtcgtacggggacccagggtaacaaggttcggg

SEQ ID NO: 112814 - DNA, 587 bp, Homo sapiens
  misc_feature: GYAE6OF01BE5RU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggagggggctgggaggtgggttggacgtttacaaaagtaaaatgatggtagaagaaaatagactacggtgacacccgtagaaaggaagattcacatctacaagagaataattacaaaacgacggtagtatttgactaaatgaaacagaccgtaagaaaaccgaggaaccacgagacccgtactattactagtaccacgagtacttacggaagtgcatcgaacgtaaaggagtctatgtctttgattagtcggtgggacccagggactagtcgg

SEQ ID NO: 112815 - DNA, 553 bp, Homo sapiens
  misc_feature: GYAE6OF01EVIZ3.15.86.H09.1.454.CMB.1.raw
  modified_base (351)..(351): a, c, t, g, unknown or other
  misc_feature (351)..(351): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggaggcctcgtccagccgggggggtccctgagactctcctgtgaagcctctggattcaccttgagcacttattggatgacttgggtccgccaggctccaggggaaggggctgggagtgggtggccaccatacaaaaagntaggaagtgacacaacctatgtgaactctgtgatgggccattcaccgtctccagagacgacgcaagactcaactacatctgacaaatgaacactgagagacgaggacacggctgtgtattactgtgtgagagtagtgttctggcggttcggggcccgtaacggggaaccccgttcggtccgacccgtccttccctcgtaccg

SEQ ID NO: 112816 - DNA, 578 bp, Homo sapiens
  misc_feature: GYAE6OF01AGT1E.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgaggggaaggggctggagtgggttggacgtttacaaaagtaaaatgatggtagagaaatagactacggtgacaccgtagaaaggagattcacatctacaagagaataattacaaaacgtacggtagtatttagactaaatgaaacagacctagaaaccgagacacagcctatattactataccactagacttacggaatgacagtcgaacgtaaaggcggtctagtgtcttttagattacgtcggtacgggacccagggactagtcgg

SEQ ID NO: 112817 - DNA, 582 bp, Homo sapiens
  misc_feature: GYAE6OF01C3ZI3.15.86.H09.1.454.CMB.1.raw
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (493)..(493): a, c, t, g, unknown or other
  misc_feature (493)..(493): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgccaggctccgagggaagggctggagtgggtgacgtttcaaaagtaaaatgatggtgaagaaaatagactacggtgcaacccgtagaaaggaanagtcacatcncaagagataattacaaaacgtacggtataatttgactaaatgaaacagacctagaaaaccgagaacacagccgtatacttactgtaccanagattacggaagtgactagtacggaacgttaaaggcggtactagtgtactttgaattatccgtaggggacccaagggactaaggtcggg

SEQ ID NO: 112818 - DNA, 551 bp, Homo sapiens
  misc_feature: GYAE6OF01CVATR.15.86.H09.1.454.CMB.1.raw
  modified_base (185)..(185): a, c, t, g, unknown or other
  misc_feature (185)..(185): n is a, c, g, or t
  modified_base (326)..(326): a, c, t, g, unknown or other
  misc_feature (326)..(326): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctcgatcaagctcacctgcacctaagtagtgagcatcgaacctacaccatcgaatggtatcaacagagaccagggaagtccccccagtatataatgaaagttaagagtgatggcagccanaccgaaggggacggatccccgatcgcttcatgggctccagttctggggctgaccgctacctcaccatctccaacctccagtctgacgatgagctgagtatcactgtggagagacgccaacgacaattcgaattcgggaccctaaggtaccgggtttaggggttgttacggggcgggaaggggacccgaaaggccgtaggaccccggttcctagggttccaaccgg

SEQ ID NO: 112819 - DNA, 593 bp, Homo sapiens
  misc_feature: GYAE6OF01BEIZI.15.86.H09.1.454.CMB.1.raw
  modified_base (542)..(542): a, c, t, g, unknown or other
  misc_feature (542)..(542): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgcaggctccgaggggaaggggctggaggtgggttggacgtttacaaaagtaaaatgaatggtagaagaaaatagactacggtgacaccgtagaaaggagattcaccatctacaagagataatacgaaaacgacggtagtaatttgacaaagtgaaacagacctagaaaaccgaggacacacgcctatacttactagtaacccatagtattacggaagtcgacatacggaacgtaaagggngtactatgtcttttagattagtcggtacggggacccagggactaagtcggg

SEQ ID NO: 112820 - DNA, 750 bp, Homo sapiens
  misc_feature: GYAE6OF01DYKKJ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttccgtgacgtgctatacgttaaaggtgtccagtgtgagtgcaggtggtggagtcgtgggggagccgttaggtaaacgccgtggggggtcccttagagttctcctgtgtggcctcgtggattcactttcaagtaagtggctggatgtaggttggggtccgccaggctccggaggggaagggggtctgggtaggtggggtttggtaacgttttacgaaaaaaggttaaaaatggtaattagggtagaaaggtaaaataggaaccgtaacggtgacgacccggtaggaaaaggaagtacttaccacctatctacgaaagtagaaattaacttaaacgaaaaaccggtacggttagttaactttaggaactaaagtacgaaacacggtacctaacggaaaaacccggaggaaccaaccgacggtacccgttacgttaaactttaccgtaacgttaacccaaccgtaaggtaacgtttaccgggaaagttacgacgtaaacgttaccggaaaccggttaaaaggggacggtaccgttaagttcgttcgttttaaggatttacgtcgtacgggggtacccaaggggtaacctaaggtcggg

SEQ ID NO: 112821 - DNA, 560 bp, Homo sapiens
  misc_feature: GYAE6OF01BLQLJ.15.86.H09.1.454.CMB.1.raw
  modified_base (474)..(474): a, c, t, g, unknown or other
  misc_feature (474)..(474): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagcctggggggtcccttagagtctcctgtgtggcctctggattcactttcagtaatggctggatgagttgggtccgccaggctccagggaaggggctggagtgggttggagtttcaaagtaaaatgatggtagagaaaatagactaggtgcacccgtgaaaggaagattcaccatctacaagagataattacaaaacgacggtagtaatttgacaaatgaaacagacctagaaaccgagacacagcctanattactgtaccacagattcggaagtgacagtcgagtaaaggaggctagtgtctttgattagtcgtgggacccagggaccaagtcgg

SEQ ID NO: 112822 - DNA, 601 bp, Homo sapiens
  misc_feature: GYAE6OF01C0ZNI.15.86.H09.1.454.CMB.1.raw
  modified_base (545)..(545): a, c, t, g, unknown or other
  misc_feature (545)..(545): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgagggaaggggctggagtgggttggacgtttacaaaagtaaaatgatggtagaagaaaatagactaggtgcacccgtagaaaggaagattcacatctacaaagagataattacaaaacgacggtagtaatttgactaaatgaaacagcctaagaaaaccgaggacacgagcgtactaattactagtaacccactaagtacttacggaagtcgacaagtacggaacggttaaaaggnggtactagtagtctttttagattagtcgtaggggacccaaggggctaaagttcggg

SEQ ID NO: 112823 - DNA, 602 bp, Homo sapiens
  misc_feature: GYAE6OF01DXBBP.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcacttttcagtaatggctggatgagttgggtccgcaggctccgagggaaggggctggaggtggggttggacgtttcaaaagtaaaatgaatgggtagaagaaaatagactacggtgacacccgtgaaaggaagatcaaccatctcaagagataattacaaaaacgacggtagtatttgactaaatagaaacagacctaagaaaacccgaggaacacagccgtactaattacctagtaaccaactagactttacggaagtgacaagtcgaaacgtaaaggaacggctaatggtccttttgattagtccgacggggacccaggggacaaggttcggg

SEQ ID NO: 112824 - DNA, 618 bp, Homo sapiens
  misc_feature: GYAE6OF01ATPJP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgagggaggggctggaggtgggttggacgtttacaaaagtaaaatgatggtagaagaaatagactacggtgacaccgtagaaaggagatcacatctacaagagataattacaaaacgtcggtagttaatttgacaaagtgaaactagacctaagaaaaccggagaacacgacgaccgttactaattaacctacgtaaccacgtaaggtacgttacgggaagttcgacctaagtacggaaacggttaaaagggcgtactagtggttcttttagattacgtcgtacggggacccaggggtactagttcggg

SEQ ID NO: 112825 - DNA, 693 bp, Homo sapiens
  misc_feature: GYAE6OF01CZXNC.15.86.H09.1.454.CMB.1.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
  modified_base (392)..(392): a, c, t, g, unknown or other
  misc_feature (392)..(392): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttcgtgagtgctatacgtaaagtgtcagtgtgaagtgcaggtggtggagtcgtggggganccttggtaaagccgtgggggtcccttagagtctcctgtgtggcctntggattcactttcagtaatggctggatgagttggccgcaggctcgagggaggggctgggagtgggttcgacgtttagaaaagtaaaatgaatggtagaagaaaatgaactaggtagcaccgagaaaggaagnttacactatctacaaagagtaataaattaccgaaaaaacggtcgggttagttaatttacggaactaaaagttagggaaaaccctaggaccccttaaaggaaaaaacccgggacggaaacctaccgtaacgtaccgttaacttaacgttaccgtaacgtaacccaacgtaagtacggtttaacggaacgttcgaacgtaacgtaacggtaaacggtaaacggtaacggtacgttagttacggttacgtttagttagttacgttacggtacgggtaccggaacgggtaacggtaacggtacgg

SEQ ID NO: 112826 - DNA, 680 bp, Homo sapiens
  misc_feature: GYAE6OF01CA3IA.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccgccaggctccgaggggaaggggctgggaggtgggttggacgtttacaaaagtaaaatgagtggtagaagaaaatagacgtacggtgaccgtacccggtagaaaggaagtacttaccaacgactactacgaaagagtaattaactaacgaaaaacggtggttacgttaagtttagaaactaaaagttacggaaacacgtacccgtaaaggaaaacccggagaaccacgacgtcccgttactattaccgtacgtaacccaagtagtaacgttacgggaatcgactaacgtaccggaaacggtaaaggacggtattaagtggttcttttaggaatttacgtccgggtacggggaccccgtaaggggtaactaggtttccggg

SEQ ID NO: 112827 - DNA, 621 bp, Homo sapiens
  misc_feature: GYAE6OF01CF83O.15.86.H09.1.454.CMB.1.raw
  modified_base (502)..(502): a, c, t, g, unknown or other
  misc_feature (502)..(502): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtccttagagtctcctgtgtggcctctggattctactttcagtaatggctggatgagttgggtccgcaggctccgagggaaggggctggagtgggttggacgtttacgaaaagtaaaatgatggtagaagaaaatagacgtaacggtgacgacccggtagaaaggaagactttacaacctatactacaagaagattaaatacgaaaacgcggtagtattagacaaatgaactagacctagaaaccgagactacagctactacttacncgtaccacgagtacgttacggaagtcgactaagtacggaaacggtaagggagtacgtagtaggttaccttttagaattacgtcggtacggggacccgaggggtaactaaggtttccggg

SEQ ID NO: 112828 - DNA, 556 bp, Homo sapiens
  misc_feature: GYAE6OF01C01MQ.15.86.H09.1.454.CMB.1.raw
  modified_base (486)..(486): a, c, t, g, unknown or other
  misc_feature (486)..(486): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcatgtgtggcctctggattcacttttcagtaatggctggatgagttgggtccgccaggctccgagggaaggggctggagtgggttggacgtttcaaagtaaaatgatggtgagaaatagactacggtgcaccgtgaaaggagattcacatctcaagagataattacaaaacgacggtagtatttgacaaatgaacagcctagaaaccgaggacacagccgtactattactgtaccanagtattcggagtgcatcgacgtaaaggnggattagtgtcttttgattactcgtgggcccagggactaagg

SEQ ID NO: 112829 - DNA, 570 bp, Homo sapiens
  misc_feature: GYAE6OF01EOTM9.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaggggctggagtgggtggacgtttcaaagtaaaatgatggtagagaaaatagactacggtgcacccgtgaaaggaagattcacatctcaagagataattacaaaaacgacggtagtatttgacaaatgaacagacctagaaaaccgaggacacagccgtctattactgtacccacagattcggaagtgacatacgacgtaaaggaggactagtgtcttttgattagtctagggggaccccaggggaccaagtcggg

SEQ ID NO: 112830 - DNA, 708 bp, Homo sapiens
  misc_feature: GYAE6OF01DN1CN.15.86.H09.1.454.CMB.1.raw
  modified_base (150)..(150): a, c, t, g, unknown or other
  misc_feature (150)..(150): n is a, c, g, or t
  modified_base (167)..(167): a, c, t, g, unknown or other
  misc_feature (167)..(167): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcggngttcgtgagtcgctatntaagntcngntgagtgcagtgtgngctggganctgaagctggggtcctagntctctgtgtgcctntggattcactttanagtagtggcgtggatgtacggttcggtccgccgacggccgtaccggaaggggaacgggtcgtagggtaggttcggggttacggtaacgtttaacgaaaaaggtaaaagtgtaagtaggtagaaagtaaaagtacgtaacgtacggtacgaccgtaacccggtaaggaaaacggtaagtacgttaccaacctagtaccgtaacgaaacgtaagtaagttaacttaaacgtaaaacggtaacggttaagttaagtttacgtaacgtaaacgtaacgtaaacgtaacgtaaccgtaacgtaaaccggaacgaacgacgacgtaccgtactacttaacgtacgtacgaacgtagtacgttacggtaacgtacgtacgtacgtacgtaacggtaacggtaacggtacgtagttagttcgttacgtagtacgtacggtacggtaccggtaacggtacgtacggtacgg

SEQ ID NO: 112831 - DNA, 621 bp, Homo sapiens
  misc_feature: GYAE6OF01D40JF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggggagccgttggtaaagccgtggggggtcccttagagtctcctgtgtggcctctggattcactttcagtaatggctggatgagttgggtccgccaggctccgagggaaggggctgggagtgggttggacgtttacaaaagtaaaatgatggtagaagaaatagactacggtgcgacccgtagaaaggaagacttacacatctacaaagagaataatacaaaacgtcggtagtatttagactaaagtgaaacacgacctaaggaaaacccgaggaaccacgacgtaccgtactaattaaccgtacgtaacccaacgtagtaacgttacgggaagtacggacaagtacggaacggtaaaggtaggttatgtcttttagattagtcgtcgggacccagggactagtggtccg

SEQ ID NO: 112832 - DNA, 590 bp, Homo sapiens
  misc_feature: GYAE6OF01DEEB5.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtctgggggagccttggtaaagcctggggggtcccttagagtctcctgtgtggcctctggattcacttttcagtaatggctggatgagttgggtccgcaggctccgagggaaggggctggagtgggttgacgtttacaaaagtaaaaatgatggtagaagaaaatagactacggtgacacccgtgaaaaggagattcaccatctacaagagataatacaaaacgacggtgtatttagacaaatgaacagacctaaggaaaaccgaggaacacgagaccgtactaattactacgtaccactaagagttacggaagtgacatacgaacggtaaaggaggtctatgtcttttagattagtcgtacggggacccaggggacaagtcggg

SEQ ID NO: 112833 - DNA, 634 bp, Homo sapiens
  misc_feature: GYAE6OF01BMYHB.15.86.H09.1.454.CMB.1.raw
  modified_base (261)..(261): a, c, t, g, unknown or other
  misc_feature (261)..(261): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctntggattcactttcagtaatggctgatgagttggtccgcaggctccgagggagggcgtggagtgggttggacgtttacaaaagtaaaatgagtggtagaagaaatagactacggtgcaccgtagaaggaagatcgacatctacgaagagaataattaacgaaaacggacggttagtaactttgaactaaaagtgaaacacgaccgtaacggaaaaaccgaggaaccaacgagtacccgttactaacttaactacgttaacccaacgtagtacgtttacgggaacgttgacgtagtaccgaaacggtaaaagggacggcttaagtgttacgttttagatacgttcggtcggggacccgagggtacaagttccggg

SEQ ID NO: 112834 - DNA, 654 bp, Homo sapiens
  misc_feature: GYAE6OF01BT9RQ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccttggtaagccgtgggggtcctagagtctctgtgtggcctctggattcactttcagtaatggctggatggagttgggtccgccgaggctccgaggggagggcgtggaggtgggttggacgtttacaaaagtaaaatgaagtggtagaagaaaatagacgtacggtgacacccgtagaaaggagattcaccatctacaagagattaatacgaaaacgtacggtagttatttagactaaatgaaacacgaccctaaggaaaacccgaggaaccacgacggcccgttacttaattaccgtaggtaacccaacgtaagtagtttaccgggaagttcgacctagttacggaaaccggttaaagggacggtacttagtcggttctttttagaagtttacgttcgggtacggggaccccgaaggggtaaccaaggttccgggg

SEQ ID NO: 112835 - DNA, 596 bp, Homo sapiens
  misc_feature: GYAE6OF01CRAFL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaagggggctggagtgggttggacgtttacaaaagtaaaatgatggtagagaaaatagactaggtgcacccgtagaaaggaagattcacatctcaagagataattacaaaaacgacggtagtaatttgactaaatgaaacagacctagaaaaccgagacacagccgtatacttactgtaaccacagtacttcggaagtgacagtacggaaacggtaaaggaggcttagtgttctttttagattagtccggttcggggacccgtaggggactaaggttcggg

SEQ ID NO: 112836 - DNA, 637 bp, Homo sapiens
  misc_feature: GYAE6OF01EJWA4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattctactttcagtaatggctggatggaggttgggtcccgccgaggctccgaggggaaggggcgtgggtaggtgggttggtacgtttacgaaaagtaaaatgatggtagaagaaaatagacgtacggtgacacccgtagaaaggaagattacaccatctacaagagtaataattaacgaaaaacgtacggttagtaatttagactaaagtagaaacagaccgtaagaaaacccggagaaccacgacgaccgttactaacttactacgtaacccagtagtattacggaatgacctagtaccggaaagtaaagggaggtctagttcgtcttttagaattacgtcggtacggggacccgaagggactaggtcgg

SEQ ID NO: 112837 - DNA, 621 bp, Homo sapiens
  misc_feature: GYAE6OF01A981O.15.86.H09.1.454.CMB.1.raw
  modified_base (444)..(444): a, c, t, g, unknown or other
  misc_feature (444)..(444): n is a, c, g, or t
  modified_base (571)..(571): a, c, t, g, unknown or other
  misc_feature (571)..(571): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttggtaaagccgtgggggtcccttagagtctcctgtgtggcctctggattctacttcagtaatggctggatggaggttcggggtcccgccgaggcctaccggaggggaaggggcgtgggaggtggggttggtacgtttaacgaaaaagtaaaatgagtggtagaagaaaatagacgtacggtgacaccggtagaaaggaagtacttacaaccatactacaaaganaataattaacaaaacgtacggtagttaatttgaactaaagtagaacagacctaagaaaaccgagacacgagcctatatactagtaccatagtacttacggaatcgactagtacggaagtaaacgggngtacttatgtcttttgaattacgtcgtcgggacccgagggactagtcggg

SEQ ID NO: 112838 - DNA, 613 bp, Homo sapiens
  misc_feature: GYAE6OF01DU6DV.15.86.H09.1.454.CMB.1.raw
  modified_base (342)..(342): a, c, t, g, unknown or other
  misc_feature (342)..(342): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgaagcctctggattcactttcagtaatggctggatgagttgggtccgccaggctcgagggaaggggctggagtgggttggacgtttanaaaagtaaaatgaatggtagaagaaaatagactacggtgacacccgtagaaaggaagattcacatctacaagagataattacaaaaacgacggtagtatttagactaaagtgaaacagacctagaaaaccgagaacacagccgtactaattactagtaccactagactttacggaagtgactaagtacggtaacgtaaaagggaggtactagttaggtcgtttttagaagttagttcggtacggggacccctaaggggactaaagttcggg

SEQ ID NO: 112839 - DNA, 562 bp, Homo sapiens
  misc_feature: GYAE6OF01CXDE5.15.86.H09.1.454.CMB.1.raw
  modified_base (530)..(530): a, c, t, g, unknown or other
  misc_feature (530)..(530): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccatcgcccggccaacatagccttctccgtcccccttgcagtaacaccaagtacaggaatattaacctgtttccatcgactacgcctttcggcctcgccttaggggtcgactcaccctgccccgattaacgttggacaggaaccttggcttccggcgagcgggctttcacccgctttatcgttacttatgtcagcattcgcacttctgactacctccagcatcgcctcacagcacaccttcacaggcttacagaacgctacccctaccaacaaccgcataacgcgtcgctgccgcagccttggtgcatcggtttacgccccgtttnacttcttcccgctactctgacgtctacgtacg

SEQ ID NO: 112840 - DNA, 559 bp, Homo sapiens
  misc_feature: GYAE6OF01A8QSS.15.86.H09.1.454.CMB.1.raw
  modified_base (475)..(475): a, c, t, g, unknown or other
  misc_feature (475)..(475): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggggagccttggtaaagcctgggggtcccttagagtctcctgtgtggcctctggattcactttcagtaatggctggatgagttgggtccgccaggctccagggaagggggctgggagtgggttggacgtttcaaagtaaaatgatggtgagaaatagactacggtgcacccgtgaaaggaagattcaccatctcaagagataattcaaaaacgacggtagtaatttgacaaatgaacagcctagaaaccgaggacacagccgtntattactgtaccacagattacggaatgcatcgacgtaaaggcggatangtctttagattatcgtagggcccagggacagtcggg

SEQ ID NO: 112841 - DNA, 570 bp, Homo sapiens
  misc_feature: GYAE6OF01DIB0G.15.86.H09.1.454.CMB.1.raw
  modified_base (477)..(477): a, c, t, g, unknown or other
  misc_feature (477)..(477): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctgggagtgggttggacgtttcaaaagtaaaatgatggtgaagaaaatagactacggtgcacccgtgaaaggagatcacatctcaagagataattacaaaaacgcggtagtatttagacaaatagaacagacctagaaaaccgagacacagaccgtntattactgtaccacagattacggaagtcgcatcgaacgtaaaggaggactatggtcttttgattacgtcgtaggggcccagggactagtcggg

SEQ ID NO: 112842 - DNA, 566 bp, Homo sapiens
  misc_feature: GYAE6OF01D6TKV.15.86.H09.1.454.CMB.1.raw
  modified_base (511)..(511): a, c, t, g, unknown or other
  misc_feature (511)..(511): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgtggacaggaacccttggtcttccggcgagcgggcttttcacccgctttatcgttacttatgtcagcattcgcacttctgatacctccagcatgcctcacagcacaccttcacaggcttacagaaccgctacccctaccaacaacgcataacgcgtcgctgccgcagcttcggtncattggtttacgccccgtttcacttccttcccgccactctgagtctacgtgtacg

SEQ ID NO: 112843 - DNA, 720 bp, Homo sapiens
  misc_feature: GYAE6OF01CVJCG.15.86.H09.1.454.CMB.1.raw
  modified_base (528)..(528): a, c, t, g, unknown or other
  misc_feature (528)..(528): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccttggtaaagccgtgggggtccttagagtctctgtgtggcctctggattctactttcagtaatggctggatgtaggttcgggtccgcgaggctccgaggggaaggggctgggaggtggggttaggacgtttaacgaaaagtaaaagtgtagtggtagaagaaaagtagacgtacggtagaccgaacccgtaggaaaaggaagtacttacaaccgtatacctaacgaaagtaacgtaattaaacgttaaccgaaaaacggtcggttagttaatttagaactaaagtacgaaacagacctaaggaaaaccgnggaaccacgacgtacccgtacttaattaccgtacgtaacccaacgtaacggtaacgtttacgggaaagttcggaacctaaggttaaccggaaacgggttaaaagggacggtacgttagttacggttacgtttttagaaacgttacgttccgggtacggggaccccgaaagggggtactaaagggttccgggg

SEQ ID NO: 112844 - DNA, 567 bp, Homo sapiens
  misc_feature: GYAE6OF01EQ6NX.15.86.H09.1.454.CMB.1.raw
  modified_base (468)..(468): a, c, t, g, unknown or other
  misc_feature (468)..(468): n is a, c, g, or t
  modified_base (494)..(494): a, c, t, g, unknown or other
  misc_feature (494)..(494): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtggggtggacgtttacaaagtaaaatgatggtagagaaaatagactacggtgcaccgtgaaaggagattcacatctacaagagataattacaaaaacgtacggtagtatttagacaaatgaacagacctagaaaaccgngacacagccgtatattactgtaccanagattcggaagtgcatacgacgtaaaggnggctatgtctttgattagtcgtaggggacccagggacagtcggg

SEQ ID NO: 112845 - DNA, 670 bp, Homo sapiens
  misc_feature: GYAE6OF01AK43D.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtgggggtcccttagagtctcctgtgtggcctctggattcactttaagtaatggctggatgagttgggtccgcaggctcgagggaggggctggagtgggttggacgtttacaaaagtaaaatgagtggtagaagaaaatagactacggtgcaccggtagaaaggagattcacatctacaagagaataattaacaaaacggtacggttagttaatttagactaaagtgaaacaacgaccgtaacggaaaaccggaggaaccaacgacggtacccgttacttaactttaccgtaacgtaacccaacgtaagtaacgtttacgggaaagttcgacgtaactaccggaaacggttaaagggaggtacgttaagttgttacgttttagaatttacgtccggtacggggtaccccgaaggggtacctaaaggttcgggttaccgg

SEQ ID NO: 112846 - DNA, 618 bp, Homo sapiens
  misc_feature: GYAE6OF01C14EP.15.86.H09.1.454.CMB.1.raw
  modified_base (417)..(417): a, c, t, g, unknown or other
  misc_feature (417)..(417): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaagccgtgggggtcccttagagtctctgtgtggcctctggattcactttcagtaatggctggatgaggttgggtccgccgaggcgtccgaggggaaggggcgtagggaggtgggttaggtacgtttacgaaaaagtaaaagtgaagtaggtagaagaaaagtagacgtacggtgacacccgtagaaaggaanatacacatctacaagagaataatacaaaacgtaggtagtaattagactaaagtagaaacagacctaagaaaccgagacacgacgaccgtactaattacctacgtaaccaacgtagacttacggaagtcgacaagtacggaaagtaaaggagtactagtgttcgtttagattacgtcgtacgggaccagggacaggttcggg

SEQ ID NO: 112847 - DNA, 578 bp, Homo sapiens
  misc_feature: GYAE6OF01E3AM2.15.86.H09.1.454.CMB.1.raw
  modified_base (483)..(483): a, c, t, g, unknown or other
  misc_feature (483)..(483): n is a, c, g, or t
  modified_base (497)..(497): a, c, t, g, unknown or other
  misc_feature (497)..(497): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccaggggaaggggctggagtgggttggacgtttacaaaagtaaaatgatggtagaagaaaatagactacggtgcaccgtagaaaggaagatcacatctacaagagataattacaaaaacgtacggtagtatttagactaaatgaacagacctagaaaaccgagacacagccgtntattacagtaccanagtattcggaagtgacatacgaacgtaaaggaggctatgtcttttagattacgtcgtacggggacccagggacaagtcggg

SEQ ID NO: 112848 - DNA, 583 bp, Homo sapiens
  misc_feature: GYAE6OF01EQTGD.15.86.H09.1.454.CMB.1.raw
  modified_base (485)..(485): a, c, t, g, unknown or other
  misc_feature (485)..(485): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctgggagtgggttggacgtttcaaaagtaaaatgatggtagagaaaatagactacggtgcacccgtagaaaggaagattcaccatctacaagagaataattacaaaaacgtacggtagtaatttgactaaatagaacagcctagaaaaccgagaacacagccgtntattactagtaccatagattacggaagtcgacatacggaacgtaaaggcggtactatgtcttttagattagtcgtaggggacccagggacaagtcggg

SEQ ID NO: 112849 - DNA, 607 bp, Homo sapiens
  misc_feature: GYAE6OF01BJ0JV.15.86.H09.1.454.CMB.1.raw
  modified_base (415)..(415): a, c, t, g, unknown or other
  misc_feature (415)..(415): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggttttcgtgacgtgctatacgttaaagtgtccagtgtgaagtgcaggtggtggagtctgggggagccttggtaaagccgtgggggtcccttagagtctcctgtgtggcctctggattcacttttcagtaatggctggatgagttgggccgccgaggctccgagggaaggggctgggagtgggttggacgtttacaaaagtaaaatgatggtagaagaaaatagactacggtgacacccggtagaaagaagattcaccatctanaagagataatacaaaacgtacggtgttatttgactaaaatgaaacacgacctagaaaacccgaggaaccacgacgacccgtcttaacttacctacgtaacccactaagtacttacggaatgacagtacgaacggtaaagaggtctagtgtctttgaattacgtcgtacggggacccagggactaggttcggg

SEQ ID NO: 112850 - DNA, 584 bp, Homo sapiens
  misc_feature: GYAE6OF01EE86L.15.86.H09.1.454.CMB.1.raw
  modified_base (477)..(477): a, c, t, g, unknown or other
  misc_feature (477)..(477): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagcctggggggtcccttagagtctcctgtgtggcctctggattcactttcagtaatggctggatgagttggtccgccaggctccagggaaggggctggagtgggttggacgtttcaaaagtaaaatgatggtgaagaaaatagactacggtgcacccgtgaaaggagattcacatctcaagagaataattacaaaaacgacggtgtatttgacaaatgaaacagcctagaaaacccgaggacacagccgtntaattactgtaaccactagtaattccgaagttgacatcgacggtaaaaggaggaccttatggtcttttagattacgtcgttaggggccccaaggggacaagttcggg

SEQ ID NO: 112851 - DNA, 762 bp, Homo sapiens
  misc_feature: GYAE6OF01AJVQJ.15.86.H09.1.454.CMB.1.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (272)..(272): a, c, t, g, unknown or other
  misc_feature (272)..(272): n is a, c, g, or t
tcagtctacgtagccacgaccggtgctcgatttagtgctatagacttgggtttggggtccgactgggcagtctcgaatagagctcttggaagtccctccaaccatggcctgggtctccttctacctactgcccttcattttctccacaggtctctgtgctctgcctgtgctgactcagcccccgtntgcatctgccttgctgggancctcgatcaagctcacctgcaccctagtagtgagcatccgaacctacaccatcgaatggtatcaanagagaccgagggaacgtccccccgagtactaataatacgtaaaagttaagaagtagagttagggacacgaccaaccgaaccgaaacgggggaccggaacgtacccccggaatcccggcgttacgtaacgttcgggccgtacccgtagtttcggtcggggtacgtcggacccggtacctacccgttaccgaccctacgttacccctaccccgtaaacccccttacccgtaccggttaccgtaccggtaaccgtacgtacggaacgggtcgtacggagttaacttccgtaacgttaccgtagggtaacgacgggtacgaacccgaacgtaaccgtaaattacggaacgtcggtaacccgaaagggttaaccgggggtttcggggttaccgggtttacgggggacccggggttaaaggggaacccccggtaagggtaaaccccggttgaaaccccccggggttaccgttaacggggccccgttaaacccgggg

SEQ ID NO: 112852 - DNA, 627 bp, Homo sapiens
  misc_feature: GYAE6OF01BCFIS.15.86.H09.1.454.CMB.1.raw
  modified_base (216)..(216): a, c, t, g, unknown or other
  misc_feature (216)..(216): n is a, c, g, or t
  modified_base (452)..(452): a, c, t, g, unknown or other
  misc_feature (452)..(452): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttccgtgacgtgctatcttaaaggtgtccagtgtgaagtgcaggtggtggagtcgtggggganccttggtaaagccgtggggggtcccttagagtctcctgtgtggcctctggattcacttcagtaatggctggatgagttgggtccgcaggctccgagggaagggctggagtgggtggacgtttacaaagtaaaatgaatggtagagaaaatagactacggtgacaccgtgaaaggacgattcaccatctacgaagagataattacaaaacgcggttagtaatttgacaaatgaaacngacctaagaaaccgaggacacgagtacccgtactaattactagtacccacgtaagaacgtttacggaacgttgaccgtagttaccggaaacgttaaaacgggacgggtacttagtacggttcttttaggaattagttaccggtaggggtaccccaaggggaacctaaggtccggg

SEQ ID NO: 112853 - DNA, 545 bp, Homo sapiens
  misc_feature: GYAE6OF01DC9JB.15.86.H09.1.454.CMB.1.raw
  modified_base (252)..(252): a, c, t, g, unknown or other
  misc_feature (252)..(252): n is a, c, g, or t
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcggtgtttcgtgagtgctatttagagtgcagtgtgagtgcaatggtggagtcgtgggggaggcctcggtccaggccggggggtcctgagctctctgtgaagcctntggattcaccttgagcattatggatgcttgggccncaggctcgagggagggctggagtggnggcacanaacaaaagaanagagaganacaaccaatgtgaacttntgtgngtggcgacgtctcgtcncgacgacgacgacgacgaacgaacacactacactactanacaanacaacaacgagagacgacgacgacgacgtacgtgtagtagttacgtgtagtagagtagtagttgttcgtggtcggtcggtacggtacggtaccgtcgtaccgtaccgtccgtccgtcgtccg

SEQ ID NO: 112854 - DNA, 570 bp, Homo sapiens
  misc_feature: GYAE6OF01BV4OM.15.86.H09.1.454.CMB.1.raw
  modified_base (491)..(491): a, c, t, g, unknown or other
  misc_feature (491)..(491): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctgggagtgggttggacgtttacaaaagtaaaatgatggtagaagaaatagactacggtgacaccgtagaaaggagattcacatctacaagagataatacaaaacgcggtagtattgacaaatgaacagacctagaaaccgaggacacagccgtatattactagaccanagattcggaagtgacagtacgacggtaaaggaggctatgtcttttagattatcggtcgggacccgagggactagtcggg

SEQ ID NO: 112855 - DNA, 595 bp, Homo sapiens
  misc_feature: GYAE6OF01EEVZU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagcctggggggtcccttagagtctcctgtgtggcctctggattcactttcagtaatggctggatgagttggtccgcaggctccagggaaggggctgggaggtgggttggacgtttcaaagtaaaatgatggtagagaaaatagactacggtgcacccgtgaaaggagattcacatctcaagagataattacaaaaacgacggtagtagtttagacaaatagaacagacctagaaaaccgaggacacagaccgtctattactagtacccacagattacggaagtcgcaatacgaacggtaaagggagggacttagtggtcgttttagattaagttccggtacggggaccccgaggggaccgtaagttacggg

SEQ ID NO: 112856 - DNA, 585 bp, Homo sapiens
  misc_feature: GYAE6OF01B6V7Q.15.86.H09.1.454.CMB.1.raw
  modified_base (151)..(151): a, c, t, g, unknown or other
  misc_feature (151)..(151): n is a, c, g, or t
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
  modified_base (178)..(179): a, c, t, g, unknown or other
  misc_feature (178)..(179): n is a, c, g, or t
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (191)..(193): a, c, t, g, unknown or other
  misc_feature (191)..(193): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcggngttcgtnagcgctatacgtaagncagnngangcagtgngnnnggnctganctgggcctagntcnctgtgngctntgatcattgagtatggctggatgngttcggcgcaggctcgagggagggctggagtgggttgacgtttagaaaagtaaaagtgaatggtagaagaaaaatgaaaccgttcggcgacgaccgtaagaaagactactaccactatcgtacgaagaagtaataactaacgtaaacgtaacgtagttagttagtaactaagtaacgaacgacgacgtaacgaaacgaacgacacgacgtacgtactactacgtacgtacgacgtacgtagtacgtagtacgacgtacgtacgtacgtaaggtacgtacgtagtacgttgttacgtacgtacgtacggtacggtaccggacggtacgtaggtacgg

SEQ ID NO: 112857 - DNA, 582 bp, Homo sapiens
  misc_feature: GYAE6OF01A3JR2.15.86.H09.1.454.CMB.1.raw
  modified_base (539)..(539): a, c, t, g, unknown or other
  misc_feature (539)..(539): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaggggctggagtgggttggacgtttacaaagtaaaatgatggtagagaaatagactacggtgcacccgtagaaaggaagattcaccatctacaagagataattacaaaaacgtacggtagtaatttggactaaagtgaaacagacctaggaaaaccgaggaaccacacgccgtactattactacgtaccactatattacggaagtgacatacgacgtaaaggnggtctatgtctttgattagtcgtacgggcccagggacagtcgg

SEQ ID NO: 112858 - DNA, 657 bp, Homo sapiens
  misc_feature: GYAE6OF01AE8QP.15.86.H09.1.454.CMB.1.raw
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (476)..(476): a, c, t, g, unknown or other
  misc_feature (476)..(476): n is a, c, g, or t
  modified_base (529)..(529): a, c, t, g, unknown or other
  misc_feature (529)..(529): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtggtttcgtgacgtcgctatacgtaaagtgtcagtgtgaagtgcaggtggtggagtcgtggggagccttggtaaagccgtgggggtcccttagngtctcctgtgtggcctntggattcactttcagtaatggctggatgagttggccgccgaggctccgaggggacgggctggagtgggttggacgtttagaaaagtaaatgagtggtagaagaaaagtcgacgtaacggtcgaccgtaacccggtaggaaacgggtaaagtacttaccgaacctacttactaacgtaaaggagtaacttaaacttaacgaaaaacggtcggttnttaagtttaggaacctaaaagtcggaaactacggacccgtaaagaaaaccggngaaccaacgtaggtacccttnttaagttacctacgaacctacggagtaagttccgaagtcgatacgtccgaaaggtaggagtctagtgttctttagaattcgcggtcgggacccaggtaacgtgtcgg

SEQ ID NO: 112859 - DNA, 598 bp, Homo sapiens
  misc_feature: GYAE6OF01AMZ8N.15.86.H09.1.454.CMB.1.raw
  modified_base (244)..(244): a, c, t, g, unknown or other
  misc_feature (244)..(244): n is a, c, g, or t
  modified_base (427)..(427): a, c, t, g, unknown or other
  misc_feature (427)..(427): n is a, c, g, or t
  modified_base (550)..(550): a, c, t, g, unknown or other
  misc_feature (550)..(550): n is a, c, g, or t
  modified_base (558)..(558): a, c, t, g, unknown or other
  misc_feature (558)..(558): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcggtggtttcgtgagtcgctatacgtaaagtgtccagtgtgagtgcaggtggtggagtctgggggagccttggtaaagccgtggggggtcccttagngtctcctgtgtggcctctggattcactttcagtaatggctggatgagttgggtccgcaggctccaggggaaggggctggagtgggttggacgtttacaaaaggtaaaatgagtaggtagaagtaaaatagagtaacggtgacgtacccggtagaaaagggaagtacttacaacctatcctaanaagagataacttacaaaacggtcgtagtattgacaaatgaactagccttaagaaaccgaggacacagccgttactattaccgtagtacccataagtgtacggaatgacgatacgacgtaaggngtctagtntcttttgattactccggttgggacccagggtatagtcggg

SEQ ID NO: 112860 - DNA, 647 bp, Homo sapiens
  misc_feature: GYAE6OF01D2YKP.15.86.H09.1.454.CMB.1.raw
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctgggggagccttggtaaagccgtggggggtcccttagagtctcctgtgtggcctctggattcactttcagtaatggctggatggagttgggtccgccaggctccgagggaaggggctgggaggtgggttggacgtttanaaaagtaaaatgatggtanaagaaaatagactacggtgcaccgtagaaaggaanattcaacatctacaaagagaataattacaaaaacgtacggtagtatttaggactaaatacgaaacacgacctaaggaaaacccgaggaccaacgacgccgtacttaattaaccgtagtaaccaactagtaacgttacggaagtcgacgtaacgtacgaaacggtaaagggacggtaccttaagtggttacctttttagacgttaatccggttacggggaccccgtaaggggtaacctaggttacgggg

SEQ ID NO: 112861 - DNA, 688 bp, Homo sapiens
  misc_feature: GYAE6OF01BQ8VU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaagccgtgggggtcccttagagtctcctgtgtggcctctggattcactttcagtaatggctggatggtagttgggtccgccaggctccgaggggaaggggcgtggaggtgggttggtacgtttacgaaaagtaaaatgagtggtagaagaaaatagacgtacggtgaccgacccggtagaaaggaagattacacatctacgaagagaattaacttaacgaaaaacggtacggttagttaagtttacgaactaaatacgaaacacgtacctaaggaaaacccgaggaaccacgtacgacccgttacttaacgttaccgtacgtaacccaacgtaacgtacgtttacgggaaacgttcgaaccgtaagtacccggtaaacggtaaaagggcggtacttagtacggttacttttagaactttacgtccggtacgggggaccccaaggggtacctaaggttccggg

SEQ ID NO: 112862 - DNA, 533 bp, Homo sapiens
  misc_feature: GYAE6OF01BNQ1W.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatccgaacctacaccatcgaatggtatcaacagagaccagggaacgtccccccagtactataatgaaagttaagagtgatgcagccacaccgaaggggacgggatccccgatcgcttcagtgggctccgagttcgtggggctcgaccgctaccgtcaccatcctccaaccctccagtctgacgatgagctgagtatcatgtggagagagccacacaattgagtggaccaaggtacgggttgggtgtcgggcgggagggaccaaggctacggaccgtccgtaggcgtaaccgg

SEQ ID NO: 112863 - DNA, 635 bp, Homo sapiens
  misc_feature: GYAE6OF01CD4CG.15.86.H09.1.454.CMB.1.raw
  modified_base (466)..(466): a, c, t, g, unknown or other
  misc_feature (466)..(466): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgtagttgggtccgccgaggcctccgaggggaaggggcgtgggagtgggttggacgtttacgaaaagtaaaatgagtggtagaagaaaatagaacgtacggtagctacccgtagaaaggaagagttccaaccagtctacaaagagaattaatacaaaacggtacgttagttaatttaganaaatgaacagaccgtaagaaaaccgagaacacacgccgtactaattacgtcgtaaccacgtagtacgttacggaagtcggactaagtccgaaacgtaaagggaggtaccttagtcgttacttttagaattcgtacggtacggggacccaggggtaactaaggttccggg

SEQ ID NO: 112864 - DNA, 607 bp, Homo sapiens
  misc_feature: GYAE6OF01B09VF.15.86.H09.1.454.CMB.1.raw
  modified_base (484)..(484): a, c, t, g, unknown or other
  misc_feature (484)..(484): n is a, c, g, or t
  modified_base (530)..(530): a, c, t, g, unknown or other
  misc_feature (530)..(530): n is a, c, g, or t
  modified_base (552)..(552): a, c, t, g, unknown or other
  misc_feature (552)..(552): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgaggttgggtccgccaggctccgaggggaaggggctgggaggtgggttggacgtttacaaaagtaaaatgatggtagaagaaaatagactacggtgacaccgtagaaaggaagattacaacatctacaaagagaataattacaaaacgtacggtatatttagaactaaagtgaacagacctaaggaaaaccgngaacacgacgccgtataattactagtacccagagtattcggaagtnacgatacggaaacgtaaagggngtcttaagtgtacttttagattacgtcggtcggggacccagggactaaggtcggg

SEQ ID NO: 112865 - DNA, 774 bp, Homo sapiens
  misc_feature: GYAE6OF01DISJS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttaggtaaagccggtggggggtcccttaggacgtctccgtgtgtggcctcgtggattcgtactttcagtaagtggctggatggtaggttcgggtccgcgacggccgtccggaaggggaacggggcgtgggagttgggttggtacgtttaacgaaaagtaaaatgagtgggtagaagaaaatagaacgtacggtacgaccgaacccgtaggaaaacggagtacttacaaccgtatacgtaacgaaaggaagtaacttaaacgttaaaccgaaaaaaccgggtggttaagtttaagttttacggaaactaaaagtacgaaaacgtaacgtacccgtaaaggaaaaacccggaggaaccaaccgaacggtccgtaacttaacgtttactaaccggtaacccctaagtaacgtacgttacgggtaaaggtcgtaacgtacgttaaccggaaaccgggttaaaaggcgggtaacctttaagttgttaccgtttttaggaaactttacggttaccgggtacgggggaccccgaaggggtaaccgtaaggtttccggggg

SEQ ID NO: 112866 - DNA, 618 bp, Homo sapiens
  misc_feature: GYAE6OF01D9MLZ.15.86.H09.1.454.CMB.1.raw
  modified_base (257)..(257): a, c, t, g, unknown or other
  misc_feature (257)..(257): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcggtggtttcgtgagtgctatacgtaaagtgtcagtgtgagtgcaggtggtggagtcgtgggggagccttggtaagcctggggggtccttagagtctcctgtgtggcctntggattcacttcagtaatggctggatgagttggtccgcaggctccgagggaagggctggagtgggtaggtacgtttacaaaggtaaaatgtagtggtagaagaaatgacgtacggtgacaccgtaggaaagagactcactatctacaaganataatacgaaaacgnggtagtagtttagacaaattcgaacagtaccgtaggaaacccgtagggaacctacgacgtacccggtacttaattacctacgtaccctagtaagtacgttacgggaattcgaccgtataccggaacggttaaaggaggtctaattcggtctttgacttacgtcgtacgggtacccgaagggtccaagttccgggg

SEQ ID NO: 112867 - DNA, 581 bp, Homo sapiens
  misc_feature: GYAE6OF01BH47H.15.86.H09.1.454.CMB.1.raw
  modified_base (536)..(536): a, c, t, g, unknown or other
  misc_feature (536)..(536): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctgggagtgggttggacgtttacaaaagtaaaatgatgggtagaagaaaatagacgtacggtgacacccgtagaaaggaagatcacatctacaagagataattacaaaacgacggtagtaatttagacaaatgaaacagacctagaaaaccgagacacagccgtactattactagtaccactagtattacggaagtgacatacgaacgtaaaggnggactatgtcttttgattacgtcgtcgggacccagggcaagtcgg

SEQ ID NO: 112868 - DNA, 593 bp, Homo sapiens
  misc_feature: GYAE6OF01A9JZR.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaaggggctggaggtgggttggacgtttacaaaagtaaaatgagtggtagaagaaatagactacggtgcaccgtagaaaggagatcaccatctacaagagataattacaaaaacgtacggtagttaatttagactaaaagtgaaacagacctaaggaaaccgaggaccacgagccgtactattactcgtaccacgtagtattacggaatgactagtacgaacggtaaaggcgcttatgtctttagattagtccgaggggacccagggtactaagtcggg

SEQ ID NO: 112869 - DNA, 681 bp, Homo sapiens
  misc_feature: GYAE6OF01CU5V2.15.86.H09.1.454.CMB.1.raw
  modified_base (512)..(512): a, c, t, g, unknown or other
  misc_feature (512)..(512): n is a, c, g, or t
  modified_base (532)..(532): a, c, t, g, unknown or other
  misc_feature (532)..(532): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgttgggtaaagccgtgggggggtccccttaggagtctccgtgtgtggcctctggattcactttcagtaatggctggatggaggttcggggtccgccgaggctccgaggggaagggggtctgggaggtggggttggtacggtttacgaaaaagtaaaatgatgggtagaagaaaatagactacggtgaccgaacccggtaggaaaagggaagtaacgttccaacccatactacgaagagaattaattaccgaaaaacggtcggttagttaatttacgactaaaatgaaaaccncgaccctaaggaaaacccgnggaaccaacgacgtcccgtaacttaattaccgtacgtaacccaagtacgtaagttaccgggaagttcgacgtacgtacggaacggtaaagggcggtactagttaggtcttttagatttacgtcggtacggggcccagggactagtcggg

SEQ ID NO: 112870 - DNA, 751 bp, Homo sapiens
  misc_feature: GYAE6OF01BA5E8.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatggagttgggtccgccgaggctccgaggggaaggggcgtggaggtgggttggtacgtttacgaaaaagtaaaatgatggtagaagaaaatagacgtacggtgaccgaacccggtagaaaaggaagactttaccgaacctactactaacgaaaggtaagaattaaacttaaccgaaaaaacggtacgggttagttaagttttaggaacctaaaagttacgaaaaccgtaacgaacccgttaacgggaaaaaaccccggaggaaacccaaccgaacggtacccgtactttaacgttacctaacgtaacccaacgtaacgtaacgttaacgggtaagtacgaccgtagtaccggaaacggtaaaacgggacggtacttaaggtacggttacgtttttaggaagtttacgttacgggttaccggggggacccccgtaaggggtaaacccgtaagggttacccgggg

SEQ ID NO: 112871 - DNA, 600 bp, Homo sapiens
  misc_feature: GYAE6OF01CEG3N.15.86.H09.1.454.CMB.1.raw
  modified_base (475)..(475): a, c, t, g, unknown or other
  misc_feature (475)..(475): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggctgggagtgggttggacgtttacaaaagtaaaatgatggtagaagaaaatagactacggtgacacccgtagaaaggagattcaccatctcaagagataattacgaaaacgtcggttagtatttagactaaatgaacagacctagaaaaccgnggaacacacgccgtatacttactagtaacccatagtacgttcggaagtgactagtacggaagtaaaggacggtctatcgtcttttagattacgtcgtcggggaccccaaggggactaaggtcggg

SEQ ID NO: 112872 - DNA, 735 bp, Homo sapiens
  misc_feature: GYAE6OF01B8PG8.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaaaggtgtccagtgtgaagtgcaggtggtggagtcgtgggggagccttggtaaagccgtgggggtcccttagagtctcgtgtgtcggcctcgtggtattctactttcaagtaatggctggtaatggtacggttcggggtcccgcgagggtcctaccggaaggggaaggggtcgtgggtaggtggggttacggaacggtttaacgaaaaaagtaaaagtggtaagtagggtaagaaagtaaaataggaaccgtacggtacgacctaaacccggtaggaaaaaggaagtaacttacgaaaccctaattaccgtaagaaagaagtaaattaaacttaacgaaaaaacggtcggttaagttaatttagaaacaaaagttacggaaaacaggaaccctaaaggaaaaccgaggaacacgtaacgcttaacctaagttaacctagtaacccacgtaagtaacgttacgggaagtagacaaacgtacggaaaacgttaaaagggcggtacttagtcggttcttttaggaattacgtcgggacgggtacccaagggtaaccagttcgggg

SEQ ID NO: 112873 - DNA, 584 bp, Homo sapiens
  misc_feature: GYAE6OF01EY48Q.15.86.H09.1.454.CMB.1.raw
  modified_base (504)..(504): a, c, t, g, unknown or other
  misc_feature (504)..(504): n is a, c, g, or t
  modified_base (539)..(539): a, c, t, g, unknown or other
  misc_feature (539)..(539): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggcgtgggaggtggggttggacgtttacaaaagtaaaatgatggtagagaaaatagactacggtgcaccgtagaaaggaagattcaccatctacaagagaataattacaaaaacgacggtagtatttagactaaatgaacagacctagaaaccgagacacagccgtactattactagtacccanagtagttacggaagtgacagtacggacgtaaaggngtctatgtctttgaattgtcgtacgggacccagggtacagtcggg

SEQ ID NO: 112874 - DNA, 630 bp, Homo sapiens
  misc_feature: GYAE6OF01D201Y.15.86.H09.1.454.CMB.1.raw
  modified_base (296)..(296): a, c, t, g, unknown or other
  misc_feature (296)..(296): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtggtttcgtgacgtgctatcttaaagtgtcagtgtgaagtgcaggtggtggagtctgggggagccttggtaaagcctggggggtcccttagagtctcctgtgtggcctctggattcactttcagtaatggctggatgagttgggtccnccaggctccgagggaaggggctggaggtgggttggacgtttcaaaagtaaaatgaatggtagagaaaatgactacggtgcacccgtgaaaggaagattcaccatcctcaaagagaataattcaaaaacgtacggtagtatttgactaaatagaaacagacctagaaaacccgaggacacaagtcgtactacttactacgtacccaataagtactttacgggaagttacggactaagttaccggaaccggtaaaaggtagggaccttaagttggtactttttaagagttaacgttcggtacgggggtaccccaagggggtactaaaggttcgggg

SEQ ID NO: 112875 - DNA, 617 bp, Homo sapiens
  misc_feature: GYAE6OF01B0DML.15.86.H09.1.454.CMB.1.raw
  modified_base (451)..(451): a, c, t, g, unknown or other
  misc_feature (451)..(451): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctggagtgggttggacgtttacgaaaagtaaaaatgatggtagaagaaaatagaagtacggtgcacccgtagaaaggagattcacatctacaagagataattacaaaacgacgtagtattgactaaagtnaaacagacctaaggaaaacccgaggaaccacacgacccgttacgtaattacctagtaccaacgaagtatttacgggaattaggctaatacggtaacgtaaaagggaggtactaatggtcttttagaattactcggtacggggaccctaaaggggctaaaggttcgg

SEQ ID NO: 112876 - DNA, 605 bp, Homo sapiens
  misc_feature: GYAE6OF01A5ON0.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaggggctggagtgggttggacgtttacaaaagtaaaatgatggtgagaaaatagactacggtgacacccgtagaaaggagattcaccatctacaagagataattacaaaacgacggtagtaatttgacaaagtgaacagacctagaaaccgagaaccacgacgccgtactaacttactacgtaccacgagtattacggaagtcgaccgtataccggaacggtaaagggacggtctagttcggtcttttagattacgtcgtacggggacccgagggactaaggttcggg

SEQ ID NO: 112877 - DNA, 650 bp, Homo sapiens
  misc_feature: GYAE6OF01DB8M3.15.86.H09.1.454.CMB.1.raw
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcggtggtttcgtgagtgctatacgtaagtgtcagtgtgaagtgcaggtggtggagtcgtggggganccttggtaaagccgtgggggtcccttagngtctcctgtgtcggcctgtggattcactttcagtatggctggatgagttggccgcaggctcgagggagggctggaggtgggtgacgtttacaaaagtaaaatgtatagggtagaaaggaaaatagacgtacggtcgacgtaaccgaggaaaggaagtattaccaccatactagaaagagaattaataacaaaacggtggttattaagtttaagaactaaagtacgaaacacggaccgtaaacggaaaccgacgaaccgacgtacgtaccgttacttaagttacgtacgtaacctaacgtagtacgttacggagtacgacgtaacggaaccggtaaaggtaaggacgtacttagttacggtttattagtagttcggtaccggacgggaccgaacggtagtacggttcgg

SEQ ID NO: 112878 - DNA, 671 bp, Homo sapiens
  misc_feature: GYAE6OF01ENWU5.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgaggggaagggggctgggaggtgggtggacgtttacaaaagtaaaatgatggtagaagaaaatagactacggtgacacccgtagaaaggagattacacatctacaaagagtaataaattacgaaaaacgtacggttagtaagttttaggactaaaataggaaaacaggaccctaaggaaaaacccggaggaaccaacgacgcccgtactacttaactagtaacccaacgtagtaattacgggaagtcgacaactacgggaaacggtaaaagggaggtaccgttaagtcggtaccttttttaggaagttaacgttccggtacggggggtacccccaagggggtaaccctaaggttacgggg

SEQ ID NO: 112879 - DNA, 660 bp, Homo sapiens
  misc_feature: GYAE6OF01DPKDH.15.86.H09.1.454.CMB.1.raw
  modified_base (357)..(357): a, c, t, g, unknown or other
  misc_feature (357)..(357): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtgggagtcgtggggagccgttggtaaagccgtgggggtcccttagagtctctgtgtggcctcgtggattctactttcagtaagtggctggatggaggttgggtccgccgaggcctccggaggggaaggggcgtgggaggtgggttggtacgtttanaaaagtaaaatgagtggtagaagaaaatagacgtacggtgacaccgtagaaaggagacttacacatctacaagagataatacaaaacggtacggtagtaatttgaactaaatcgaaacagaccctaagaaaaccgaggaaccacgacgtacctacttaattaccgtacgtaacccacgtaagtacgttacgggaagttcgacgtaagtaccggaaacggtaaagggtacggtcttaagttggttccgtttttagaacttacggttccggtacgggggacccctaaggggacctaaggttcggg

SEQ ID NO: 112880 - DNA, 609 bp, Homo sapiens
  misc_feature: GYAE6OF01BA6VT.15.86.H09.1.454.CMB.1.raw
  modified_base (417)..(417): a, c, t, g, unknown or other
  misc_feature (417)..(417): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggccgcaggctcgaggggagggctggaggtgggttggacgtttacaaaaggtaaaatgatggtagaagaaaatagacgtacggtgacaccgtaggaaaggaagattcacatctacgaaganaataactaccaaaacggtcgtagtatttgaacaaatgaaacacgacctaagaaaccgagaacacacgcctactaattacgtgtaacccagtaagtacttacgggaagttcgacgtagtaccggtaaaggtaaagggacgtattagtgtcttttgaattcgtcggtcggggacccagggtactaaggttcggg

SEQ ID NO: 112881 - DNA, 600 bp, Homo sapiens
  misc_feature: GYAE6OF01EC584.15.86.H09.1.454.CMB.1.raw
  modified_base (185)..(185): a, c, t, g, unknown or other
  misc_feature (185)..(185): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctcgatcaagctcacctgccaccctaagtagtgagcatccgaacctacaccatcgaatggtatcaacagagaccagggaacgtccccccagtactataatagaaagttaagagtgagtgcagccaacaccgaaggggacggacgtccccgagtcgctcagtcgggctccgagttcgtcgggctcgaccgtctacctccaccactcctacccaaccctcctacgtctagacgatcggacgtctgaagtataccgacgtggtaggaaggtagacggtaccaacaacgtaattcggaagtacggaccgtaagggtacggggttggggtacggttacgggcgggaacggggaaccgaacggtcgtacggtacccgtccggtacggtccgtaacccggg

SEQ ID NO: 112882 - DNA, 578 bp, Homo sapiens
  misc_feature: GYAE6OF01CZZNT.15.86.H09.1.454.CMB.1.raw
  modified_base (418)..(418): a, c, t, g, unknown or other
  misc_feature (418)..(418): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagccgtggggggtcccttagagtctcctgtgtggcctctggattcactttcagtaatggctggatgagttgggtccgccaggctccgagggaaggggcgtgggaggtgggttggacgtttacaaaaggtaaaatgatggtagaagaaaatagactacggtgacaccgtagaaaggagatacacatctacaaganataacttacaaaacgcggtagtatttgactaaatgaaacacgacctagaaaaccgagacacagcctatatactagtaccatagattcggagtgcatacgaagtaaggaggtctagtacgtctttagatacgtcggtcggggaccctagggactagtcggg

SEQ ID NO: 112883 - DNA, 527 bp, Homo sapiens
  misc_feature: GYAE6OF01BJS0S.15.86.H09.1.454.CMB.1.raw
  modified_base (185)..(185): a, c, t, g, unknown or other
  misc_feature (185)..(185): n is a, c, g, or t
  modified_base (452)..(452): a, c, t, g, unknown or other
  misc_feature (452)..(452): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctcgatcaagctcacctgcaccctaagtagtgagcatcgaacctacaccatcgaatggtatcaacagagaccagggaagtccccccagtactataatagaaagttaagagtgatggcagccacaccgaaggggacggactccccgatcgcttcatgggctcagttctggggctcgaccgctacctcgaccatcctccctaaccctccacgtctgaccgatgaggctgagtatcacgtgtggagagngaccacacattgagtggaccaaggtcggttgggtgttcgggcggagggaccagctcggaccgtcgtggcgaccgg

SEQ ID NO: 112884 - DNA, 581 bp, Homo sapiens
  misc_feature: GYAE6OF01AILAT.15.86.H09.1.454.CMB.1.raw
  modified_base (429)..(429): a, c, t, g, unknown or other
  misc_feature (429)..(429): n is a, c, g, or t
  modified_base (495)..(495): a, c, t, g, unknown or other
  misc_feature (495)..(495): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtggttttccttgactgctatcttaaaaggtgtccagtgtgaagtgcaggtggtggagtctgggggagccgttggtaaagcctggggggtcccttagagtctcctgtgtggcctctggattcacttttcagtaatggctggatgagttggtccgccaggctccgaggggagggggctggagtgggttggacgtttacaaaagtaaaatgatggtagagaaaatagactacggtgacaccgtgaaaggaagattcacatctacaagagataattacaaaacgnggtagtatttgacaaatgaacagacctagaaaccgagacacacgcgtactagttacctagtaccanagtacttcggaagtgcagtcgaacgtaaaggcggtactagtgtcttttaggattacgtcgtacggggacccagggactagttcggg

SEQ ID NO: 112885 - DNA, 524 bp, Homo sapiens
  misc_feature: GYAE6OF01E2EU6.15.86.H09.1.454.CMB.1.raw
  modified_base (394)..(394): a, c, t, g, unknown or other
  misc_feature (394)..(394): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccccagtatataatgaaagttaagagtgatggcagccacaccaagggggacgggatccccgatcgcttcatgggctccagtctggggctgaccgctacctcaccntctccaacctccagtctgacgatgaggctgagtatcactgtggagagagccacacaattgatggaccaaggacgggttgggtgttcgggcgggacggggaccaacggctagacccgtcctaggtcaccgg

SEQ ID NO: 112886 - DNA, 573 bp, Homo sapiens
  misc_feature: GYAE6OF01DNT66.15.86.H09.1.454.CMB.1.raw
  modified_base (442)..(442): a, c, t, g, unknown or other
  misc_feature (442)..(442): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagtggtccgccaggctcgagggaggggctggagtgggttggacgtttacaaaagtaaaatgatggtagaagaaaatagactacggtgacacccgtagaaacggaagattacacatctacaagagataatacaaaacgtcgtagtattaganaaatgaacagacctaagaaaccgagacacacgccgtactattactacgtaccatagagttacgaagtgacagtacgaacgtaaaggagactagtgtctttagattatcgtagggacccagggactagtcgg

SEQ ID NO: 112887 - DNA, 587 bp, Homo sapiens
  misc_feature: GYAE6OF01CU2UD.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggaaggggctggagtgggttggacgtttcaaaagtaaaatgatggtagaagaaaatagactacggtgcaccgtagaaaggaagattcaccatctacaagagattaatacgaaaacgtcggtagttaatttgactaaatgaaacagacctagaaaccgaggacacacgccgtactattacctagtaccagtagacttacggaagtgacagtacgaacgtaaggaggtactatgtcttttagattacgtcgtcggggacccagggactaaggttcggg

SEQ ID NO: 112888 - DNA, 640 bp, Homo sapiens
  misc_feature: GYAE6OF01DRWIS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatggtagttgggtccgccaggctccgaggggaaggggcgtgggaggtgggttggtacgtttacaaaagtaaaatgaagtggtagaagaaaatagactacggtgacgaccggtagaaaaggagtattacgaccatctacaaagagtaataattaacaaaaacggtcggttagttatttagaactaaatacgaaactacgaccgtaaggaaaacccgaggaacaccgacgtcccgtattacgttactacgtaaccaacgtagtacgttaggaagtgacagtacggaacggtaaaggcggtacttagtgtcttttagattacgtcggtacggggaccctaagggactaggtcgg

SEQ ID NO: 112889 - DNA, 708 bp, Homo sapiens
  misc_feature: GYAE6OF01CMVAK.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaagccgtgggggtcccttagagtctcctgtgtgcctctggattcactttcagtaatggctggatggtagttgggtccgccgaggcctccgaggggaaggggcgtgggaggttggggttggtacgtttacgaaaaagtaaaatgaagtggtagaagaaaatagactacggtgaccgaacccggtagaaaggaagacttacaacctatactacgaaagagtaattaacttaacgaaaacggtacggttagttaagtttagaactaaagtagaaacagaccctaaggaaaacccgaggaaccaacgacggtacccgttacttaacgttaaccgtacgtaacccaacgtacggtaacgtttacgggaacgtcgactacgtaccggtaaacgggttaaagggaacggtacttaagttcggttacgtttttaagagtttacgtccgggttaccgggggaccccgtaaaggggtacctaaggtttccgggg

SEQ ID NO: 112890 - DNA, 602 bp, Homo sapiens
  misc_feature: GYAE6OF01CLKAC.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccaggggaaggggctggagtgggttggacgtttacaaaagtaaaatgatggtagaagaaaatagactacggtgcacccgtagaaaggaagattcaccatctacaagagataattacaaaaacgtcgtagtaatttgactaaatgaaacagacctagaaaaccgaggaacacgagcccgtatattactagtacccaacgtagtattacggaagtgacaagtcgaacggtaaagggaggtccttatggtcttttagattacgtcggtacggggacccaaggggactaaggttcggg

SEQ ID NO: 112891 - DNA, 806 bp, Homo sapiens
  misc_feature: GYAE6OF01EV1K4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatcttaaaaggtgtccagtgtgaagtgcgaggtggtggagtcgtggggagccgttggtaagccgtggggtcctagagtctcctgtgtggcctcgtggattcactttcagtaatggctggatggtaggttcgggtccgccgaggcctaccggaggggaaggggcgtgggaggttggggttacggtacgtttaacgaaaaagttaaaatgaagtggtagaaagtaaaagtagacgtacggtgaccgtaaccggtagaaaggagtacttaccaacctactacgtaacgaagtagtaattaacgttaacgaaaaaccggttcggttagttaacgttttacggaacttaaaaagtacggaaaccgtaacggtaacccgttaaacggaaaaaccccgggtaggaaacccaaccgtaaccgggtaaccccgtttacgtttaaacgtttaacccgttaaccggttaaaccccaagttaaacggttaaccggtttaccgggaaagttaccggaaccgtaaacggttacccggaaaacgggttaaaagggtccgggttacttaaggttacggttacgtttttagaacgttaacggtttcccgggacgggggtaaaccccctaggggtaaacctaagggtttcccggg

SEQ ID NO: 112892 - DNA, 697 bp, Homo sapiens
  misc_feature: GYAE6OF01C2DL3.15.86.H09.1.454.CMB.1.raw
  modified_base (262)..(262): a, c, t, g, unknown or other
  misc_feature (262)..(262): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcctagagtctctgtgtggcctctggnttcactttcagtaatggctggatgaggttcgggtccgccgaggctccgaggggaagggcgtggaggtggtggtacgtttaagaaaagtaaaagtgagtggtagaagaaaataggacgtacggtgaccgtaaccgtaggaaaggagaacttcgaactatctaacaaagacgtaataaacttaacgaaaaacggtacggttagttaagtttagaactaaaagtacgaaaaccgtagacccgtaaggaaaaccggtacgaacaaccgtacgaccgttacttaacgttaccgtacgtaccccaagtaacgtaacgttacggaagtacgaacgtaacgttacggaaacggttaaaaggacggtacgttaagttcggtttacgtttagtaaccgttgtaccgggtaccgggaacccggagggaaaccgttaggttcccggg

SEQ ID NO: 112893 - DNA, 622 bp, Homo sapiens
  misc_feature: GYAE6OF01BD5OI.15.86.H09.1.454.CMB.1.raw
  modified_base (363)..(363): a, c, t, g, unknown or other
  misc_feature (363)..(363): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtcagtgtgaagtgcaggtggtggagtctgggggagccttggtaaagccgtgggggtcccttagagtctcctgtgtggcctctggattcacttttcagtaatggctggatgagttgggtccgccaggctccgaggggaagggctgggagtgggttggacgtttacaaaagtaaaatgatggtanaagaaaatagactaggtgcaaccgtgaaagagattcaccatctacaagagataattacaaaaacgtcggtagtatttagactaaagtgaaacagacctagaaaaccgaggaacaacgagccgtactattacgtagtaaccacgtagattacggaagtcgactaagtaccggaaacggttaaacggagggtaccttaagtcggttacttttacgattaacgtcgttaccgggggacccaagggtaacgtaaggttccggg

SEQ ID NO: 112894 - DNA, 571 bp, Homo sapiens
  misc_feature: GYAE6OF01BJ9V6.15.86.H09.1.454.CMB.1.raw
  modified_base (463)..(463): a, c, t, g, unknown or other
  misc_feature (463)..(463): n is a, c, g, or t
  modified_base (481)..(481): a, c, t, g, unknown or other
  misc_feature (481)..(481): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccagggaaggggctggagtggggttggacgtttcaaaagtaaaatgatggtgagaaaatagactacggtgcaccgtgaaaggaagattcaccatctacaagagataattacaaaacgacggtatatttgacaaatgaacagcctagaaaaccgngacacagcctatattacngtaccacagattcggaagtgacagtcgaagtaaagggcgtctaagtcgtcttttgattacgtcgtcggggacccaggggaccagttcggg

SEQ ID NO: 112895 - DNA, 588 bp, Homo sapiens
  misc_feature: GYAE6OF01CYMZP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgcaggctccgagggaaggggctggagtgggttggacgtttacaaaagtaaaatgatggtagaagaaaatagactaggtgacaccgtagaaaggaagatcacatactacaagagataatacaaaacgacggtgtattagacaaatagaacagctagaaacgagacacagccgtactattactgtaaccacgagtaagttccggaagtcgacaagtacggacggtaaagggaggacttagtggttacttttagattagtccgtacggggcccaaggggactaaggttcggg

SEQ ID NO: 112896 - DNA, 729 bp, Homo sapiens
  misc_feature: GYAE6OF01BSZQ9.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtcccttagagtctctgtgtggcctctggattcactttcagtaatggctggatggagttcgggtccgccgaggcctccggaggggaaggggcgtgggaggttggggttaggtacgtttaacgaaaaagttaaaaagtgaagtggtagaagaaaatagaacgtacggtgaccgaacccggtaggaaaaggaagacttaccaacatctacgaaagaagtaataattaacgaaaaacggtcggttattaatttaggaactaaaagtgaaacagtaccctaagaaaacccggaggaacaccgacgtacccgttaacttaacgtttaccgtagtaaccccgaagtaacggttaacgtttacgggaaacggtacgaccgtaacggtacccgggtaaaacggttaaagggacggtacgtttaagtggtttaccttttagaacgttacgttacccgggtagggggaacccccgaaggggtaacccgtaaaggttcccgggg

SEQ ID NO: 112897 - DNA, 615 bp, Homo sapiens
  misc_feature: GYAE6OF01DTZDI.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctgggagtgggttggacgtttacaaaagtaaaatgatggtagagaaaatagactacggtgcacccgtagaaacggaagattcacatcacaagagataattacaaaacgacggtagtatttagactaaatagaaacagaccgtagaaaaccggaggaaccaacgacgtccgtacttatttacctacgtaaccactaagtacttacggaagtcgactagtcgaaacggtaaaggaggtacttagttggtcttttagattagtcgtacggggacccaacgggacgtaaggttcggg

SEQ ID NO: 112898 - DNA, 622 bp, Homo sapiens
  misc_feature: GYAE6OF01CK29H.15.86.H09.1.454.CMB.1.raw
  modified_base (398)..(398): a, c, t, g, unknown or other
  misc_feature (398)..(398): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctctgtgtggcctctggattcactttcagtaatggctggatgagttggtccgcaggctccgagggaaggggctgggagtgggttggacgtttacgaaaagtaaaaatgaatggtagaagaaaatagactacggtgacacccgtagaaaggaanagttcaccatactacaagagataaattacaaaaacggtacggtagtaagtttagactaaaagtgaaacagaccctaaggaaaaccgaggaaccacacggtaccgtactactttaactagtaccaacgagtacgttaccggaagtcgacagtacgaacggtaaaggaggtactagtagttcttttagattacgtcggtacgggacccaagggactaaggtacggg

SEQ ID NO: 112899 - DNA, 563 bp, Homo sapiens
  misc_feature: GYAE6OF01B9WF4.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccagggaaggggctggagtgggtggacgtttcaaagtaaaatgatggtagagaaaatagactacggtgcacccgtgaaaggagattcacatctcaagagataattacaaaacgacggtagtatttgacaaatgaaacagacctagaaaaccgaggaacacagccgtactattactagtaccactagattcggaatgcatcgacgtaaaggagctatgtcttttgaatactcgtggggacccaggggacaagttcggg

SEQ ID NO: 112900 - DNA, 670 bp, Homo sapiens
  misc_feature: GYAE6OF01CCK3P.15.86.H09.1.454.CMB.1.raw
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtcccttagagtctcctgtgtggcctctggattcactttcagtaatggctggatgagttgggtccgccgaggcctccgaggggaaggggctgggaggtcgggttggaacgttttacaaaaagtaaaaatgaagtaggtagaagaaaaatagaacgtacggtagaccgaacccgtagaaaagaagattacaaccatactacaaagagaataaattacaaaaaacgtcggttattaacgtttagaactaaaatcgaaacagtaccctaagaaaaacccgnggaaaccncgtaagacccgttattaacttaactacgtaacccaacgagtaactttacgggaaagtgacaagtaccggaaacggtaaaaggcggtacttaagtgttaccgttttagaattacgtcgtacggggacccaaggggaacctaagttcggg

SEQ ID NO: 112901 - DNA, 607 bp, Homo sapiens
  misc_feature: GYAE6OF01A2K9T.15.86.H09.1.454.CMB.1.raw
  modified_base (518)..(518): a, c, t, g, unknown or other
  misc_feature (518)..(518): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccaggggaaggggctggagtgggttggacgtttacaaaagtaaaatgatgggtagaagaaaatagactacggtgacaacccggtagaaaaggaagattacaacccatctacaaagagaattaaattacaaaaacgtacggtagtaactttgacaaaatgaaacacgacctagaaaaccgaggacacgagccgtactaattactgtacccanacgattaccggaagtcgacagtacgaaggtaaagggaggtactatggtcttttaggatacgtcgtggggaccccaggggacaagtcggg

SEQ ID NO: 112902 - DNA, 629 bp, Homo sapiens
  misc_feature: GYAE6OF01BDTJB.15.86.H09.1.454.CMB.1.raw
  modified_base (421)..(421): a, c, t, g, unknown or other
  misc_feature (421)..(421): n is a, c, g, or t
  modified_base (476)..(476): a, c, t, g, unknown or other
  misc_feature (476)..(476): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggccgccaggctccgaggggaaggggctgggaggtgggttggacgtttacaaaagtaaaaatgaagtggtagaagaaaatagacgtacggtgacaccgtagaaaggaagatcacatctacaaganataatacaaaacgcggtatattagactaaagtgaaacagacctaaggaaaaccgnggaaccacgagtacccgtacttaacttaactacgtaaccaactagtaacgttacggaagttgacctaagtaccggaaacggtaaaagggcggtacttaatggtctttttagaattacgttcggtacggggaacccaagggtactaagttcggg

SEQ ID NO: 112903 - DNA, 572 bp, Homo sapiens
  misc_feature: GYAE6OF01EBWZL.15.86.H09.1.454.CMB.1.raw
  modified_base (494)..(494): a, c, t, g, unknown or other
  misc_feature (494)..(494): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctggggggtcccttagagtctcctgtgtggcctctggattcactttcagtaatggctggatgagttggtccgccaggctccaggggaaggggctgggagtgggtggacgtttcaaagtaaaatgatggtgaagaaaatagactacggtgacgacccgtagaaaggaagatcacatcacaagagaataattacaaaaacgacggtagtatttagacaaatagaaacagacctagaaaccgagacacagccgtactattactgtaccanagattacggaagtgcatacgacgtaaagggagtctatgtctttagatacgtcgtacggggcccagggactaagtcggg

SEQ ID NO: 112904 - DNA, 605 bp, Homo sapiens
  misc_feature: GYAE6OF01CKONT.15.86.H09.1.454.CMB.1.raw
  modified_base (217)..(217): a, c, t, g, unknown or other
  misc_feature (217)..(217): n is a, c, g, or t
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (410)..(410): a, c, t, g, unknown or other
  misc_feature (410)..(410): n is a, c, g, or t
  modified_base (450)..(450): a, c, t, g, unknown or other
  misc_feature (450)..(450): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggcgtttcgtcgaaggtcgctaattacgtaaagtgcagtgtgagtgcaggtggtggagtcgtaggggnccgttggtaaagccgtggggggtcccttagagtctcctgtgtcggcctcgtggattcactttgagtaatggctggatgtagttcgggccgccaggctaccgaggggagggctggngtgggtgacgtttanaaaagtaatgagtggtanagtaaatcgacttaggngacacgtagaagactatccacatacganaagaagtaataataacgtaaacgtaacgtagtattagtanaataagaacgacgacgaacgaacgaacgacgacgacgactactactacgtacgtactacgtagtagtacgtagtacgacgtacgtacgtacggtaaggtacgtacgtagtagttcgttagtagtacgtacggtacggacggacggtagtacgtcg

SEQ ID NO: 112905 - DNA, 639 bp, Homo sapiens
  misc_feature: GYAE6OF01CQAO2.15.86.H09.1.454.CMB.1.raw
  modified_base (351)..(351): a, c, t, g, unknown or other
  misc_feature (351)..(351): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggtgacgtttacaaaagtaaangatggtagaagaaaatgactaggtgacaccgtagaaaggagatacacatcacaganataatacaaaacgngtagtattgacaaatacgaangtacctaagaaaacccgtaggaacacgacgaccgttactaatttaactagtaacccaactaggtaacgtttccgggaaagttcgacgtaagtacgggaaacgtaaaggggacgtacgttagtcggttacgtttttagaagttaaccgtttcccggaggggggtacccccgaaaggggtaaccctaaaggttccgggg

SEQ ID NO: 112906 - DNA, 748 bp, Homo sapiens
  misc_feature: GYAE6OF01DDVOT.15.86.H09.1.454.CMB.1.raw
  modified_base (260)..(260): a, c, t, g, unknown or other
  misc_feature (260)..(260): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtccttagagtctctgtgtggcctntggattcactttcagtaatggctggatggagttcgggtccgccgaggctaccgaggggaagggcgtagggtagtgggttaggaacgtttaacaaaaagtaaaaagtgaatggtagaagaaaactgaacgtaggtgacgaacccggtagaaaaggaagtaattccaaccattacctaacgaaagaaggtaattaaacttaacgaaaaacggtacggttagtaagtttagaaacaaaagttaggaaacaaggtacccctaaaggaaaaacccggacggaaaccaaccgaaggtaccccgttattaacgtttaacgtaccggtaaccctaagaacggttaaactttacgggtaaagttagttaaaccggtaacggtaaacgggttaaaagggacggttaacttaaacggttgttacggtttttagaacgtttaaaggtccgggtaccgggggaaacccgtacggggaaacttaaccggtggggtttacccg

SEQ ID NO: 112907 - DNA, 654 bp, Homo sapiens
  misc_feature: GYAE6OF01B7A5P.15.86.H09.1.454.CMB.1.raw
  modified_base (644)..(644): a, c, t, g, unknown or other
  misc_feature (644)..(644): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtccttagagtctcctgtgtgcctcgtggattcactttcagtaatggctggatggagttgggtccgccgaggcctccgagggaaggggctgggaggtgggttggacgtttacaaaagtaaaagtgagtggtagaagaaaagtagactacggtgcaccgtagaaaggaagattacacatctacgaagagtaataattacgaaaaacgtacggttagttaatttgactaaaagtagaaacgagaccctaaggaaaaacccgaggaaccaacgacgccgttacctattaacctgtaaccaacgtagtaacgttacggaagtcgacgtaacgtacggtaacggtaaaaggcggtaccgttagttacggttcgttttagaattacggtcgttaccggggggacccaacggggtaanaaggttcggg

SEQ ID NO: 112908 - DNA, 708 bp, Homo sapiens
  misc_feature: GYAE6OF01BZ449.15.86.H09.1.454.CMB.1.raw
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaagggctggagtgggttggacgtttacaaaagtaaaatgatggtagagaaaatagactacggtgcacccgtgaaaggaagattcaccatctacaagagataaattacaaaaacgtacgtaggtagttagttagaactaaagtacgaacacgtaccgtaaacgaaaaccggacgaacaacgacgtaccgtacttaacttacgtacgtaaccaagagtacgtacggaagtacgacgtacgtacggtaaacggttaaagggtagtttagtcggtttacgtttagtaattacgttccggtaccgggaccggaagggtaactaacggttcggttacgttccgttccttcgttacgaccgtccctacccgaaccgacccgggaccctacggtccccggttccccttcccccggtcgacccctacccctcccgtaaccgaacgacccg

SEQ ID NO: 112909 - DNA, 586 bp, Homo sapiens
  misc_feature: GYAE6OF01DYXBB.15.86.H09.1.454.CMB.1.raw
  modified_base (475)..(475): a, c, t, g, unknown or other
  misc_feature (475)..(475): n is a, c, g, or t
  modified_base (538)..(538): a, c, t, g, unknown or other
  misc_feature (538)..(538): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggggagccgttggtaaagccgtggggggtcccttagagtctcctgtgtggcctctggattcactttcagtaatggctggatgagttgggtccgccaggctccgaggggaaggggctgggagtggggttggacgtttacaaaagtaaaatgatggtagaagaaatagactacggtgcaccgtagaaaggagattcacatctcaaagagaataattacaaaaacgcggtagtatttagacaaatagaaacagacctagaaaaccgnggacacgagccgtatattactgtaccacgagtacttacggaagtgacagtacgaagtaaaggnggtactatcgtctttagattatcggtagggcccaagggactagtcggg

SEQ ID NO: 112910 - DNA, 665 bp, Homo sapiens
  misc_feature: GYAE6OF01ERE3Y.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatggagttggggtccgccgaggctccgaggggaagggggctgggaggtggggttggacgtttacgaaaagtaaaaatgaagtggtagaagaaaatagacgtacggtgacgacccgtagaaaggaagattcacatcacaagagaataattacgaaaaacgtacggtagttatttagactaaatcgaaacagacctaggaaaaccgaggaacacgagacccgtataacttactacgtaaccacgtaagtaacgttacggaagtacgacgtaagtaccggaaaccgggtaaaagggtacggtacttaagttacggttcttttaggtaagttaacgttcggtaacgggggaccctaaggggacctaaaggtttccgggg

SEQ ID NO: 112911 - DNA, 791 bp, Homo sapiens
  misc_feature: GYAE6OF01DBIXH.15.86.H09.1.454.CMB.1.raw
  modified_base (349)..(349): a, c, t, g, unknown or other
  misc_feature (349)..(349): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctctgtgtggcctctggattcactttcagtaagtggctggatggaggttcgggtccgccgaggctccgaggggaaggggctgggagtgggttggacgtttanaaaagtaaaagtgatggtagaagtaaaagagactacggtagaccgaacccggtaggaaaacgggaaagtacttaccgaaccaagttaccctaacgaaagaagtaaagttaaactttaacccgaaaaaaaacgggtacgggtttaagttaatttttacggaaaccgttaaaaagttcggaaaaacgtacggaaccccgttaaagggaaaaaaaccccggtagggaaacctaaacccgaacggtaccccggtttaaccttaaacgttttaaccgtacggtaaacccctaagtaacggtaaacgttttaccgggaaagttcgaacgtaaacgttcgggtaaaacgttaaaacggggacggttaccttaaggttcggttctttttaaggattaacgttccgggtaaccgggggacccaaagggggtaaccctaacggtttacgggg

SEQ ID NO: 112912 - DNA, 585 bp, Homo sapiens
  misc_feature: GYAE6OF01B0Q3J.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaaggggcgtgggaggtgggttggacgtttacgaaaagtaaaatgaagtggtagaagaaaatagacgtacggtgacacccgtagaaaggaagattacaccatctacaagagataatacaaaacgacggtagtattgacaaagtgaacagcctagaaaccgagacacagccgtactattactagtaccacgtagattacggaagtcgacagtacgaacgtaaaggaggtactagtgtctttgattagtcgaggggacccagggtacagtcgg

SEQ ID NO: 112913 - DNA, 612 bp, Homo sapiens
  misc_feature: GYAE6OF01BCISA.15.86.H09.1.454.CMB.1.raw
  modified_base (398)..(398): a, c, t, g, unknown or other
  misc_feature (398)..(398): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgcaggctccgagggaaggggctggagtgggttggacgtttcgaaaagtaaaatgatggtagaagaaaatagacgtacggtgacacccggtagaaaggaanattcaccatctacaaagagtaataattaacaaaacgacggtagtatttagactaaatagaacagacctaagaaaccgaggacacagccgtactattactgtaaccatagacttacggaagtcgctatacggaacgtaaagggaggtaccttagtcggttcttttagaagttagttccggtacgggggacccctaaggggacctaaggttccggg

SEQ ID NO: 112914 - DNA, 650 bp, Homo sapiens
  misc_feature: GYAE6OF01DZ0NN.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctcgtggattctactttcagtaatggctggatggtagttgggtccgccaggcctccgaggggaagggcgtgggaggtgggttggacgtttagaaaagtaaaatgatggtagaagaaaatagaactacggtgacaccggtaggaaaggagacttacacatctacaagagaataattacgaaaaacgtcggttagtatttagaactaaagtgaaacagaccgtaagaaaaccgagaacacgacgaccttactaacttaccgtagtaacccacgtaagtaacgttacggaagtacgacagtacggaaccggtaaaagggcggtacttagttacgttcgttttagaagttacgttcgggtaccggggaccctaaaggggtcaaagggttccgg

SEQ ID NO: 112915 - DNA, 612 bp, Homo sapiens
  misc_feature: GYAE6OF01EH3LQ.15.86.H09.1.454.CMB.1.raw
  modified_base (400)..(400): a, c, t, g, unknown or other
  misc_feature (400)..(400): n is a, c, g, or t
  modified_base (554)..(554): a, c, t, g, unknown or other
  misc_feature (554)..(554): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaagggctgggaggtgggttggacgtttacaaaagtaaaatgatggtagaagaaaatagactacggtgaccaccgtagaaagganaattcacatctacaaagagaattaatacaaaaacggcggttagtatttagactaaaatgaaacacgacctaggaaaacccgagaccacacgaccgtataacttaactacgtaccagtagtacttacggaagtcgacagtaccgaaggtaaaggnggtactagtcggtcttttaggattacgtcggtacgggacccaagggtacaggttcggg

SEQ ID NO: 112916 - DNA, 600 bp, Homo sapiens
  misc_feature: GYAE6OF01A7MCC.15.86.H09.1.454.CMB.1.raw
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
  modified_base (548)..(548): a, c, t, g, unknown or other
  misc_feature (548)..(548): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgttgggtaaagccgtggggggtcccttagagtctcctgtgtggcctctggattcactttcagtaatggctggatgagttgggtccgccaggctccgaggggaaggggctgggaggtgggttggacgtttacaaaagtaaaatgagtggtagaagaaaatagactacggtgcaccgtagaaaggaanactcacatctacaaganaataatacaaaacgtcgttagtatttagacaaagtagaaacagtaccaaggaaaaccgaggaacacgagccgtactatactagtacccagagtattacggaagtcgatagtaccgaaggtaaaggnggtactagttgtcttttagattacgtcgtcggggaccagggataaggttcgg

SEQ ID NO: 112917 - DNA, 646 bp, Homo sapiens
  misc_feature: GYAE6OF01DPM64.15.86.H09.1.454.CMB.1.raw
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
  modified_base (477)..(477): a, c, t, g, unknown or other
  misc_feature (477)..(477): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtccttagagtctctgtgtggcctctggattcactttcagtaatggctggatggagttggtccgcaggctcgagggagggctggagtgggtgacgtttacgaaaagtaaaatgagtggtagaagaaaatagactaggtgacgacccgtagaaagganattacacatctanaagataataattaacaaaacgtacggtattaatttagaactaaagtcgaaacagacctaaggaaaaccggnggaaacacgacgtaccgttactaacgtttactacggtaaccctaacgtaagtaacgtttacgggaaagttcgactaacgttaccggaaacggtaaagggacggtacttaagttcggttacttttgaatttacgtcggtacgggaccctaaggggtaacctaggttcggg

SEQ ID NO: 112918 - DNA, 609 bp, Homo sapiens
  misc_feature: GYAE6OF01B4LDW.15.86.H09.1.454.CMB.1.raw
  modified_base (497)..(497): a, c, t, g, unknown or other
  misc_feature (497)..(497): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctgggagtgggttggacgtttacaaaagtaaaatgagtggtagaagaaaatagacgtacggtgacacccgtagaaacggaagattcaacatctacgaaagagaataaattaacaaaaacgtacggtataatttagacaaaatgaaacagaccgtaagaaaacccggagaaccaanacgaccgtactagtactacgtaccacagtaattcgaagtgacagtacgaacgtaaaggcgattagtagtcttttagaattagtccgtagggacccaagggactaaggtcggg

SEQ ID NO: 112919 - DNA, 662 bp, Homo sapiens
  misc_feature: GYAE6OF01CK2C9.15.86.H09.1.454.CMB.1.raw
  modified_base (429)..(429): a, c, t, g, unknown or other
  misc_feature (429)..(429): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagccttggtaaagccgtggggggtcccttagagtctcctgtgtggcctctggattctactttcagtaatggctggatggaggttgggtccgccgaggctccgaggggaaggggctgggaggtgggttgtacgtttacaaaagtaaaatgatggtagaagaaaatagactacggtgaccgaaccggtagaaaggaagtactacaaccatactanaagaagataattacgaaaacgtcggtagttattagactaaatagaaacacgacctaaggaaaaccggagaacacaacgcccgttatacgttacgtacgtaccaacgtacgtagttacgggaagtcgacaagtaccggtaaacggtaaagggacggtacttaaggttcggttcgtttttaggaactttacgtaccgggtacgggggacccctaaggggaactaagggttcgggg

SEQ ID NO: 112920 - DNA, 621 bp, Homo sapiens
  misc_feature: GYAE6OF01E1ZCU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtggggggtcccttagagtctcctgtgtggcctctggattcactttcagtaatggctggatggagttgggtccgcaggctccgaggggaggggctggagtgggtggacgtttacaaaagtaaaatgatggtagaagaaatagactacggtgacacccgtagaaaggagacttcaccatctacaagagaataattacaaaacggtacggttagtatttgactaaatagaacacgacctaacgaaaaccgaggacaacgacgaccgtacttaacttactagtacccacgtagtagttacgggaagtgaccaagtaccgaaacggtaaaagggacggacttagtgtacttttagaattacgtcggtacggggaccccgagggactaaggtcggg

SEQ ID NO: 112921 - DNA, 627 bp, Homo sapiens
  misc_feature: GYAE6OF01CYEOX.15.86.H09.1.454.CMB.1.raw
  modified_base (468)..(468): a, c, t, g, unknown or other
  misc_feature (468)..(468): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctggagcgtgggttttccgttgacgtgctatacttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggctggagtggggttggacgtttacaaaagtaaaatgatggtagaagaaatagactacggtgcgacccgtagaaacggaagacttcaaccattctacgaagagataattacaaaacgcggtagtattagacaaatgaaacngacctagaaaccgagacacacgaccgtctattactacgtaaccactagtacgttacggaagtgactagtaccggaacgtaaagggacggtactagttagtacttttaggaattacgtccggttacggggaccccaaggggtaccctaaggtttccgggg

SEQ ID NO: 112922 - DNA, 586 bp, Homo sapiens
  misc_feature: GYAE6OF01DEZ3V.15.86.H09.1.454.CMB.1.raw
  modified_base (400)..(400): a, c, t, g, unknown or other
  misc_feature (400)..(400): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgagggaaggggctgggagtgggttggacgtttacaaaagtaaaatgagtggtagaagaaatagactacggtgacacccgtagaaagganatcacatactacaagagataatacaaaacgcgtagtattgacaatagaacagcctagaaaccgagacacgacgccgtatacttactacgaccacagtattcggaagtgacatacgaacggttaaaggagtcttagtcgtcttttagattacgttcggtacggggaccgaagggactaggttccggg

SEQ ID NO: 112923 - DNA, 633 bp, Homo sapiens
  misc_feature: GYAE6OF01CLZ9I.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgaggggaaggggctgggagtggggttggacgtttacgaaaagtaaaatgaatggtagaagaaaatagaacgtacggtgacacccgtagaaaggaagattacaaccatacctacgaagagaattaacttacaaaaacggtacggttagttatttagactaaatagaaacagacctaacggaaaaccgaggacaacgagcccgtatacttactacgaaccacaagtacttacggaagtcgactactacggaagtaaaggaggtaccttagtgttcttttagattacggttcgtaccggggcccgaagggtacgtaagttccggg

SEQ ID NO: 112924 - DNA, 624 bp, Homo sapiens
  misc_feature: GYAE6OF01CXILY.15.86.H09.1.454.CMB.1.raw
  modified_base (522)..(522): a, c, t, g, unknown or other
  misc_feature (522)..(522): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagttaatggctggatggagttgggtccgccgaggctccgagggaggggctgggagtgggttggacgtttacgaaaagttaaaatgatggtagaagaaaatagactacggtgcgacccgtagaaaggaagtatacaccatactacaagagaattaatacaaaaacggcgtagttatttagactaaagtacgaacacgacctagaaaaccgaggaacctacgagcccgtacttattaacctgtaacccanagtacttacggaagttgactagtaccgaacgtaaaggacggtacttatagtctttttaggattagtcgtacggggacccgaagggtaccgtaagttccgggg

SEQ ID NO: 112925 - DNA, 687 bp, Homo sapiens
  misc_feature: GYAE6OF01A2YAB.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttggtccgcaggctccgagggaggggctggagtgggttggacgtttacaaaagtaaaatgatggtagaagaaaatagactacggtgcacccgtagaaaggagattcacatctacaagagaattaacttacgaaaaacgtacggttagttaatttaggacctaaaagtacgaaacacgaccgtaacggaaaaccggtaggaaccaaccgacgtacccgttacttaacgttaaccttacggtaaccctacgaacggttactttaccgggaagttacggactaagtaccggtaaaacggttaaaaggggaacggtaccgttaagttaggttacctttttaggaatttacggttcgttacggggggaccccaagggggtaacctaagggtttacccggg

SEQ ID NO: 112926 - DNA, 685 bp, Homo sapiens
  misc_feature: GYAE6OF01D8FJ3.15.86.H09.1.454.CMB.1.raw
  modified_base (265)..(265): a, c, t, g, unknown or other
  misc_feature (265)..(265): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctntggattcactttcagtaatggctggatggagttggtccgcaggctccgagggagggctgggagtgggtggacgttacaaaagtaaaatgataggtagaagaaaatagactacggtgacgaccgtagaaaggagacttcaacatactacgaagtagaataattaacgaaaaacggtcggtagttaatttagaactaaaagtagaaacgacgtacccgtaacggaaaaacccggtaggaaccaacgtaacggtcccgttacttaacttaaccgtacgtaacccaacgtaggtaacgttacgggaagtcgaccgtaaagtaccggtaaacgggtaaaagggacgggtacttaaggttcggttacgttttaggaattacgttccgggtacggggaccccaaggggtaacctaaggttcccgggg

SEQ ID NO: 112927 - DNA, 684 bp, Homo sapiens
  misc_feature: GYAE6OF01B8CX1.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtgggggtcccttagagtctcctgtgtggcctcgtggattctactttcagtaatggctggatggagttgggtccgccgaggcctcggaggggaaggggcgtgggaggtgggttggtacgtttacaaaaagtaaaagtgaagtggtagaagtaaaatagaacgtacggcgacgacccggtaggaaaggaagacgttaccaaccgtatactacgaaagaagtaattaaacgttaacgaaaaacggtacggttagttaactttaggaactaaaatacggaaacaggacccgtaaggaaaaccggagaaccacgacgtaccgttactaattaaccgacgtaccaacgtagtaacgttacggaagtcgactagtaccggaaagtaaaggcgtacgtagttacgtcgttttagaagttacgtccgggtacggggaccctaagggtactacggttcggg

SEQ ID NO: 112928 - DNA, 607 bp, Homo sapiens
  misc_feature: GYAE6OF01CP2M0.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgagggaaggggctgggagtgggttggacgtttacaaaagtaaaatgatggtagaagaaaatagactacggtgacacccgtagaaaggaagattacaaccatctacaaagagaataattacaaaaacggtacggtagtaatttagacaaatagaaacagacctaagaaaaccgaggacaacgacgccgtactaattactacgtaaccacgtagattacggaagtgacagtacgaacggtaaaggagtctagttgtcttttagattagtcgtacggggacccagggactaagttcggg

SEQ ID NO: 112929 - DNA, 626 bp, Homo sapiens
  misc_feature: GYAE6OF01DT5QE.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccgccaggctccgagggaaggggcgtgggaggttgggttggacgtttacaaaagtaaaatgaatggtagaagaaaatagaactacggtgcacccgtaggaaaggaagattcacatctacaagagaataattacaaaacgacggtatatttgactaaatagaaacagacctagaaaaccgaggaacacacgtaccgtactaacttactcgtaacccacgagtattacggaagttcgactacgtacgaacggtaaagggacggtacttaagtgttctttttagattaacgttccggtacgggggacccctaaggggacctaagttccggg

SEQ ID NO: 112930 - DNA, 651 bp, Homo sapiens
  misc_feature: GYAE6OF01DFFL0.15.86.H09.1.454.CMB.1.raw
  modified_base (328)..(328): a, c, t, g, unknown or other
  misc_feature (328)..(328): n is a, c, g, or t
  modified_base (417)..(417): a, c, t, g, unknown or other
  misc_feature (417)..(417): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtggggggtcccttagagtctcctgtgtggcctctggattctactttcagtaatggctggatgagttggtccgccaggcctcgagggaaggggctgggngtgggtggacgtttacaaaagtaaaatgatggtagaagaaaatagactaggtgacaccgtagaaaggaagatcaaccatacacaaaganaataattaacaaaaacgtacggttagttaattgactaaatagaaacacgacctaagaaaaccggaggaccaacgacgaccgttacttaattaacctacgtaacccaacgtagtaacgttacgggtaagttcgactacgtaaccggaacggttaaagggacggtacttagttaggtttacttttaggattacggttcggtacgggggtaccccgaagggaccgtaaggttccggg

SEQ ID NO: 112931 - DNA, 569 bp, Homo sapiens
  misc_feature: GYAE6OF01D3GQU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttcaaaagtaaaatgatggtgaagaaatagactacggtgcacccgtgaaaggaagattcaccatctcaagagaataattacaaaaacgacggtagtaatttgacaaatagaacagacctagaaaaccgaggacacagccgtactattactagtaccagtagattcggaagtgacatcgaacgtaaaggaggctatgtctttagatatcgtagggacccagggcaagtcggg

SEQ ID NO: 112932 - DNA, 670 bp, Homo sapiens
  misc_feature: GYAE6OF01DR7TN.15.86.H09.1.454.CMB.1.raw
  modified_base (175)..(176): a, c, t, g, unknown or other
  misc_feature (175)..(176): n is a, c, g, or t
  modified_base (182)..(182): a, c, t, g, unknown or other
  misc_feature (182)..(182): n is a, c, g, or t
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcggtgtcgtcagcgcatagtagtagtcnngtgagngcagtggtggagcgtggaggctcgtagacgtcggtcggtctagtcgtctgtgtgctctgtatctctatnaagtgcgtgagtgtcgtggtcgaccgngcgtccgaggagggcgtgtaggnggttcggtcgttataaagtaaaatagtgtagttaggaagaaaattaacggtactaacggtacgcgtaacccggtaacggaaagggaaaagtacgttactaaccccgaacgtacgttaacaacgaaagtaacgtaaacgtaaacgttaaaacgtaaacggtaacgttaagttaacgttaacgtaacgtaacgtaacgtaacgtaacgtaacgaaacgaaacgaacgaacgaacgtacgtacgtacgttacgtacgtacgtacgtacgtacgtacgtacgtacgtacgtacgtacgtacgtaacggtaaggtacgtagtacgttcgttacgttagtacgtcggtacggtacggacggtacgtacggtacgg

SEQ ID NO: 112933 - DNA, 801 bp, Homo sapiens
  misc_feature: GYAE6OF01DUJV5.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttctgctgctatactaaaggtgtccagtgtgaagtgcgaggtggtggagtcgtggggagccgttaggtaaagccggtgggggtcccttagacgtctcgtgtgtcggcctgtggattcactttcgagtaagtggctggattggaggttcgggccgaccgaggcctaccggaaggggaaggggtcgtagggtaggttggggttaggtaacgtttaacgaaaaaaggttaaaaagtcggaagttagggtaagtaaaacgaaaaagtacggtaacgtaacggtcgaccgtaaccggtaagaaaaggactacttaccgaacctagtacctaacgaaagtaacgtaattaaacgttaacgaaaaacggtcggttagttaagtttacgaaaccgtaaaagttacgaaacgtaacgtaacccgaacggaaaaacccggacgaaacctaaccgacggtacccgttacttaacgttaccgtaccgtaaccgaacgttaaggtacgtttaacgggaaacgttacgacccgtaaaggttacccgtaaaacgggtaaaagggtaccggtacctttaaggtccggtttacgtttttaaggaacctttcggtacccggggtaccgggaaccccgtaacgggtaaacgttagggttacccggg

SEQ ID NO: 112934 - DNA, 697 bp, Homo sapiens
  misc_feature: GYAE6OF01DQMVP.15.86.H09.1.454.CMB.1.raw
  modified_base (524)..(524): a, c, t, g, unknown or other
  misc_feature (524)..(524): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtgcctctggattcactttcagtaatggctggatggtagttgggtcccgccgaggcctccgaggggaaggggcgtggaggttggggttggtacgttttacaaaaggtaaaaagtgaagtgggtagaagaaaacgtagaacgtacggtgaccgaacccggtaggaaaaggaagtaatccgaaccatctacaaagagtaactaattaacgaaaaacggacggttagttaatttgaactaaataggaaacaggtacctaaggaaaacccgngaacaacgacgtaccgttactaattaccgtacgtaaccacgaagttacgttacgggaagtacgcgtaaacgtccggtaaacggtaaaggtaggtacctttaagttggttcgttttagaacgtttacgtaccgggttacggggaccccgtaaggggttaacaacggtttcgggg

SEQ ID NO: 112935 - DNA, 672 bp, Homo sapiens
  misc_feature: GYAE6OF01E5F56.15.86.H09.1.454.CMB.1.raw
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaggggcgtggaggtgggttggacgtttacaaaagtaaaatgagtggtagaagaaaatagactacggtgcacccgtagaaaggaagattacacatcanaagagataattacaaaacgnggtagtatttgactaaagtgaacagaccgtaagaaaacccgaggaaccacgacgtacccgtactaactttacctacgtaacccacgtaaggtacgtttacgggaagttcgaccgtaagttaccgggaaaccggttaaaaggggacgggtactttaagttcgggttaccgttttttaggaactttacggttaccgggttaccgggggtaaccccaagggggtaacctaaagggtttccgggg

SEQ ID NO: 112936 - DNA, 186 bp, Homo sapiens
  misc_feature: GYAE6OF01AEZLH.15.86.H09.1.454.CMB.1.raw
  modified_base (168)..(186): a, c, t, g, unknown or other
  misc_feature (168)..(186): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgggctggcaaggcgcatagnnnnnnnnnnnnnnnnnnn

SEQ ID NO: 112937 - DNA, 712 bp, Homo sapiens
  misc_feature: GYAE6OF01DF2DX.15.86.H09.1.454.CMB.1.raw
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (194)..(194): a, c, t, g, unknown or other
  misc_feature (194)..(194): n is a, c, g, or t
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcggtgttcgtgagcgctatagtaagtgtcagtgnagtgngngtgtgngtgtggngcgtagtagcggtcggtcgtagngtcgtcgtgtgtcgtcgtcgtgtactctacttacgtagtagtgtcgtgtagtgtggtcggtccgacgacgtacgtacggagggtagggtcgtggtaggtggttacggtaacgttaaacgtaaaagtaaagtaagtaggtaggtagtaagtaaagtaagtacgtacggtacgtacgtaacgtaacggtaaacgtaacgtaactacgacgtaacgtactaacgtaagtaagtaacgtaaacgtaaacgtaaacgtaacgtagtacgtaacgtaacgtaaagtaacgtaacgtaacgtaacgtaacgaaacgaacgaacgacgtaaccgtaccgtacgtaacgttaaccgtaacgtaaccgtaacgtaacgtaagtaacgtaacgtacgtacgtaacgtaacggtaaacggtaaaggtaacgtacgttacgttacgttacgttacgttagtacgtacggtaccggtacggtaacggtacggtacggttcgg

SEQ ID NO: 112938 - DNA, 568 bp, Homo sapiens
  misc_feature: GYAE6OF01ECILS.15.86.H09.1.454.CMB.1.raw
  modified_base (521)..(521): a, c, t, g, unknown or other
  misc_feature (521)..(521): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccagggaggggctggagtgggttggacgtttcaaaagtaaaatgatggtgagaaaatagactacggtgcacccgtagaaaggaagattcacatctcaagagataatacaaaacgacggtagtatttgacaaatagaacagacctagaaaaccgaggacacagccgtactattactgtaccacagtattcgggaatgacatacggacgtaaaggnggactatgtcttttagattagtcgtaggggcccagggacaagtcggg

SEQ ID NO: 112939 - DNA, 582 bp, Homo sapiens
  misc_feature: GYAE6OF01C62LP.15.86.H09.1.454.CMB.1.raw
  modified_base (501)..(501): a, c, t, g, unknown or other
  misc_feature (501)..(501): n is a, c, g, or t
tcagtctacgtagccacgaccggtgctcgatttagtgctatagacttgggtttggggggagaggagccccagtcttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtgggttggacgtttacaaaagtaaaatgatggtgaagaaaatagactacggtgacacccgtagaaaggaagattcaccatctacaagagataattacaaaacgtcggtagttatttagactaaatgaaacagacctagaaaaccgaggacacagcctactattactgtaccanagattcggaagtgacagtcgaacggtaaaggacggtctatgtcttttagattagtcgtaggggcccaagggactagtcggg

SEQ ID NO: 112940 - DNA, 707 bp, Homo sapiens
  misc_feature: GYAE6OF01EKXUH.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaaggggctgggagtggggtggtacgtttacaaaagtaaaatgagtggtagaagaaaatagactacggtgcacccgtagaaaggagatcacatctacaagagaataattacgaaaaacgtacggtagttaatttagactaaagtacgaaacagaccctaacggaaaacccgagggaaccaacgaacgtacccggttacttaacgtttaacctacgtaaccccaacgtaaggtaacgtttacgggaacgttacgaccgtaacgttaccggaaaccgggttaaaaggggaacggtaccgttaaagttcgggttaaccttttttaggaaacgtttacggttacccggtttacggggggacccccgtaaagggggtaacccgttaaagggttccgggg

SEQ ID NO: 112941 - DNA, 795 bp, Homo sapiens
  misc_feature: GYAE6OF01BC9PL.15.86.H09.1.454.CMB.1.raw
tcagtctacgtagccacgaccggtgctcgatttagtgctatagacttggggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgtaggtggtggagtcgtggggagccgttaggtaaagccgtgggggtcccttagagtctcctgtgtggcctcgtggtattctactttcgtagttaatcggctaggatggaggttcgggtccgccgtaggccgtccgaggggaacggggtctgggagtgggttggaacgtttacgaaaagtaaaatgagtggtacgaagtaaaagtagaacgttacggtagaccgaacccggtaaggaaaggaagtacgttaccaaccgaattcctacgaaaggacgtaattaaacttaaccgtaaaaacggtcggttagtttaacgtttaggacctaaaagtcggaaaaccgtacgtaacccgttaaggaaaaacccggaggtaaccgaacgtaacggtccccgttaacttaacgtttaaccgtacgtaacccgtaacgtaacggtacgtttaaccgggaaagttcggtaccgtaacgttaccggaaacggttaaaacgggacgggtaccttacggttgggtttaaccgtttttaggaacgtttacggttacccgggttaccgggggaccccgttaagggggaaccttaaacgggttcggggtttaaccccgg

SEQ ID NO: 112942 - DNA, 652 bp, Homo sapiens
  misc_feature: GYAE6OF01DWDXM.15.86.H09.1.454.CMB.1.raw
  modified_base (380)..(380): a, c, t, g, unknown or other
  misc_feature (380)..(380): n is a, c, g, or t
  modified_base (573)..(573): a, c, t, g, unknown or other
  misc_feature (573)..(573): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggtattcactttcagtaatggctggatgagttggtccgcaggctccgagggagggctgggaggtgggttggacgtttacaaaagtaaaatgatggtagagaaaatgactacggtncgaccgtagaaaggagattcacatctacaagagaataattacgaaaacgtcggtagtatttagactaaatcgaaacagtacctaagaaaacccgaggaaccacgacgtacccgttactaattaacctaggtaaccctaagaagtaacgttacgggaaagtcgaacctaagtaccggtaaacggtaaaaggggnggtacttaagttcggtactttttagactttaacgtccggttacgggggacccctaaggggtacctaaggtttaccgggg

SEQ ID NO: 112943 - DNA, 798 bp, Homo sapiens
  misc_feature: GYAE6OF01A8RFC.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcacttcagtaatggctggatgtaggttggtccgcgaggctccgagggaaggggcgtggaggtgggttggtacgtttacaaaagtaaaagtgagtggtagaagtaaaagtagacgtacggtgaccgaaccgtagaaaggaagtacttaccaacctatactacgaaagaagtaattaaacgttaacgaaaaaacggtaccggtttagttaacgttttacgaaacctaaaagtacgaaaccgtaacggtacccgttaaacggaaaaacccggtaacggaaacccaaccgaacggtaccccgttaacttaacgtttaacccgtaccgttaaaccccgtaacgtaacggttaacgtttaaccggggaaagttacggaaccgtaaacgttaacccgggaaaaccgggttaaaaaggggacgggttactttaaggttcgggtttaaccgttttttaggaaacgtttaacggtttacccgggtaccggggggtaacccccgtaaacgggggtaaaccgttaaagggtttcccgggg

SEQ ID NO: 112944 - DNA, 576 bp, Homo sapiens
  misc_feature: GYAE6OF01BYMXN.15.86.H09.1.454.CMB.1.raw
  modified_base (151)..(151): a, c, t, g, unknown or other
  misc_feature (151)..(151): n is a, c, g, or t
  modified_base (395)..(395): a, c, t, g, unknown or other
  misc_feature (395)..(395): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (482)..(482): a, c, t, g, unknown or other
  misc_feature (482)..(482): n is a, c, g, or t
  modified_base (528)..(528): a, c, t, g, unknown or other
  misc_feature (528)..(528): n is a, c, g, or t
  modified_base (544)..(544): a, c, t, g, unknown or other
  misc_feature (544)..(544): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgnggtttcgtgagtgctatacgtaaaggtgtcagtgtgaagtgcaggtggtggagtctgggggagccttggtaaaagcctggggggtcccttagagtctcctgtgtggctctggattcactttcagtaatggctggatgagttggtccgaccaggctccaggggagggctggagtgggttggacgtttcaaaaggtaaaatgaatggtagaagaaaatcgaatacggtgcacccggtgaaaagganattcaacatctacaagagataattcaaaaagacgttgagtttagactaaatgaaanancccgtagaaaaccgaggacacgagccgtntaatactagtaccactagattacgaagtgcagtcgaacgtaaaggngacgttatggtctttnatatcggtcgggacccaggaccgaagttcggg

SEQ ID NO: 112945 - DNA, 750 bp, Homo sapiens
  misc_feature: GYAE6OF01BSMUN.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctctgtgtggcctcgtggattctactttcagttaagtggctggatcggtaggttcgggtccgccgtaggccgtccggaggggtaacggggcgtgggtaggttggggttggtaacggttttaacgaaaaaggttaaaaagtgaagttagggtagaaagtaaaagtagacgtaacggtacgaccgaacccggtaggaaaagggaagtacttaccgaacctacgtctaacgaaacgaagtaacttaaacgtaacccgaaaaaggtccggttaagtttaacgtttagaactaaaagtacgaaactacgacccgtaaacggaaaaccggtagaacccaacgtacgacccgttactaacgtttaccgtacgtaacccagtaacgtacgttacggtaagacgtactaacgtaccggaaaggtaaacgggaggtccttaaggtcgttccgttttagacgtttacgtaccgggtcggggaacccctaaggggtaaccgtaaggtttcccggg

SEQ ID NO: 112946 - DNA, 648 bp, Homo sapiens
  misc_feature: GYAE6OF01EPOA8.15.86.H09.1.454.CMB.1.raw
  modified_base (420)..(420): a, c, t, g, unknown or other
  misc_feature (420)..(420): n is a, c, g, or t
  modified_base (488)..(488): a, c, t, g, unknown or other
  misc_feature (488)..(488): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggcctccgaggggaaggggcgtgggaggtgggttggacgtttacaaaagtaaaatgatggtagaagaaaatagacgtacggtgacaccgtagaaaggagatcacatctacaaganaataatacgaaaaacgtacggtagtatttagactaaaagtcgaaacagaccctaaggaaaaacccggnggaaccacgaacgtacccgttactaacttaaccgtacgtaacccaagtaagtaacgtttacggaagtcgaacaagtacggtaaacggtaaaaggcggtacttagtggtctttttaggaattacgtcggtacggggacccgtaaggggaactaaggtcggg

SEQ ID NO: 112947 - DNA, 685 bp, Homo sapiens
  misc_feature: GYAE6OF01E1EB4.15.86.H09.1.454.CMB.1.raw
  modified_base (345)..(345): a, c, t, g, unknown or other
  misc_feature (345)..(345): n is a, c, g, or t
  modified_base (382)..(382): a, c, t, g, unknown or other
  misc_feature (382)..(382): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaagccgtgggggtcccttagagtctcctgtgtggcctcgtggattcactttcagtaatggctggatgagttgggtccgccaggctccgaggggagggcgtgggagtgggtggacgttanaaaagtaaatgatggtagaagaaaatagacgtacggngaccaacccggtagaaaggaagtacttaccacctatcctacgaaagaagtaattaaacttaaccaaaaacggtacggttagttaagtttagaactaaaagtacgaacaacgaccgtaaggaaaacccgaggaaccaacgacgtacccgttattaacttaccgtacgtaaccccaagtaggtaacgttacgggaagttcgactaagtaccggaaacggtaaaagggacggtacttaagtcggttccttttaggaactttacgtccggtacgggggaacccctaaggggaacctaaggttcgggg

SEQ ID NO: 112948 - DNA, 631 bp, Homo sapiens
  misc_feature: GYAE6OF01DDA7X.15.86.H09.1.454.CMB.1.raw
  modified_base (418)..(418): a, c, t, g, unknown or other
  misc_feature (418)..(418): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctcgtggattcactttcagtatggctggatgagttgggtccgccaggctccgagggaaggggctgggagtgggttggacgtttacaaaagtaaatgatggtagaagaaatagactacggtgacgacccgtagaaaggaagacttcaccatctacaaganattaatacaaaacgtcgtagttattgactaaatgaaacagacctaaggaaaacccgaggaaccacacgcccttactaattactacgtaacccacagtacgtttaccggaagtcggactaacgtaccggaaacggttaaaggacggtacttagttcggttacgtttttagaattacgttacggtacggggccctaaaggggcctaaggttcggg

SEQ ID NO: 112949 - DNA, 572 bp, Homo sapiens
  misc_feature: GYAE6OF01DACYI.15.86.H09.1.454.CMB.1.raw
  modified_base (536)..(536): a, c, t, g, unknown or other
  misc_feature (536)..(536): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtcgccaggctccagggaaggggctggagtgggttggacgtttacaaaagtaaaaatgatggtagagaaaatagactaacggtgcacccgtgaaaggaagattcaccatctcaagagataatacaaaaacgacggtagtatttgacaaaatgaaacagacctagaaaaccgaggaacacagccgtactattactagtaccacagacttcggaagtgacagtcgaacgtaaaggaggctangtctttgattatcgtgggaccctagggacaagtcgg

SEQ ID NO: 112950 - DNA, 687 bp, Homo sapiens
  misc_feature: GYAE6OF01CXT61.15.86.H09.1.454.CMB.1.raw
  modified_base (519)..(519): a, c, t, g, unknown or other
  misc_feature (519)..(519): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgagtgcaggtggtggagtcgtggggagccgttggtaaagccgtgggggtcccttagagtctcctgtgtggcctctggattctactttcagttaatggctggatgagttggtccgccaggctccgagggaggggctgggagtgggttgacgtttacgaaaagtaaaatgatggtagaagtaaaatagaacgtacggtagtacgaacccggtagaaaacggaagacttaccgaacctatacctacgaaagaagaattaaacgttaacgaaaaacggtcggttagttaagtttagaactaaaagttagaaactagacccgtaaggaaaaacccgnggaaaccaccgaacggtaccctactaacgtttaacctagttaaccccaagagtaagtttaccgggaaggttgtaacaacggttacgaaaccggttaaagggacggtctaagttggttctttttaggattacgtcggtacggggaccctaaggggacctaaggttcggg

SEQ ID NO: 112951 - DNA, 653 bp, Homo sapiens
  misc_feature: GYAE6OF01EEJWG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtggtttcgtgacgtgctatacgtaaaggtgtcagtgtgaagtgcaggtggtggagtcgtggggagccttggtaaagccgtggggggtcccttagagtctcctgtgtggcctctggattcactttcagtaatggctggatgagttggtccgccaggctccgagggagggctgggaggtgggtggacgtttacaaaaggtaaaatgaatggtagaagaaatagactacggtgcaccgtagaaaggaagtattacacctatctacgaaagtagtaataaacttacgaaaaacgtcggtattaatttacgataaatagaactacgacctaaacggaaaaccgacggaacaacgacgtaccgtactaattaaccgtagtaacccgagtaagtacgtttacggaagtgactaagtacgtaacggtaaacggaggacttaagttggtacgttttaggacgttaacgttccggtaaccggggaccccgaagggtacctaaaggtttcggg

SEQ ID NO: 112952 - DNA, 689 bp, Homo sapiens
  misc_feature: GYAE6OF01C25Y4.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaagccgtgggggtcctagagtctctgtgtggcctctggattctactttcagtaatggctggatgaggttcggtccgcgaggctccggaaggggagggcgtgggaggtgggttgtacgtttaagaaaaagtaaaatgagtaggtagaaagaaatagacgtaacggtgaccgaaccggtaggaaaggaagtacttcaactatactaacgaaagtaagtaattaaagtaacgaaaaacggtaggttagttaacgttagaactaaaagtcgtaaacgagtaccctaaaggaaaacccgaggaaccaacgacgaccgttactaacgtttaccgacgtaaccccaagtacgtaagtttaccggaaagttcgaaccctaaggttaccgggaaacggtaaagggacggtaccgtagttcggttacttttaggattaaccggtcggtacgggacccgaagggaccttaaggtcgg

SEQ ID NO: 112953 - DNA, 782 bp, Homo sapiens
  misc_feature: GYAE6OF01D6IS4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttggtaaagcccgtggggggtacccctttaggacgtccgtccgtggtgtcgggcccttcgtggtatttcgtactttcagttaatggctaggatggtaggttcgggtcccgccgaggcctccggaaggggtaacgggggcgtgggaggttggggttagggtaaccggttttaacgaaaaaggtaaaaagtgaagttagggtagaaagtaaaagtaggtaacgtaacggtgaccgtaacccggtaaggaaaaggaacgtaacttaccgaaccctacgtacgtaacgaaagtaagtaacttaaaacgttaaccgaaaaaacgggtcgggttaagttaacgttttaaggaacttaaaaacgtgaaaacccgtacggtaaccccgttaaggaaaaaacccggtacgggaaacccgaaccgaccggtacccgttaactttaactttaacccggtacgtaacccagtaagtacgttacggaagtcgactagtacggaaagtaaaggcgtacttatcgttcgtttagaacttacgtacggtacggggacccaagggtataacgggtcgg

SEQ ID NO: 112954 - DNA, 657 bp, Homo sapiens
  misc_feature: GYAE6OF01C70US.15.86.H09.1.454.CMB.1.raw
  modified_base (414)..(414): a, c, t, g, unknown or other
  misc_feature (414)..(414): n is a, c, g, or t
  modified_base (512)..(512): a, c, t, g, unknown or other
  misc_feature (512)..(512): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcggctgagctgggttttccttgctgctatcttaaaaggtgtccagtgtgaagtgcaggtggtggagtcgtgggggagccttggtaaagccgtgggggtccctagagtctccgtgtgtggcctcgtggattctactttcaagtagtggctggtatgagttgggtcccgcaggctccgaggggaagggcgtgggaggtgggttaggaacgtttacgaaaaagtaaaagtgagtaggtagaagaaaagtgacgtacgtgacaacccggtagaaaggaanacgttacaacctatactacgaacgtagtaattaaactaacgaaaacgtacggttagttagtttagaactaaagtagaaacagacctaaggaaaaccgngaacacgaacgtccgtacttaattaccgtacgtaaccacgtaagagttaccggaagtcgactaacgtacgaaaggtaaaggacgggtacttagttggttactttagaattacgtcggtacggggaccaacgggataggttaccgg

SEQ ID NO: 112955 - DNA, 842 bp, Homo sapiens
  misc_feature: GYAE6OF01DT7TR.15.86.H09.1.454.CMB.1.raw
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagctgggttttccttgctgctatcttaaaaggtgtccagtgtgaagtgcgaggtgggtggaggtcgtgggggagccgttagggtaaaggccggtgggggggtccccttaggacgttccttccgtggttggtcggcccttcgtgggtactttcctaaccttttccgaagttaagtgggcgtagggagtggtaggttcggggtcccgccgacgggtccgtcccggaaggggggtaacgggggtcgtaggggtaagggttcgggggtttagggtaaccggttttaaacgaaaaaaggttaaaaaagttggtaagtagggtagaaaaggtaaaaagttaggtaaccgttaacggtacgaacccgtaacccggtaaggaaaaacggtaagtaacttaccgaaccctaataccgtaacgaagtaacgtaattaaaacgttaacgaaaaacggtacggtttagttaacgtttagaaactaaaagtacgaaacgtaccgaaccgtaaaggaaaaacccgacggaaccaaccgtaccgtaccgttaacctaagtttaacccgtacgtaaccccaagtaacggttaagttaccggtaaaggttccggaactaacgggtaccgaaagggttaaacggacggttacctagttcgtttactttaggaattacggtcggtacgggacccggaagggtactaggttccggg

SEQ ID NO: 112956 - DNA, 753 bp, Homo sapiens
  misc_feature: GYAE6OF01BECUN.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagccgttggtaaagccgtggggggtcccttagagtctcctgtgtggcctctggattcactttcagtaatggctggatgagttgggtccgccgaggctccgagggaagggggcgtgggaggtgggttaggacggtttacaaaaggtaaaaatggaagtggtagaagaaaataggacgtaacggtgaccgaacccggtaggaaaaggaagacttacacctatactacaaagagtaataacttaacaaaaacggtacggttagttaacgttttagaaactaaaatacggaaaacctaggtaaccccgttaaaggaaaaacccggagggaaacccaaccgtaacggtacccgttaccgtaaagtttacccgtaacggttaaacccaacgtaacggtaacggtttaccgggaaaggttcgaaccgtaacgtaccgggaaacgggttaaaacgggacgggtacttaagttacggttactttttaggaatttacggttccggtacggggtaccccggaaggggtaacctaagggttacccgggg

SEQ ID NO: 112957 - DNA, 890 bp, Homo sapiens
  misc_feature: GYAE6OF01C2JLJ.15.86.H09.1.454.CMB.1.raw
  modified_base (162)..(162): a, c, t, g, unknown or other
  misc_feature (162)..(162): n is a, c, g, or t
  modified_base (178)..(178): a, c, t, g, unknown or other
  misc_feature (178)..(178): n is a, c, g, or t
  modified_base (189)..(189): a, c, t, g, unknown or other
  misc_feature (189)..(189): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (318)..(318): a, c, t, g, unknown or other
  misc_feature (318)..(318): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtggtttcgtcgagngctataaagtagtctngtgagagcagnggtgaggcgtgggagggctcggttaaaggacgtcgggtcgggttacctaggtctcctgtgtggtcgctgngtctacttntanaaagtagttcggngtagtgtggtcggtcgccagcgcgaggagggcgngtggtagtggtacgtaataaaagaaaatagtagtagtaggaaagaaaagtaacgtacggtacggtacggaccaaaccggtaacgggaaaaggaaaagtacgttaaccgtaaccctaaacgtacgttaaaccgtaaaggtaaaagtaaaaccgttaaaacgttaaaaccggtaaaaaacgggtaaacggtttaggtttaacgtttaacggtaaaacgtaaaaacggtaaaacgtaaaccgtaaaccggtaaaccggtaaaccggtaaaaacccgggtaaaaaccgggtaaaaccggtaaaccggtaaaccggtaaacccggttaaccgtttaaaccgtttaaacgttaaacccgttaaacccgtaaacccgtaaaccggtaaacggttaaacggttaaacggttaacggtaacggtaaccgtaacgggtaaaaccgggtaaaaccgggtaaaacgggtaaacggttaacgttaacgtttaacggtttaacggtttaacggttaacggttaacggttaaccggggtaacccgggtaaccgggtaaaccgggtaaaccggtaacgggttaccggg

SEQ ID NO: 112958 - DNA, 592 bp, Homo sapiens
  misc_feature: GYAE6OF01BXU1K.15.86.H09.1.454.CMB.1.raw
  modified_base (379)..(379): a, c, t, g, unknown or other
  misc_feature (379)..(379): n is a, c, g, or t
  modified_base (463)..(463): a, c, t, g, unknown or other
  misc_feature (463)..(463): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagcctgggggtcccttagagtctcctgtgtggcctctggattcactttcagtaatggctggatgagttgggtccgccaggctccgagggaagggcgtggaggtgggttggacgtttacaaaagtaaaatgatggtagagaaaatagactacggtncaccgtagaaaggagattacacatctacaagagataatacaaaacgtcggtagtattagactaaatgaacagcctagaaaccgnggacagagtcctactattactacgtaccactagattcggaatgacctaagtacgaacggtaaaggcggtactagtcgtcgttttagaattacgtacggtcggggaccctaaggggtactaaggttcggg

SEQ ID NO: 112959 - DNA, 650 bp, Homo sapiens
  misc_feature: GYAE6OF01CN6QF.15.86.H09.1.454.CMB.1.raw
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtgttcgtcagtcgctatagtaagntcngtgtgagtncngngtgngtntggngctgtaagcgtgggtctgngtctctgtgtggctctggatctcttntagtaatgntggngtgtagtcggtcgcgcgcgcgaggaggngtggtggtggtaggtacgttaagtaaagtaaagtagtagtaggtagaaagtaaagtaagtacgtacgtacgtacgtacgtaacgaaagtaacgtacgtactacgtactactaacgaagtaagtaataactaaacgtaaacgtaacggttaacgttaagttagtaataacgtaacgtaacgtacgtacgtaacgaacgaacgtacgacgtacgtactacgttactaacgtacgtacgtacgtagtagtacggtacgtacgtacgtacggtacggtaacggtaaggtaacggtacgttagttacgttcgttacgttacgttacggtaccggtaccggtaccggtacggtacggtacggtaccgg

SEQ ID NO: 112960 - DNA, 607 bp, Homo sapiens
  misc_feature: GYAE6OF01BC2BK.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccgcaggctccagggaggggctggagtgggtggacgtttacaaaagtaaaatgatggtgagaaatagactacggtgacacccgtagaaagagattcaccatctacaagagaataattacaaaacgtacggtagttatttgactaaatagaacagacctaaggaaaacccgaggacaacacgacctactaattactacgtaacccacgtagtacttcggaagtcgacagtacggaaacggtaaagggacggcttaagtcgtcttttaggattacgttcgtacgggggaccccaggggactaaggttcggg

SEQ ID NO: 112961 - DNA, 613 bp, Homo sapiens
  misc_feature: GYAE6OF01A06BL.15.86.H09.1.454.CMB.1.raw
  modified_base (406)..(406): a, c, t, g, unknown or other
  misc_feature (406)..(406): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtatggctggatgagttgggtccgccaggctccgaggggaggggctgggaggtgggttggacgtttacgaaaagtaaaatgagtagggtagaagaaaatagacgtacggtgacaccgtagaaagganatcacatcacaagagataatacaaaacgtcgtagtattgacaatacgaactgacctaaggaaacgcgaacacacgccgtatactactacgaccacgtagtaacgttacggaagttcgaactacgtacggtaaacggtaaagaggtaccttaggtcgttcgttttagacttacgtacgggttacgggacctagggactaggttccggg

SEQ ID NO: 112962 - DNA, 620 bp, Homo sapiens
  misc_feature: GYAE6OF01DP809.15.86.H09.1.454.CMB.1.raw
  modified_base (338)..(338): a, c, t, g, unknown or other
  misc_feature (338)..(338): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctctgtgtggcctctggattcactttcagtaatggctggatgagttggtccgcaggctcgagggagggctggagtgggtgacgtttanaaaagtaaaatgagtggtagaagaaaatagacgtacggtgacaccggtagaaaggagatcaacatactacaagagaataattaacgaaaaacgtacggttagttaagtttagaactaaaatagaaacacgacctaaggaaaacccgagaaccaacgacgtccgtataacttactagtacccataagtacttacggaagngacaagtacggaaacggtaaagggcgtactagtgtcttttagattacgtcgggtacggggacccgagggaacctaaggttcgg

SEQ ID NO: 112963 - DNA, 668 bp, Homo sapiens
  misc_feature: GYAE6OF01A3MOS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaagccgtgggggtcccttagagtctcctgtgtggcctcgtggattcactttcagtaagtggctggatgtaggttcgggtccgccgacggcctccggaggggaaggggcgtgggaggtggggttggtacgtttacgaaaaagtaaaatgagtggtagaagaaaatagacgtacggtgacaccgtagaaagagatacacatactacgaagagtaataacttacgaaaaacgtcggttattaagtttagaactaaaagtcgaaaacaggtaccctaaggaaaacccgaggaaccacgacgtaccgtactagttactagtaacccatagtagttacggaagtcgactaacgtacggaaacggttaaagggcggttactaagtcggttacttttagacgttaacgttccgggacgggggaaccccaaggggtaacctagggttccggg

SEQ ID NO: 112964 - DNA, 722 bp, Homo sapiens
  misc_feature: GYAE6OF01B18D8.15.86.H09.1.454.CMB.1.raw
  modified_base (654)..(654): a, c, t, g, unknown or other
  misc_feature (654)..(654): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcttgggttttccttgctgctatcttaaaaggtgtccagtgtgaagtgcgaggtggtggagtcgtgggggagccgttagggtaaagccgtgggggtcccttagacgtctctgtgtcggcctctggattctactttcagtaatggctggatggtaggttcgggtccgccgaggccgtaccggaagggggaacgggtcgtgggtaggttggggttaggtaacgtttaacgaaaaaggtaaaaatgagtagggtaagaagtaaaataggaacgtacggtagaccgtaaccggtaagaaaacggaagtaacttacaacctatactacgaaagaacgtaattaaacgtaacgaaaaacggtacggttaagttaacgtttagaaactaaagtagaaaccacgtaacccgtaaagaaaacccgggagtaaccaacgaccgtaccgttactaacgtttacctacggtaaccaacgtagtaagttacggaattgactaagtaccggaaggtaaaggnggtcttaaggtctttcggtttagaacttacggtccggtacggggaccctaagggaacgtaggttcggg

SEQ ID NO: 112965 - DNA, 613 bp, Homo sapiens
  misc_feature: GYAE6OF01EEZCB.15.86.H09.1.454.CMB.1.raw
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgagggaggggctgggaggtgggttggacgtttacaaaagtaaaatgagtggtagaagaaatagacgtacggtgcaccgtagaaaggagattcacatctacaagagaataattacaaaaacgtacggtagttaatttagacaaagtgaaacagacctaagaaaaccgaaggaaccaacgacgacccgtactaattactagtaacccaacagtaacttcgggaatgactatacggaacgtaaagggacgacttagtgtctttagattacgtcggtacgggacccagggtaccaagttccggg

SEQ ID NO: 112966 - DNA, 719 bp, Homo sapiens
  misc_feature: GYAE6OF01EZUNE.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttggtaaagccgtgggggtcccttagagtctcctgtgtggcctctggattcactttcagtaatggctggatgaggttgggtcccgccgaggctccgaggggaggggcgtgggaggtgggttggtacgtttacgaaaagtaaaatgagtggtagaagaaaatagacgtacggtgacacccggtagaaaggaagtatacacctatctacaagagaataattacgaaaaacggtacggttagttaagtttagaactaaaagtacgaaacgaacgacccgtaacggaaaacccggaggaaccaacgacgtacccgttacttaacgtttaccgtacgtaaccctaacgtaaggttaacgtttacgggaaagttcggacctaacgttaaccggtaaacgggtaaaagggacggttacttaaggttcggttacttttttaggaacgtttacgttacccgggttccgggggaaccccgtaaggggtaaaccgtaagggttccgggg

SEQ ID NO: 112967 - DNA, 578 bp, Homo sapiens
  misc_feature: GYAE6OF01DD27F.15.86.H09.1.454.CMB.1.raw
  modified_base (516)..(516): a, c, t, g, unknown or other
  misc_feature (516)..(516): n is a, c, g, or t
tcagtctacgtagccacgaccggtgctcgatttagtgctatagacttgggtttgggggggagaggagccccagccttgggatccccaagtgttttcattcagtgatcaggactgaacacagaggaatcaccatggagttcgggctgagctgggttttccttgctgctatcttaaaaggtgtccagtgtgaagtgcaggtggtggagtcgtggggggagccgttggtaaacgccgtggggggtcccttagagttctcctgtgtggcctcgtggattcactttcagtaatggctggatgagttgggtccgccaggctccgaggggaagggggctgggagtgggttggacgtttacaaaagtaaaatgatggtgaagaaaatagactaggtgcaacccgtagaaaggaatattcaccatcacaagagaattaatacaaaacgcgttagtattagacaaatagaaacagacctaggaaaacccgagacacagccgtatatactgtaccagagatacggangacatcgaagtaaggagctatggtcttttgattagtcgtcgggacccagggactaagtcggg

SEQ ID NO: 112968 - DNA, 824 bp, Homo sapiens
  misc_feature: GYAE6OF01AUX39.15.86.H09.1.454.CMB.1.raw
  modified_base (625)..(625): a, c, t, g, unknown or other
  misc_feature (625)..(625): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgtgacgtcgctatacgtaaagtgtcagtgtgagtgcgaggtggtggagtcgtgggggagtccgttagggtaacggtccggttcggggggttacccttaggacgttcctccgtggtggtcggcctcgtggtattcctacttttcgaagttaatgggctggattggacggtttcgggtcccgacgaggccgtaccggagggggagggcgtgggtaggtgggttagtaaccgtttaagaaaaaggttaaaatggaagtgggtaagaaacgtaaaagtacgtaaccgttacggacgaccgtaacccgggtaaggaaaacgggtagtaacttaccaaccctaattacccgtaacgaaaaggaagttaaacttaaacgttaaacccggaaaaaacgggttcgggtttaagtttaagtttaacgaaccgtaaaagtaacgaaaccgtaaccggaacccgtaaagggaaaaacccgngaaaccaacgtaccgtaacccgttacttaactaccgttacctaaaccgacgtaaggttacgttaaccgggaataggacccaaggttaaacccggaaagggttaacgggacgttcgttaagttggtttacgttttagaaaccggttttcgtaacgggttcccgggggaaaccctaggggtaaacctggggtttacccggg

SEQ ID NO: 112969 - DNA, 731 bp, Homo sapiens
  misc_feature: GYAE6OF01EORFG.15.86.H09.1.454.CMB.1.raw
  modified_base (723)..(723): a, c, t, g, unknown or other
  misc_feature (723)..(723): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttagggtaaagccgtgggggtcccttagacgtctccgtgtgtcggcctcgtggtattctacttttcgagttaatggcgtggatggtaggttcgggtccgcgacggcgtaccggaaggggaggggtcgtgggtaggtggggttacggtaacgtttaacgaaaaagtaaaagtgtaagtaggtaagaaagtaaaagtagaacgttacggtcgaccgacccggtaaggaaaggaacgtattaccgaactatacctacgaaagagtaataaacgttaacgaaaaacggtacggttagttaacgttagaaactaaagtaagaaacgtacgaaccgtaaacgaaaaccggaacgaccaaccgtacggtaccttaacgtactttaaccgtacgtaacccagtaacgtagttacggaagtacgaacgtacgtacggtaaaaccggtaaaggacggttactagttcgttacgtttagtagttacgtcggtacgggacccgagggtaacnggttccgg

SEQ ID NO: 112970 - DNA, 596 bp, Homo sapiens
  misc_feature: GYAE6OF01COE11.15.86.H09.1.454.CMB.1.raw
  modified_base (414)..(414): a, c, t, g, unknown or other
  misc_feature (414)..(414): n is a, c, g, or t
  modified_base (434)..(434): a, c, t, g, unknown or other
  misc_feature (434)..(434): n is a, c, g, or t
  modified_base (484)..(484): a, c, t, g, unknown or other
  misc_feature (484)..(484): n is a, c, g, or t
  modified_base (554)..(554): a, c, t, g, unknown or other
  misc_feature (554)..(554): n is a, c, g, or t
  modified_base (586)..(586): a, c, t, g, unknown or other
  misc_feature (586)..(586): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttaggtaaagccgtgggggtcccttagagtctctgtgtggcctctggattctactttcagtaatggctggatggtagttcgggtccgccgaggctaccggaggggaaggggctgggaggtgggttaggacgtttacgaaaaagtaaaatgatggtagaagaaaatagactacggcgacaccgtagaaaggaanactacacctatctagaaganataatacaaaacgtcgtagtattagactaaatgaacagactaagaaacgngaacacacgtgtactatactactaccatagacttacggaatcgacagtacgaacgtaaggacgtctagtntagtttgattacggtccgacgggtaccgaggngtaagttcgg

SEQ ID NO: 112971 - DNA, 643 bp, Homo sapiens
  misc_feature: GYAE6OF01BPZZM.15.86.H09.1.454.CMB.1.raw
  modified_base (579)..(579): a, c, t, g, unknown or other
  misc_feature (579)..(579): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctctgtgtggcctctggattcactttcagtaatggctggatggagttgggtccgccgaggctccgaaggggagggcgtgggagtgggttggtacgtttacgaaaaagtaaaagtgagtggtagaagaaaatagacgtacggtcgacgaccgtaagaaaggagactacacatactacaagagtaataaacgttaacaaaaacggtacggttattaagtttagactaaaagtgaaacagacctaagaaaacgagaaccacgacgtccgtacttatacctacgtaacccagtagtaacttacggaagtcgactaagtaccggaaaggttaaaaggnggtacttaagtgttcttttagacgttacgtcgggacggggacccaagggtacctaaggttcggg

SEQ ID NO: 112972 - DNA, 750 bp, Homo sapiens
  misc_feature: GYAE6OF01DH11X.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctctgtgtggcctctggattcactttcagtaatggctggatgagttgggtccaccaggctccgagggaaggggctggagtgggttggacgtttacaaaagtaaaatgataggtagaagaaatagactacggtgcaccgtagaaaggaagatcaccatactacaaagagtaataattaaccgaaaaacgtcggttagttaatttacggaactaaaagtagtaaaccgacgtacccgtaaggaaaaaccccggaggaaacctaaccgaacggtaccccgtttacttaaacgtttaaaccgttacgttaaaccccgtaacgtaacggtaacgtttacccggggtaaaaggtcggtaaccgtaaacggttaaccgggtaaacccggtttaaaaagggggacgggtaaccgttaagttacggtttaccgttttttaggaaacctttaggttacccgggttacggggggacccccgtaaaggggggtaacccttaacgggttaccggggg

SEQ ID NO: 112973 - DNA, 658 bp, Homo sapiens
  misc_feature: GYAE6OF01BJF9I.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccgccaggctccgaggggaaggggctgggaggtgggttggacgtttacaaaagtaaaatgagtggtagaagaaaatagactacggtgacacccggtagaaaggaagacttacaccatctacaaagagaattaattacaaaaacggtacggttagttaatttgaactaaagtcgaaacagacctaaggaaaaccgaggaaccacgacggcccgttacttaacttacctacgtaacccagtacgtaagttacgggaagtcgacctagtaccggtaaacggtaaagggaggtacttagtcggttactttttaggaattacgtccggtacggggaccccgtaaggggtaaccgtaaggttcggg

SEQ ID NO: 112974 - DNA, 582 bp, Homo sapiens
  misc_feature: GYAE6OF01COWLN.15.86.H09.1.454.CMB.1.raw
  modified_base (414)..(414): a, c, t, g, unknown or other
  misc_feature (414)..(414): n is a, c, g, or t
  modified_base (451)..(451): a, c, t, g, unknown or other
  misc_feature (451)..(451): n is a, c, g, or t
  modified_base (535)..(535): a, c, t, g, unknown or other
  misc_feature (535)..(535): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtggggggtcccttagagtctcctgtgtggcctctggattcactttcagtaatggctggatgagttgggtccgccaggctccgagggaaggggctgggagtggggttggacgtttacgaaaagtaaaatgataggtgaagaaaatagactacggtgcacccgtgaaaggagatcacatcacaaganattaattacaaaacgtacggtagtaatttgactaaangaacacgcctaagaaaccgaggacacgagcctactattacacgtaccacagtatacggaagtgacatacgaacgtaaggacggntatgtacttttggattactcggtacgggacccaggacgaagttcggg

SEQ ID NO: 112975 - DNA, 580 bp, Homo sapiens
  misc_feature: GYAE6OF01DUV3O.15.86.H09.1.454.CMB.1.raw
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (295)..(295): a, c, t, g, unknown or other
  misc_feature (295)..(295): n is a, c, g, or t
  modified_base (349)..(349): a, c, t, g, unknown or other
  misc_feature (349)..(349): n is a, c, g, or t
  modified_base (399)..(399): a, c, t, g, unknown or other
  misc_feature (399)..(399): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (478)..(478): a, c, t, g, unknown or other
  misc_feature (478)..(478): n is a, c, g, or t
tcagtctacgtagccacgaccggtgctcgatttagtgctatagacttgggtttgggggggagaggagccccagccttgggatccccaagtgtttcattcagtgatcaggactgaacacagaggactcaccatggattcgggctgagctgggttttccttgctgctatcttaaaaggtgtccagtgtgaagtgcaggtggtggagtctggggganccttggaaagccgtgggggtcccttagagtctcctgtgtggcctntggattcactttcagtatggctggatgagttggtcncagctccaggggaggctggagtgggttgacgtttacaaaagtaaatgatggtanaagaaatgactacggtgacgacccgtagaaaggagtacttcactatctanaagagtataagttacaaaacggtggtagtattagacaaatgaaactgcctaagaaacccgngacacngtcctatatacngtaccatagtcttggaatcgtacagtacggaaccgtaaggcgtctagttcgtactttagacgttacgtcggtacgggaccctaagggtactaaggttccggg

SEQ ID NO: 112976 - DNA, 632 bp, Homo sapiens
  misc_feature: GYAE6OF01ELHOJ.15.86.H09.1.454.CMB.1.raw
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgcaggctccgagggaggggctggaggtgggttggacgtttanaaaagtaaaaatgatgggtagagaaaatgactacggtnacaccgtagaaaggagattacaccatctcaaagagataattacaaaaacgtacggtagtatttagactaaaagtgaacagcctagaaaacccggagaacacgagcccgtactaattactaggtaacccagtaagactttacgggaagttcgactagttaccggaaacggtaaaaggaggtacctaagttacggtctttttaggaattagttaccggtacgggggtaccccagggggtaacctaaaggttcggg

SEQ ID NO: 112977 - DNA, 666 bp, Homo sapiens
  misc_feature: GYAE6OF01CEWJX.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggctggagtgggttggacgtttacaaaagtaaaatgagtggtagaagaaaatagactacggtgacgaccgtagaaaggaagtattacacatctacaagagaataatacgaaaacgtcggtagttattacgactaaatagaaacacggtacctaaggaaaaacccgagggaccaacgacggacccgtacttaacttaaccgtacgtaacccaactaacggttaagttacgggaaagttcggacctaacgttaccgggaaaacggtaaagggacggtacttaagttggttcttttagaacgttacgttccgggtacgggggacccaaggggtacctaaaggttccggg

SEQ ID NO: 112978 - DNA, 803 bp, Homo sapiens
  misc_feature: GYAE6OF01A89CL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgtaggttggtccgccaggctccgaggggaaggggcgtgggaggtgggttggacggttttacaaaaaggtaaaatgataggtagaagaaaatagaactacggagaccgaacccggtaggaaaacggaagtaactttaccaacccgtaattaccgtaccaaaaggtaaacgtaaattaaacgtttaaccgaaaaaaacggtaaccgggttaagtttaaattttaggaaacccgtaaaaagttacggtaaaaccaacggtaacccttaaacggaaaaaacccggaagggaaacccaaccgaacggtaccccgttaacttaacgtttaaccctacggtaaacccctaacgtaacgttaagtttaacccggggaagtacggtacgtaaacggtaccggtaaacgggtaaaaacggggtacggtaccgtttaagttacggttacctttttaggaagtttaacgttccgggttaacgggggtaccccgtaaaggggaacccgttaaacgggttccgggg

SEQ ID NO: 112979 - DNA, 620 bp, Homo sapiens
  misc_feature: GYAE6OF01DY9SG.15.86.H09.1.454.CMB.1.raw
  modified_base (381)..(381): a, c, t, g, unknown or other
  misc_feature (381)..(381): n is a, c, g, or t
  modified_base (555)..(555): a, c, t, g, unknown or other
  misc_feature (555)..(555): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgagggaaggggctgggagtggggttggacgtttacaaaagtaaaatgatggtgaagaaatagactaggngcacccgtagaaaggaagattcaccatctacaaagagaataattaacaaaaacgtcggtagtatttagactaaatagaaacagacctaaggaaaacccgaggaaccacgacgtccgtacttacttaactcgtaaccacagtagttcggaagtgaccataccggaaggtaaaggngggacttaagtgttcttttaggattacgttccggtacgggggacccaaggggactaagttcgggg

SEQ ID NO: 112980 - DNA, 829 bp, Homo sapiens
  misc_feature: GYAE6OF01CPXL5.15.86.H09.1.454.CMB.1.raw
  modified_base (217)..(217): a, c, t, g, unknown or other
  misc_feature (217)..(217): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggganccgttggtaaagcctggggggtcccttaggagtctcctgtgtggcctcgtggattcactttcagtaatggctggatggaggttgggtccgccgaggctccgagggaagggggctgggagtgggttggaacgttttacgaaaaagtaaaatgaagttaggtagaaagaaaatagacgttaacggtgaccgtaacccggtaggaaaacggtaagaacttcgaacctatactacgaaagaagtaattaaacttaacgaaaaaacgggtcggtttagttaattttacgaactaaaagttacggaaaactacggtaccccgttaaaagggaaaaaccccggagggaaaacccctaaccgtaaccgggtacccggtttaaaccctttaacgtttaaacccgtacgggttaaaccccctaaagtaacggttaacgttttaccgggaaaacggttcggaccgttaaagttaacccggggtaaaacccggttaaaaggggaccgggttaacgtttaacggttcggtttaaccgttttttagggaaatttacgggttacccggggtttacggggggaacccccggtttaaagggggaaaccgttaaagggttttcccggggg

SEQ ID NO: 112981 - DNA, 658 bp, Homo sapiens
  misc_feature: GYAE6OF01BS4PV.15.86.H09.1.454.CMB.1.raw
  modified_base (423)..(423): a, c, t, g, unknown or other
  misc_feature (423)..(423): n is a, c, g, or t
tcagtctacgtagccacgaccggtgctcgatttagtgctatagacgttagggtttgggggggagaggagccccagcctttcgggactccccaagtgttttcattcagtgatcgaggacgtgaacgacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcacttttcagtaatggctggatggagttgggtccgccaggctccgaggggaggggctgggagtgggttggacgtttacaaaagtaaaatgatggtagaagaaaatagactacggtgaccaccgtagaaaggaagattacacatctanaagagaataattacaaaacgtcggtattattagactaaatgaaacagacctaacggaaaaccgaggaaccacgacgcccgtacttaacttacgtacgtaaccactagtacttacgggaagttcgactaacgtacggtaaacggtaaagggacggtacttagttggttcgtttttagaacgtttacgttccgggtacggggggaccccctaaggggtaaccgtaaggttaccgggg

SEQ ID NO: 112982 - DNA, 738 bp, Homo sapiens
  misc_feature: GYAE6OF01DDQCQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtgggggtcccttagagtctcctgtgtggccttcgtggattctactttcagtaatggctggatgtaggttgggtccgcgaggctccgaggggaaggggctgggaggtgggttggtacgtttacaaaaagtaaaatgagtggtagaaagaaaatagactacggtgacgaaccgtaggaaaggaagtataccgaacatcaacaaagtaagaattaataaccgaaaaacgtcggttaagttatttacgaactaaagtagaaacgacgtaccgtaaaggaaaaaccggacggaacaaccgaacgtacccgttaacttaacgtttaacgtacgtaaacccgaagtaacggtaacgtttaacccgggaagttacgaaccgttaaacgtaccggaaaacgggttaaaagggacggttaaccgtaagtttacgtttaccgtttttaaggaacgtttaacggtcccgggttaacgggggacccccgtaaaggggaccttaaacgggtttccgggg

SEQ ID NO: 112983 - DNA, 595 bp, Homo sapiens
  misc_feature: GYAE6OF01DCCPB.15.86.H09.1.454.CMB.1.raw
  modified_base (397)..(397): a, c, t, g, unknown or other
  misc_feature (397)..(397): n is a, c, g, or t
  modified_base (451)..(451): a, c, t, g, unknown or other
  misc_feature (451)..(451): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttggtccgccaggctccgaggggaaggggctgggagtgggttggacgtttcaaaagtaaaatgatgggtgaagaaaatagactaggtgcacccgtagaaacggaanatcacatcacaagagataattacaaaacgcggttatatttgactaaatgaaacngactagaaaccgagacacagccgtatagtactgtaccatagattacagaagtcgacagtacgaggtaaaagggcggacttaggttcgttacgttttagaacttacgttacggttacggggaccccgtagggtaacgtaaacggg

SEQ ID NO: 112984 - DNA, 653 bp, Homo sapiens
  misc_feature: GYAE6OF01DOJUJ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagccgtggggggtcccttagagtctcctgtgtggcctctggattcactttcagtaatggctggatggagttgggtccgccaggctccgagggaaggggctgggaggtgggttggacgtttacaaaaggtaaaatgatggtagaagaaaatgaactacggtgcacccgtgaaacggaagatcacatctacaagagaataattacaaaaacgtacggttagtatttagactaaatacgaaacacgacctaggaaaaccgagggaaccaacgacgcccgttactaatttaacctggttaacccaccgtagtagtttaccgggaagttcggactaagtccggaaaccggttaaagggacgggtaccttaagtggttcctttttaggattaagttccggtacgggggaccccaagggggtaccaagttccgggg

SEQ ID NO: 112985 - DNA, 585 bp, Homo sapiens
  misc_feature: GYAE6OF01ALQZT.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctgatgagttgggtccgccaggcctccgaggggaaggggcgtggaggtgggttggacgtttacgaaaagtaaaatgatgggtagaagaaaatagacgtacggtcgacgacccgtagaaaggaagattacaccatctacaagagataatacaaaacgcggtatattgacaaatgaaacagtacctaagaaaccgagacacagcctatagttaccagtaccactagacttacggaagtgactagtacgaacgtaaaggcgtactatgtcttttagattagtcgtagggacccagggactagtcgg

SEQ ID NO: 112986 - DNA, 598 bp, Homo sapiens
  misc_feature: GYAE6OF01CIR8G.15.86.H09.1.454.CMB.1.raw
  modified_base (397)..(397): a, c, t, g, unknown or other
  misc_feature (397)..(397): n is a, c, g, or t
  modified_base (457)..(457): a, c, t, g, unknown or other
  misc_feature (457)..(457): n is a, c, g, or t
  modified_base (490)..(490): a, c, t, g, unknown or other
  misc_feature (490)..(490): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggttggacgtttacaaaagtaaaatgatggtgaagaaatagactacggtgacacccgtagaaaggaanattacacatctacaagagataattaacaaacgtacggtagttatttgactaaatgaaacngacctagaaaccgagacacagcctactattacngtaccagtagattcggaagtcgacagtcgaacgtaaagggagtacgttatcgttcgtttttagaattacgtcggttacggggacccgtaaggggtactaagttccggg

SEQ ID NO: 112987 - DNA, 658 bp, Homo sapiens
  misc_feature: GYAE6OF01C6FCS.15.86.H09.1.454.CMB.1.raw
  modified_base (346)..(346): a, c, t, g, unknown or other
  misc_feature (346)..(346): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttgggggagaggagccccagccttgggatccccaagtgttttcattcagtgatcaggactgaacacagagactcaccatggagttcgggctgagctgggttttccttgctgctatcttaaaaggtgtccagtgtgaagtgcaggtggtggagtcgtgggggagccgttggtaaagccgtgggggtcccttagagtctccgtgtgtggcctcgtggatttcacttttcagtaatggctggatgagttgggtccgccgaggctccgagggaagggctgggagtgggttgacgtttanaaaaagtaaaatgagtggtagaagaaaatagacgtacggtgaccgaaccggtagaaaggaanacttcaacatcctagaaagaagaataaactaacgaaaaacggtacggttagtaatttagaactaaaagtacgaaacgagacctaaggaaaacccggagtaacaccgaacgtccgttacttaagttaactcgtaacccaacgtagtaacgttacgggaatcgactaagtaccggaaacggtaaaaggacggtactagttgtccgttttagattacgtcggtaccggggcccaaggggacctaaggttcggg

SEQ ID NO: 112988 - DNA, 604 bp, Homo sapiens
  misc_feature: GYAE6OF01BPV3U.15.86.H09.1.454.CMB.1.raw
  modified_base (414)..(414): a, c, t, g, unknown or other
  misc_feature (414)..(414): n is a, c, g, or t
  modified_base (439)..(439): a, c, t, g, unknown or other
  misc_feature (439)..(439): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcatctggattcactttcagtaatggctggatgagttggtccgcaggctccgagggagggctggagtgggttggacgtttacaaaagtaaaatgatggtagaagaaaatagactacggtgacgacccgtagaaaggaagattcacatctacaaganataatacaaaacgcgtagtattganaatgaacagacctagaaaccgaggacacacgaccgtataacttactgtaaccacgtagtacgttacggaagttcgactagtaccggaacggtaaagggcggtacttagttcgttacttttagaacttacgttccggtacggggaccccaggggtaacctaacggg

SEQ ID NO: 112989 - DNA, 583 bp, Homo sapiens
  misc_feature: GYAE6OF01AQQ27.15.86.H09.1.454.CMB.1.raw
  modified_base (382)..(382): a, c, t, g, unknown or other
  misc_feature (382)..(382): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgaggggaaggggctggaggtgggttggacgtttacaaaagtaaaatgatggtagaagaaaatagactacggngcaccgtgaaaggaagatcacatctacaagagaataattacaaaacgtacgtagtatttgactaaatgaaacacgacctagaaaaccgagacaacacgccgtactattacctagtaccactagattacggaagtcgacagtaccgaagtaaaggngactatgtacttttgattcgtcgtggggacccagggcctagtcggg

SEQ ID NO: 112990 - DNA, 665 bp, Homo sapiens
  misc_feature: GYAE6OF01CMMDM.15.86.H09.1.454.CMB.1.raw
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagttaatggctggatgtagttgggtccgcaggcgtccgaggggaaggggctggnggtgggtggacgtttanaaaagtaaaatgaagtggtgaagaaaatagaacgtacggtagctaacccggtagaaaggaagtattacaaccatactacaaagtagaattaacttaacgaaaaacgtacggttagttaagtttagaactaaagtagaaacgacgacctaacggaaaaccgaggaaccacgaacgtccgttacttaagttaccgtaagttaacccaagtacgtagttacggaaaggtcgaccgtaagtaccggtaaacggtaaaggaggtacttagtcggttagttttagattacgtcggtacggggaccaacgggactaaggtccggg

SEQ ID NO: 112991 - DNA, 677 bp, Homo sapiens
  misc_feature: GYAE6OF01BIZ8B.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgagggaggggcgtgggaggtgggttggacgtttacgaaaagtaaaatgagtggtagaagaaaatagacgtacggtgacgaacccgtagaaaggacgattaccacatctacaagtagaattaataacgaaaacgtacggtagttaatttgaactaaagtgaaacacgacctaacggaaaaccgaggaaccaacgacgtacccgtacttaacgttacctacggttaacccaagtaaggtaacgtttaccgggaaggttcgactaacgtacggtaaaccggtaaaagggcggtacttagtcggttacttttaggaatttacggtcggttaccgggggacccaaggggtaccgtaaggtttacccgggg

SEQ ID NO: 112992 - DNA, 623 bp, Homo sapiens
  misc_feature: GYAE6OF01BRIXB.15.86.H09.1.454.CMB.1.raw
  modified_base (565)..(565): a, c, t, g, unknown or other
  misc_feature (565)..(565): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgaggttgggtccgccaggctccgaggggaaggggctgggaggtgggttggtacgtttacgaaaagtaaaatgagtggtagaagaaaagtagaactacggtgacacccggtagaaaggaagtatcacatctacaagagataattaacaaaacgtacggtataattgacaaatgaaactagacctaagaaaaccgaggaacacgacgacccgtataattaacctacgtaacccacgtagtattacgggaattgacgtagtacggaacgtaaaagggngacttagtggttcttttagattacgtcggtcggggacccaaggggtacctaagtcggg

SEQ ID NO: 112993 - DNA, 622 bp, Homo sapiens
  misc_feature: GYAE6OF01E0HRY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccaggggaaggggctggagtgggttggacgtttcaaaagtaaaatgatggtgaagaaatagactacggtgcaccgtgaagaagatacacatctcaagagataattacaaaacgtaacgtgtatttagactaaatagaacagaccgtagaaaaccgaggaaccacgacgtaccggtctaattaactacgtacccaacgtaagtagttacggaagtacgacagtaccgtaaggtaaaacgggagggtctaagtcgttcttttaggtaattacgtaccggttcgggggaccccgtacggggaacgaacggttacgggg

SEQ ID NO: 112994 - DNA, 666 bp, Homo sapiens
  misc_feature: GYAE6OF01B59FL.15.86.H09.1.454.CMB.1.raw
  modified_base (481)..(481): a, c, t, g, unknown or other
  misc_feature (481)..(481): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttgggtccgcaggctccgagggaaggggctgggagtggggttggacgtttacaaaaggtaaaatgaatggtagaagaaaatagacgtaggtgacaccgtagaaaggagattacacatcacaagagaataattacaaaaacgcgttagtaatttgaacaaaatcgaaacagacctaaggaaaaaccgnggaacacgtacgaccgttacttaacgttactaggtaacccaacgtagtaagttaccggtaaaggtcgtaccgaacgttaccgggaaaaccggttaaaagggacgggtaccttaaaggtcggtttactttttagaacgttacgtccgggtacgggggacccctaaaggggtactaaaggttcgggg

SEQ ID NO: 112995 - DNA, 642 bp, Homo sapiens
  misc_feature: GYAE6OF01D2FS4.15.86.H09.1.454.CMB.1.raw
  modified_base (265)..(265): a, c, t, g, unknown or other
  misc_feature (265)..(265): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctntggattcactttcagtaatggctggatgtaggttgggtccgccgaggctccgaggggaggggctgggaggtgggttggacgtttacgaaaagtaaaagtgatggtagaagaaatagactacggtgacaccgtagaaaggaagatcacatctacaaganaataattaacaaaaacggtacggttaagtatttagactaaatagaaacagacctaaggaaaacccgaggaccacgacgtccgttactaattacctacgtaaccacgagtagttacgggaagtcggactaagtacggaaacggtaaagggacggtacttaagttgtacgttttagagttacgtcggtacggggacccgtaaggggaactaaggttccggg

SEQ ID NO: 112996 - DNA, 635 bp, Homo sapiens
  misc_feature: GYAE6OF01C3QYA.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggctgggagtgggtggacgtttcaaaagtaaaatgagtggtagaagaaaagtagaacgtacggtgaccgacccgtagaaaaggaagtattacaaccatctacgaagagaattaacttaacgaaaaacggtacggtagttaatttagaactaaagtagaaacagacctaaggaaaacccggaggaaccaacgacgaccgtactattaactacgtaaccacgagtattacgggaagttgactagtacggaagtaaagggacggtactatgttcttttagattagttcggacggggtacccgaagggactaagttcggg

SEQ ID NO: 112997 - DNA, 866 bp, Homo sapiens
  misc_feature: GYAE6OF01ETOGN.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcgttgggttttccttgctgcttatacgttaaaaggtgtccagtgtgaagtgcgagggtggtggagtcggtgggggacgtccgttagggtaaacgtccggtcggggggttacccctttaaggtacggttccttccgttggttcggtcgggcccttcgtggtactttccgtacttttcaagttaagtggtacgtggagttggtaggttcgggtcccgaccgtacggccgtaccggaggggaaggggcgtggggtagggttggggttaggtaacggtttaaacgtaaaaaggttaaaagtgtaagttagggtaagtaaaaggtaaaaacgtaggtaaccgtaacgggtacgtaacccgtaacccgggttaaaggaaaagggtaacgtaacgtttaacccaaccgtaacgttacccgttaagaaaacgtaagtaacgtttaaaacgttaaccgaaaaaaccggtcggtttaagttagttttaacgaaacgaaagttacggaaacgtaaccgaaccgtaaacggaaaaccgacgaaccaacgtacgtacccgttacttaacgttaccgtacgtaacccgtaagtaacggtacgtttacgggaacttacgaacgtaacggtaccgtaaaagggtaaaacggtgtaacgttagtacgtttgtttaggtaacgtacgttaccggggttaccgggaaccgaaacggggttcctaaggggtttccgg

SEQ ID NO: 112998 - DNA, 621 bp, Homo sapiens
  misc_feature: GYAE6OF01A4QK2.15.86.H09.1.454.CMB.1.raw
  modified_base (356)..(356): a, c, t, g, unknown or other
  misc_feature (356)..(356): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaagccgtggggggtcccttagagtctcctgtgtggcctctggattcaccttgagcacttattggatgacttgggtccgccaggctccgaggggaaggggctggagtggggtggccaccaatacaaaaagntaggaagtgacacaacctatgtagaactctgtgatgggccattccaccgtctccagacgaccgacgaccaagaacctcactacatctagacaaatcgaaacaaccgtgaagacgaccggagaccacggctggtattaattactgtggtagagtagtattcggtttacgtcggtcgggtttacgggggcccgaaaccgggggtaaaccccccgttggggttacccctaccccggtttccttccgtttacccgaccggttacccccg

SEQ ID NO: 112999 - DNA, 578 bp, Homo sapiens
  misc_feature: GYAE6OF01CA1H7.15.86.H09.1.454.CMB.1.raw
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (472)..(472): a, c, t, g, unknown or other
  misc_feature (472)..(472): n is a, c, g, or t
  modified_base (529)..(529): a, c, t, g, unknown or other
  misc_feature (529)..(529): n is a, c, g, or t
  modified_base (540)..(540): a, c, t, g, unknown or other
  misc_feature (540)..(540): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggggagccttggtaaagccgtggggggtcccttagagtctcctgtgtggcctctggattcactttcagtaatggctggatgagttgggtccgccaggctccgagggaaggggctgggagtgggttggacgtttacaaaagtaaaatgatggtgagaaaatgactacggtgcaccgtagaaaggagatcacatctnaanagaataatacaaaagcggtagtatttagctaaatgaacagcctagaaaaccgaggaacacganccgtactattactacgtaccacagtacttacggaagtcgacagtacgaagtaaaggnggactagtgtnttttagattagtcgtacggggcccagggactaggtcgg

SEQ ID NO: 113000 - DNA, 1059 bp, Homo sapiens
  misc_feature: GYAE6OF01BYP4Y.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctggggttttcgttcgtcgtcgtcgtacttacttaaaacggttaaaggtccgtacgtaggttgtaaggtaggtcgaggtaggggttgggtaggtacgttcgggggtagggggaccgtccgttccgaccggaccgggggggtccccgggggttccgtaggaacgtccttcccgttcgttggtaacggaccgtccttgggtagttaccttaccgttacgttaggacgtacctttaattttggtagtagtaacgtttcggggttccggccccgacggacggtccctacggggaaaggggggacggtcggagggtagggtggggtcccgaccctaacgtaaacgaaaaagaaaaggtggtaaagggtaacggtaaccaaacctaaaccttaaacgttaggttacggtaaactacccgtttggtaggtaacgtacgggggtcccgggaacctttactaccccggtacccgttcccgtaaccggaagggaacccggtaacccggaacccgaaaaccggtaaaacgttaacccctaaccgtaaacctaacgtaaccttcggtaacgaaaaacttaacggaaaccctaaaaccccgttacggaagggaaaccgggaccccggggtaaacccgggaaacggaaacccccggggtccggtttacggtttacggggttttaaaacttttaaacccggtttaacgggtttgggttaaacgggttaaagggaaacgggttaaaggttttacgtttttcccggggttttaaccgggtccggggggtttttaaacccggggggggttccccggggggtaaaaccccggggtaaaaccccccgggtttttaccccgggggttacccggtttaaaaccccccccgggttcccccggtttttaaccccgttccccggtaaaacccccgggg

SEQ ID NO: 113001 - DNA, 654 bp, Homo sapiens
  misc_feature: GYAE6OF01B2X4F.15.86.H09.1.454.CMB.1.raw
  modified_base (420)..(420): a, c, t, g, unknown or other
  misc_feature (420)..(420): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgaggttgggtccgccgaggctccgaggggaaggggctgggagtgggttggacgtttacaaaagtaaaatgatggtagaagaaaatagactacggtgacgaccgtagaaaggagatcacatctacaaganataataacaaaacgtacggtatatttgacaaagtgaacagacctaacgaaaccgaggaaccacgacgtaccgttactaattaccgtacgtaacccacgtagtaacgttacggaagtcgaacctagtaccggtaaacggtaaaaggtacggtacttaaggttggtttaccgttttaggaaattacggttccggtacgggggtaccccgaagggtaaaccgttaaggttaccgggg

SEQ ID NO: 113002 - DNA, 653 bp, Homo sapiens
  misc_feature: GYAE6OF01BGUME.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccgaggctccgaggggaggggcgtgggaggtgggttggtacgtttacaaaagtaaaatgagtggtagaagaaaatagacgtacggtgacgaccgtagaaaggagatcacatctacaagagaataagttaacgaaaacgtacggttagttatttagacaaagtacgaaacacgacctaagaaaaccgaggaaccacgacgtcccgtacttacttacctagtaacccactagtacgtttacgggaagtcgactagtaccggaaacggtaaaagggacggtacttagttacggttctttttaggaacttacgttaccgggtacggggaccccgaggggtaaccgtaggttccggg

SEQ ID NO: 113003 - DNA, 637 bp, Homo sapiens
  misc_feature: GYAE6OF01A7XKK.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcgaggctccgaggggaaggggctgggaggtgggttggacgtttacaaaagtaaaatgatggtagaagaaatagactacggtgacgacccgtagaaaggaagacttcgaaccatctacaagagtaataattacaaaacggtacggttagtaagtttagaactaaatagaaacacgtacctaagaaaaccgagaacacgacgtacctactacttactgtaacccatagtagttacggaagtcgactagtacgaacggtaaaggaggtaccttaagtcggttacttttaggattacgttccggtacggggaccccaaggggtaaccgtaaggttcgggg

SEQ ID NO: 113004 - DNA, 585 bp, Homo sapiens
  misc_feature: GYAE6OF01BINYN.15.86.H09.1.454.CMB.1.raw
  modified_base (434)..(434): a, c, t, g, unknown or other
  misc_feature (434)..(434): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccgaggctccgaggggaaggggcgtggagtggggttggacgtttacaaaagtaaaatgagtggtagaagaaaatagacgtacggtgacaccgtagaaaggaagattcgacatctacaagagataatacaaaacgngtagtaatttgacaaatgaacacgactaagaaaaccgagaacacagccgtactatacagtaccagagtagttacggaagtcgactatcggtaacgtaaaggagtctagttgtctttagatagtcgacgggacccagggtactaaggtcggg

SEQ ID NO: 113005 - DNA, 708 bp, Homo sapiens
  misc_feature: GYAE6OF01ASRER.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattctactttcagtaatggctggatggtaggttcgggtccgccgaggtccgtccggagggggaaggggcgtgggaggtggggttaggacggttttaacgaaaaagttaaaagtgtaagtggtagaagaaaagtagacgtacggtgacgaccgtagaaaggaatacttacaacctatctacgaagagtaataattaacgaaaacggtacggttagttagtttagaactaaagtcgaaaccagacccgtaaggaaaaccggtagaaccgaccgacgtacccgtattaacttaccgtacgtaacccagtaaggtaccgttacgggaagtacgacctaaaggtaccggtaaaggttaaaacgggcggtaacttagttacggttcttttaagagttacggttccggaccggggaacccgtaaggggtaaccgttagggttcccggg

SEQ ID NO: 113006 - DNA, 590 bp, Homo sapiens
  misc_feature: GYAE6OF01B5B4M.15.86.H09.1.454.CMB.1.raw
  modified_base (411)..(411): a, c, t, g, unknown or other
  misc_feature (411)..(411): n is a, c, g, or t
tcagtctacgtagccacgaccggtgctcgatttagtgctatagacttgggtttgggggggagaggagccccagccttgggatccccaagtgttttcattcaatgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctgggagtgggttggacgtttacaaagtaaaatgagtggtagagaaatagactacggtgcacccgtgaaagaagatcacatcacaaganataatacaaacgacggtgtatttgacaaatgaacacgcctagaaaccgaggaccacgacgccgtactataccgtgtaaccactacgtattacggaagtcgactacgtacgaacggtaaaggaggacttagtcgtcttttgattacgtcgtacggggaccccaaggggactaagttcggg

SEQ ID NO: 113007 - DNA, 644 bp, Homo sapiens
  misc_feature: GYAE6OF01BE689.15.86.H09.1.454.CMB.1.raw
  modified_base (414)..(414): a, c, t, g, unknown or other
  misc_feature (414)..(414): n is a, c, g, or t
  modified_base (579)..(579): a, c, t, g, unknown or other
  misc_feature (579)..(579): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttggtccgcaggctccgaggggagggcgtggagtgggttggacgtttacaaaagtaaaatgaagtggtagaagaaaatagacgtacggtgaccaccgtagaaaggagacttacaccatctanaagaagtataaatacgaaaaacggtcggttagtatttagactaaaagtcgaaactagacctaacggaaaaccgaggaacctaacgaacgtccgttactaacgttacctacgtaacccaacgtagtaacttacgggaagtgactacgtacgaaacggttaaacggnggtacgtagtcggttctttagaattacgtcgtacgggggaaccctaggggtaactaaggttcggg

SEQ ID NO: 113008 - DNA, 629 bp, Homo sapiens
  misc_feature: GYAE6OF01A2N48.15.86.H09.1.454.CMB.1.raw
  modified_base (163)..(163): a, c, t, g, unknown or other
  misc_feature (163)..(163): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (373)..(373): a, c, t, g, unknown or other
  misc_feature (373)..(373): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (476)..(476): a, c, t, g, unknown or other
  misc_feature (476)..(476): n is a, c, g, or t
  modified_base (588)..(588): a, c, t, g, unknown or other
  misc_feature (588)..(588): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctggagcggtcggtttcgtnacgtcgctaatacgtaaagtgtcagtgtgagtgcgaggtggtggagtcgtgggggactccttaggtaaacgccgtcgggggtacccttagagtcctctgtgtcggcctgtaggnttcactttcagtaatggngtaggatggnggttcgggccgccgaggcctacggaggggagggctgggaggttggtggtacgtttaagaaaagtaaangtagtaggtagaaagaaatacgacgtaacgtgaccaccggaggaaagganatacactatccaanaaganaattaactaacgtaaaccggtggtatattagaanaatagaacacgtacgaagaacggacgacaacgtcgacctactaacttactacgtacaacgtagtacttaggaactcgactagtaccgaggtaaagcggtaactgttcggttntttagaattcggtcggttacgggaccgagtacctggttcgg

SEQ ID NO: 113009 - DNA, 683 bp, Homo sapiens
  misc_feature: GYAE6OF01CM1XC.15.86.H09.1.454.CMB.1.raw
  modified_base (414)..(414): a, c, t, g, unknown or other
  misc_feature (414)..(414): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttcaaaagtaaaatgatggtagaagaaaatagactacggtgcacccgtagaaaggaagattcaccatctcaaganaataattacaaaaacgacggttagttaatttaggactaaaagtcgtaaaacagtacccgtaaggaaaaacccgacgggaaccaacgaacggtacccgttactaacttttaacctacgttaacccaacgtaaggtactttaaccggggaagttcgaccgtaagttaccggaaaccgggttaaaagggacgggtccttaagttcggttctttttaggatttacgttccggtacggggggtccccctaaagggggctaaaggtttaccgggg

SEQ ID NO: 113010 - DNA, 680 bp, Homo sapiens
  misc_feature: GYAE6OF01DSBLA.15.86.H09.1.454.CMB.1.raw
  modified_base (360)..(360): a, c, t, g, unknown or other
  misc_feature (360)..(360): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgagtgcaggtggtggagtctgggggagccttgggtaaagccgtggggggtcccttaggagtctcctgtgtggcctctggattcactttcagtaatggctggatgagttgggtccgccaggctcgagggaaggggctggagtgggttgacgtttcaaaagtaaatgaatggtanaagaaatagacgtacggtgccacccgtagaaaggaagacttacaccatctacgaagtagaataattaacgaaaaacgtacgggttagttaagtttagaactaaataggaaacctagacccgtaaggaaaaacccggtaggaaccaacgaacggacccgttacttaactttaaccgtacggttaacccaacgtacggtaagtttaccgggaaagtcggacgtaacttaccgggaacgtaaaaggggcggtaaccttaagttcgttacctttttagacttacgttcggttacgggggacccctaaggggacctaagtcgggg

SEQ ID NO: 113011 - DNA, 653 bp, Homo sapiens
  misc_feature: GYAE6OF01CPXWQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattctactttcagtaatggctggatggtagttgggtccgcgaggctccgaggggaaggggcgtggaggtgggttggacgtttacaaaagtaaaatgagtaggtagaagaaaagtagaacgtaggtgaccgaacccggtagaaaaggagtattccaaccatacacaaagagaataataacgaaaacgtacggtagtatttagactaaatagaaacagacctaagaaaaccgagaccacgacgaccgtatattaaccgtacgtaaccacgtagtacgttacggaagtcgaactaacgtaccggaaaggtaaagggacgtacgttaagtggttacttttacgaattacgtccgggtacggggacccgaaagggtaacgtaaggttcggg

SEQ ID NO: 113012 - DNA, 752 bp, Homo sapiens
  misc_feature: GYAE6OF01AKHUI.15.86.H09.1.454.CMB.1.raw
tcagtctacgtagccacgaccggtgctcgatttagtgctatagacttgggtttggggggaggaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtcccttaggacgtctcctgtgtcggcctcgtggtattcactttcagtaatggctggatgaggttcgggtccgccgaggcctccgagggggaacggggcgtgggacggtggggttcggtacggtttaacgaaaaaggtaaaaagtggtaagtagggtagaaagtaaaagtacggaacgtaacggtggaccgaacccggtaaggaaaagggtaagtaactttacgaaccctaataccgtaacaaaggtaagtaacgttaaattaaccgaaaaaacggtacgggttagttaagttttacgaactaaaagtacgaaaaccgtacgacccggttaaaggaaaacccggtaggaacctaaccgacgacccgtttaactaacgtttaaccgtacgtaaccgaactaagtaacgttacggaagttcgaactagtaccggtaaacgtaaagggacgtacttagttacgtcgttttagaattcggtacggttacggggaacccctaggggaactaaggttccggg

SEQ ID NO: 113013 - DNA, 583 bp, Homo sapiens
  misc_feature: GYAE6OF01EFINA.15.86.H09.1.454.CMB.1.raw
  modified_base (466)..(466): a, c, t, g, unknown or other
  misc_feature (466)..(466): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
  modified_base (545)..(545): a, c, t, g, unknown or other
  misc_feature (545)..(545): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctcccgtcccccttcgcagtaacaccaagtacaggaatattaacctgtttcccatcgactacgcctttcggcctcgccttaggggtcactcaccctgccccgattaacgtgacaggaacccttggtcttccggcgagcgggtcttttcaccgtctttatcgttacttatgtcagcattcgctacttctgactacctcagcatcgcctcacagcacaccttcacaggcttacagaaccncctacccctacccaacaaccgcaataacgccgtcgctcgccgcagtcttcggngctacgttggtttaccnccccgtttnacttcccttcccgctactctacgagtctacgtagtacg

SEQ ID NO: 113014 - DNA, 574 bp, Homo sapiens
  misc_feature: GYAE6OF01B0RRQ.15.86.H09.1.454.CMB.1.raw
  modified_base (523)..(523): a, c, t, g, unknown or other
  misc_feature (523)..(523): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggcgtggagtgggttggacgtttacaaagtaaaatgatggtagagaaatagactacggtgcacccgtgaaaggagattcaccatctacaagagaataattacaaaacgtacggtagtatttgactaaatgaacagacctaagaaaccgagacacagcctactatactagtaccacagattcggaatgacatacgaacgtaaaggngcttagtgtcttttagaattacgtcgtacggggacccagggactagtcggg

SEQ ID NO: 113015 - DNA, 621 bp, Homo sapiens
  misc_feature: GYAE6OF01BE9EK.15.86.H09.1.454.CMB.1.raw
  modified_base (413)..(413): a, c, t, g, unknown or other
  misc_feature (413)..(413): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgcaggctccgaggggaaggggctgggaggtgggttggacgtttacaaaagtaaaatgatggtagaagaaaatagacgtacggtgacacccgagaaaggagatcaccatctanaagagataatacaaaacgcggtatatttgacaaatgaacagacctagaaaaccgaggaacacgacgccgtactaattaccgtgtaacccagtaagacgtttacgggaatcgacagtaccggaaacggtaaagggaggtaccttagttggttacttttaggaattacgttccgggtacggggaccccgaaggggtaactaggttcgggg

SEQ ID NO: 113016 - DNA, 816 bp, Homo sapiens
  misc_feature: GYAE6OF01BWURR.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcgagggtggtgggaggtcgggggagccgttaggtaaaggccgtgggggtcccttaggagtctccgtgtgtcggcctcgtggattcactttcagtaatggctggatggtaggttcgggccgccgaggccgtccgagggggacgggtcgtgggtaggttcggggttaggtaccgtttaacgaaaaaggttaaaaagtggtaagtagggtagaaaggaaaaataggaacgtacggacgaccgaaccggtaaggaaaaggaacgtaacgttaccaaccgtaagttacctaacgtaaaggtaagtaaacttaaacgttaaaccgtaaaaaacgggtccgggtttaagttaaacgtttagaaccgtaaaagttacggaaactaacgtacccgtaaacggaaaaccggtaacggaacccgaacgtaccggtacccgttaacttaaccgtttaacctacggtaacccaacgtaacggtacgtttacggaacgttgactaacggttaacggaacggtaaacgggaccggttacgttaacggttagttacgttttaacggtaacgttacgggttaccggttaccgggggtacccggaaagggttaacccggtagggttaccgggttaccccggg

SEQ ID NO: 113017 - DNA, 754 bp, Homo sapiens
  misc_feature: GYAE6OF01DDC1A.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtgggggagtccgttggtaaaggccggtgggggtcccttaggacgtcctccgtggtgtcggtcctcgtggtattctactttcaagttaagtggcgtggattggtaggttcgggtcccgccgacggccgtaccggaagggggaacgggggcgtaggggtagggttggggttaggtaacggtttaacgaaaaaaggttaaaaagtgtaagtagggtaagaaagtaaaaagtaggtaacgttaacggtacgaccgaaacccggtaggaaaaacggtaagtaacttaccaaccgtactaccgtaacgaaaggtaagtaaattaaaacgttaaaccgtaaaaaacggtacggtttagttaagtttagaactaaaagtacgaaacacgtacccgtaaggaaaacccgaggaacccagaacggtccttacttaacgttactacgtaaccactaagtaccttaggaacgttgactaagtaccgaaacggtaaaggcgtacttagtcgttctttagattacgtcggtacgggacccgagggtactaggttcgg

SEQ ID NO: 113018 - DNA, 632 bp, Homo sapiens
  misc_feature: GYAE6OF01DW2CE.15.86.H09.1.454.CMB.1.raw
  modified_base (305)..(305): a, c, t, g, unknown or other
  misc_feature (305)..(305): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcatgtggtggagtcgtgggggagccgttaggtaaagccgtggggggtcccttagagtctcctgtgtggcctcgtggattcacttttcagtaatggctggatgagttgggccncaggctcgaggggaagggctggaggtgggttaggacgtttacaaaagtaaaatgagtggtagaagaaaatagactaggtgacaccgtagaaaganatacacatctanaagagtataaattacgaaaaacgtacggttagtaatttgaactaaaagtacgaaacacgaccgtaagaaaaccgaggaacacgacgtccgtactaacttactacgtaaccagtaagtagttaccggagtcgactaagtcggaaacgtaaagggacgtacttagttcggttacttttagaacttcgtaccggtacggggacccctaggggtactaaacggg

SEQ ID NO: 113019 - DNA, 812 bp, Homo sapiens
  misc_feature: GYAE6OF01DII55.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgttggttttccttgctgctatacttaaaaggtgtccagtgtgaagtgcgaggtggtggagtcgtgggggacgtccgttaggtaaagccggtcgggggtacccttagagtcctccgtggtcgtggcctcgtggtacttctactttcgagtaagtggctggtattggtacggttcgggtcccgcgtacggccgtaccggaaggggaacggggcgtgggtaggttgggttacggtaacgtttaaacgaaaaagttaaaagtggtaagtagggtaagaaagtaaaagtacgtaacgttaacggtacgaccgtaacccgggtaaggaaaacggaacgtaacttaccaaaccgtaactaccgtaacgaaagtaaacgtaaacttaaacgttaaaccgaaaaaacggtcggtttaagttaatttacgaaacgtaaaagtacgaaaacctaacggtaacccgtaaaacggaaaaacccggacggaaccgaaccgaacggtacccgttaactaaccgtttacgaaccgtaacccgtaacgtaacgtaacggttaacggtaagtacgaacctaaggtaaccggtaaacggtaaaaggacggttacttagttacggttcttttaacggatttacggtcggtaccggggaacccctagggtaaccgtaggttcccgg

SEQ ID NO: 113020 - DNA, 718 bp, Homo sapiens
  misc_feature: GYAE6OF01B59QO.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccgccgaggctccgaggggaaggggctggaggtgggtggacgtttacgaaaagtaaaatgagtggtagaagaaatagacgtacggtgacgaacccggtaggaaaaggaagtaattaccaaccgtatacctacaaagaagaattaaataaccgaaaaacgtacggtaagttagtttagaactaaaagttagaaactacggtacccgtaagaaaaacccggaaggaacccaacgaacgtaccccgttacttaacgtttaacgtacgtaacccaacgtaacgttaacgttaacgggtaagtacgaccgtaagtaccggtaaaccgggtaaaaggaacgggtaccttaagttaggttccgtttttaggaatttacggtcggtacggggaccccgtaaaggggtaaccgtaagttacccggggg

SEQ ID NO: 113021 - DNA, 742 bp, Homo sapiens
  misc_feature: GYAE6OF01A2SA3.15.86.H09.1.454.CMB.1.raw
  modified_base (386)..(386): a, c, t, g, unknown or other
  misc_feature (386)..(386): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgcaggctccgaggggaaggggctgggaggtgggttaggacgtttacaaaaagtaaaatgatggtagaagaaaatagacgtaacggngacgacccgtagaaaacggaagacttcaacctatctacgaaagagtaattaaacgttaacgaaaaacggtacggttaacgttaagtttacggaactaaaagtacggaaaccacggtaacccgtaacggaaaacccgaacgggaaccaacgaacgtcccgttaacttaaacgtttaactaacgttaacccaaacgtaacgttaacgtttaaccgggaacgttacgaccgtaagtaacccggtaaaacgggttaaaacgggaggtaaccgttagttacgggttacctttttaaggaacgtttacgttccgggttaccggggggaacccctaagggggtaaaccgtaaggttccggggg

SEQ ID NO: 113022 - DNA, 177 bp, Homo sapiens
  misc_feature: GYAE6OF01DO24M.15.86.H09.1.454.CMB.1.raw
  modified_base (169)..(177): a, c, t, g, unknown or other
  misc_feature (169)..(177): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgggctggcaaggcgcatagnnnnnnnnn

SEQ ID NO: 113023 - DNA, 621 bp, Homo sapiens
  misc_feature: GYAE6OF01CYXEX.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgagggagggctggagtgggtgacgtttacaaaagtaaatgatggtagaagaaaatagacgtacggtgacctacccgtagaaaggaagattaccaccgtatactacgaagagtaataatacgaaaaacgacggtagttaattagactaagtagaacagacctaaggaaaaccgagaccgaacacgaccgtactactttactacgtaccactacgagttacggaagtcgactagtacgaaacgtaaagggacggcgttagttgttctttagacttagtccggtacggggacccacggggactaacggttcggg

SEQ ID NO: 113024 - DNA, 820 bp, Homo sapiens
  misc_feature: GYAE6OF01D4N48.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtgggggagtccgttagggtaaagcccggttcggggggttcccctttaggacggttccttccgttggtggtcggcccttcgtggtatttctactttcagttaatggctggattggtaggttcgggtcccgccgaggcctaccggagggggaaggggtcgtgggtaggttggggttaggtaacgtttaacgaaaaaaggtaaaaagttggtaagttagggtaagaaaaggtaaaaagtaacggtaacgtaacgggtcgaccgaaacccggtaaggaaaaacgggtaagtaacttaccgaacctaataccgtaacgaaaaggtaagtaaattaaacgggggttaaacaaaaacggtaacgggttaagtttaagtttacgaaacgtaaaagtacgaaaccaacgtaacccgtaaacggaaaacccggaacggaaccgaacgacggtacccgttacttaacgtttactacgtaacccaacgtaacgtaacgttacgggaagtacgacgtaacgtacggtaaacggtaaaagggtacggtacgttagttacggttacttttaggaattacgtccggttaccggggacccgtaacggggtaaacgtacggttccggg

SEQ ID NO: 113025 - DNA, 633 bp, Homo sapiens
  misc_feature: GYAE6OF01DO9MR.15.86.H09.1.454.CMB.1.raw
  modified_base (491)..(491): a, c, t, g, unknown or other
  misc_feature (491)..(491): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggttttccttgctgctatcttaaagtgtccagtgtgaagtgcaggtggtggagtctgggggagccgttggtaaagccgtggggggtccccttagagtctcctgtgtggcctctggattcactttcagtaatggctggatgagttgggtccgccaggctccgaggggaaggggctgggaggtgggttggacgtttcgaaaaagtaaaatgaatgggtagaagaaatagaacgtacggtagcaacccggtagaaaaggaagtattcaccatctacaagagtaataattacaaaaacgtcggtagtatttagactaaatagaaacagtaccgtagaaaacccgnggaacacgacgacccgtacttattactacgtaaccacgtagtacttcggaagtcgaccaagttacggaaacggtaaagggcggacttagtgttcttttaggattacgtcggtacggggacccctaaggggctaaggttcggg

SEQ ID NO: 113026 - DNA, 618 bp, Homo sapiens
  misc_feature: GYAE6OF01DAV15.15.86.H09.1.454.CMB.1.raw
  modified_base (389)..(389): a, c, t, g, unknown or other
  misc_feature (389)..(389): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtccttagagtctcctgtgtggcctctggattcactttcagtaatggctggatgagttggtccgcaggctcgagggagggctggagtgggtgacgttagaaaagtaaaatgatggtagaagaaaatagacgtaggtgacaccgtagaaagganactcactatactacaagaagaataatacgaaaacggtacgtagttaatttagaactaaagtagaacacgacctaaggaaaacgaggaacaccgagtacctataacttactacgtaaccaactagaacgttaggaatcgaactagtaacggaaccggttaaaaggcggtactagttacggtacttttgaattacgtcggtaccgggacccgaagggtacaagggttccgg

SEQ ID NO: 113027 - DNA, 606 bp, Homo sapiens
  misc_feature: GYAE6OF01ELMLU.15.86.H09.1.454.CMB.1.raw
  modified_base (343)..(343): a, c, t, g, unknown or other
  misc_feature (343)..(343): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgaggggagggctgggagtgggttggacgtttanaaaagtaaaatgatggtagaagaaaatagactacggtgacacccgtagaagaagatcacatctacaagataataattacaaaacgtacggtnttaattacganaaatagtaacaacgtacccgaaaccgagaacacgacgccgttacatttactacgaccctacgagtaccgttacggtaagacgtcatacgaacgggtaaaggaggtacgtagttagtcgttttgattatacggtcgggacccgagggacgtagtgggtccg

SEQ ID NO: 113028 - DNA, 664 bp, Homo sapiens
  misc_feature: GYAE6OF01BZ2NG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctccgagggagggctggagtgggttggacgtttacaaaagtaaaatgagtggtagaagaaaatagacgtacggtcgacgacccgtagaaaggaagattacacatactacgaagagaataaacttaaccgaaaaacggtacggttagttaagtttacgaactaaaagtacgaaacaccgtaccgtaacggaaaacccgaggaacccacgacggtacccgttacttaatttacctagttaacccagtaacgagttacggaagtcgactacgtacggaaacggtaaagggcgtacttaggttcgttacttttggaattacgttcggtacggggtacccacggggtaacgtaaggttccggg

SEQ ID NO: 113029 - DNA, 787 bp, Homo sapiens
  misc_feature: GYAE6OF01DY097.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttaggtaaacgccgtggggggtcccttaggacgtctccgtgtgtggcctcgtggattctactttcagtaatggctggatggtaggttcgggtccgccgacggtcctaccggaggggaacggggcgtgggtaggttggggttacggtaacgttttaacgaaaaaagttaaaagtggtaagtagggtagaaagtaaaaagtacgtaaccgtacggtacgaccgaacccggtaaggaaaagggaacgtaacgttaccgaacctaacgtacctaacgaaaaggtaacgtaaacttaaaacgttaaccgaaaaaacggttcgggttaagtttaacgtttacgaaactaaaagtacggtaaaccgaaccggtacccgtaaaaggaaaacccgggaacggtaaaccaaccggacgtacccgttacttaacgtttaaccgtaaccgtaacccaacgtaaggtaacgttacggaagtcgactaacgtacggaaacggtaaaggcgtacttagtcgtttacgtttagaactttacggtaccggtacgggaaccccgtagggtaactaggtttccggg

SEQ ID NO: 113030 - DNA, 712 bp, Homo sapiens
  misc_feature: GYAE6OF01CEEWB.15.86.H09.1.454.CMB.1.raw
  modified_base (417)..(417): a, c, t, g, unknown or other
  misc_feature (417)..(417): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggagagccttggtaaagccgtgggggtccttagagtctctgtgtggcctctggattcactttcagtaatggctggatggagttggtccgccaggctccgagggagggctggagtgggtgacgtttacaaaagtaaatgatggtagaagaaatagacgtacggtgaccgaaccggtagaaaggagattacgaaccagtactacaaaganaacttaattaacgaaaaacgtcggttagttaatttagaactaaagtacgaaacgacgtaccgtaaacggaaaaaccggagggaaccaacgtacggtaccccgttacttaacgttaacccgttacggtaaaccccaacgttaaggtaaacgtttaacggggaacgttaggaacccttaaggtacccggttaaaacgggtaaaagggtacggtaccgtttaagttacggtttaccgttttaggaacgttacgttaccgggtaccggggggtaccccaagggggtaaccttaaacggg

SEQ ID NO: 113031 - DNA, 820 bp, Homo sapiens
  misc_feature: GYAE6OF01BC9PP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagtccgttggtaaagccgtgggggtcccttagagtctcctgtgtcggcctctggtattctactttcagttaagtggctggagttggtaggtttcggggtcccgccgagggtccgtaccggaagggggaacgggggcgttggggtagggttggggtttagggtaacggttttaacgaaaaaggttaaaaaagtggtaaagtagggtaagaaaaggtaaaacgtaaggtacgtaacgggtagaaccgtaaccgggtaaggaaaaggtaacgtaagttaccaaccgtaattacctaagaaagtaagtaagttaaactttaaccgaaaaaacgggtacggttaggtttaaagtttacgaaactaaagtagaaaacctacggtaaccctaaacgggaaaaaccccgtagggaaacctaacggtaaccgtaccggtttaacttaacttacgtaaccggttaacccaacgtaaggtacgtttaaccgggaaggttacgacgtaacgttaaccggaaaacggttaaagggacgggtacttaagggtcctttaacgtttagtaagttacgtccggttaccgggggaacctaaggggtaacctagggtttcccggg

SEQ ID NO: 113032 - DNA, 717 bp, Homo sapiens
  misc_feature: GYAE6OF01AVUBS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccgcaggctccgagggagggctggagtgggttgacgtttacaaaagtaaaatgatggtagaagaaaatagactacggtcgacaccgtagaaagagtatacactatactacaaagagaataattacgaaaaacggtacggttataatttggaacctaaaagttacggaaacctacggaacccgtaacgggaaaaacccggaggtaaccaaccggaacggtaccccgttaaccttaacggtttaacccttacggtaaacccctaagtaacgttaacggtttaaccgggaagttacggaacgtaacgtaaccgggaaaacgggttaaaacgggacggtactttaggtacggttacgttttagaacgttaacggttccggggacccggggtaacccgaaggggtaaacctaaggttcccggg

SEQ ID NO: 113033 - DNA, 756 bp, Homo sapiens
  misc_feature: GYAE6OF01DLWDY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatggagttgggtccgcaggctccgaggggaaggggctgggagtgggttggacgtttacgaaaaagtaaaatgaatggtagaagaaaatagacgtacggtgaccgtaaccggtagaaaaggtaagacttaccgaacctatctaacgaaagagtaattaaactacgaaaaaacgtcgggttagttaatttggaactaaaagtacgaaacacggtacccgtaaggaaaaaccccggagtaaaccaaccgtaacggtaccctttacgtaacgttttaacccgacgttaaacccgacgtaaggtaacgttttacgggaaacggtttcgaaccgtaaagttacccgggaaacgggttaaaaagggacggtactttaaaggttggtttaaccttttttagggaaactttaacggttcccgggttaacggggggtacccccgtaaagggggtaaccttaaagggtttcccggggg

SEQ ID NO: 113034 - DNA, 735 bp, Homo sapiens
  misc_feature: GYAE6OF01B0YIF.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgcaggctccgaggggagggctgggaggtgggttggacgtttacaaaagtaaaatgatggtagaagaaaatagacgtacggtgacacccggtagaaaggaagattaccacatctacaagagaataaacttacgaaaaacggtcggttagttaatttagaactaaagtcgaaacgtacgacccgttaaggaaaaacccggaggaaccaaccgaaggtaccccggttacttaagtttaacccttacggtaaacccaacgtaacggtaactttacggggaaacgttacggaaccctaacggttaccgggaaaaccgggttaaaaaggggacggttaccgttaagtttacgggttaccttttttagggaaatttaccgggttaccgggttacccgggggaacccccgtaaggggggtaaccttaaagggttcccggggg

SEQ ID NO: 113035 - DNA, 811 bp, Homo sapiens
  misc_feature: GYAE6OF01BAM5A.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttagggtaaagccgtgggggtcccttagagtctcctgtgtcggcctctggtattctactttcagtaatggctggatgtaggttcgggtccgccgaggtcctccggaaggggaacggggtcgtggggtaggttggggtttacgggtaaccgttttaacgaaaaaaggttaaaaagtggtaagtagggtaaggaaagtaaaaacgtaggtaacgttaacgggtcgaacccgtaaccgggtaaggaaaacggtaacgtaactttaccgaaaccgtactacgtacgaaagaacgtaacttaaacttaacgaaaaaaccggtcggtttagttaactttacgaactaaaaacgttacgaaaccgtacggtaacccgtaaacggaaaaaccggacgaaccgtaacgaacggtacccgttaacgtaactttaaccgtacggtaacccctaagtaacggttaacgtttacggggaaacctttaggaccgtaaaggtacccggtaaaacgggtaaagggtcggtaccttaaggtcgtttaacttttacgggaaatttccggtaccggtaccggggaaccctaggggtaaacctcgggttacggg

SEQ ID NO: 113036 - DNA, 582 bp, Homo sapiens
  misc_feature: GYAE6OF01BC87L.15.86.H09.1.454.CMB.1.raw
  modified_base (352)..(352): a, c, t, g, unknown or other
  misc_feature (352)..(352): n is a, c, g, or t
  modified_base (409)..(409): a, c, t, g, unknown or other
  misc_feature (409)..(409): n is a, c, g, or t
  modified_base (470)..(470): a, c, t, g, unknown or other
  misc_feature (470)..(470): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccaggggaggggctggagtgggttgacgtttacaaagtaaaangatggtgaagaaatagactacggtgcgacccgtagaaaggagattacactatcctanaagagaattaatacgaaaacgcggttagtattagacaaagtgaacagacctaggaaaccgngaacacagtcctactacttactacgtaccagagtattacgggaatgacagtacggacgtaaaggcgtctagtgtctttgattgtcgtcggggacctagggtactaggtcggg

SEQ ID NO: 113037 - DNA, 684 bp, Homo sapiens
  misc_feature: GYAE6OF01A8JZ0.15.86.H09.1.454.CMB.1.raw
  modified_base (410)..(410): a, c, t, g, unknown or other
  misc_feature (410)..(410): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttaggagtctcctgtgtggcctctggattcactttcagtaatggctggatgagttgggtccgcaggctccgagggaaggggcgtgggaggtgggttggacgtttacgaaaagtaaaatgaagtggtagaagaaaagtagacgtacggtgacacccgtagaaaggaanatacacctatctacaagagaattaaattacgaaaaacggtacggttagtaatttagaactaaaagtacgaaacaagaccctaaggaaaacccggaggaaccacgaacgtacccgtagtaacttaacctagtaacccaacgtaagtacgtttacggaagttcgaccgtaagtaccggaaacggtaaagggacggtaaccgttagttacggttacttttaggaacttaacgttccggtacgggggaccccgtaaggggaacgtaaggttaccgggg

SEQ ID NO: 113038 - DNA, 699 bp, Homo sapiens
  misc_feature: GYAE6OF01BUSPY.15.86.H09.1.454.CMB.1.raw
  modified_base (611)..(611): a, c, t, g, unknown or other
  misc_feature (611)..(611): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattctactttcagtaatggctggatgagttggtccgccaggcctccgaggggaggggcgtgggaggtgggttggtacgtttacaaaagtaaaatgagtggtagaagaaaatagacgtacggtgcgacccgtagaaaggaagattacacatctacgaagagtaataattaacaaaacggtcgttagttaatttacgaactaaagtcgaaacacgaccgtaaggaaaaccgaggaaccacgacgtacccgtacttaatttaacccgtagtaacccctaagtaacggttaacgtttaccgggaaagttcgaacctaacggttacccggtaaaacggggtaaaaacgggngggtaactttacggttaggttccgtttttagaacgtttacgttccgggtaccgggggaaccctaacggggaacttaagggttccgggg

SEQ ID NO: 113039 - DNA, 669 bp, Homo sapiens
  misc_feature: GYAE6OF01CHI3E.15.86.H09.1.454.CMB.1.raw
  modified_base (379)..(379): a, c, t, g, unknown or other
  misc_feature (379)..(379): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcccttagagtctcctgtgtggcctctggattcactttcagtaatggctggatgagttggtccgccaggctccgaggggagggctggaggtgggttggacgtttacaaaagtaaaatgaatggtagagaaaatagacgtacggngacaccgtagaaaggaagattacacatctacaagagataattacgaaaacgacggtagtatttagactaaatgaaacagaccgtaaggaaaacccgaggaaccaacgacgtacccgttacttaacttaccgtacgtaacccactaggtaacgtttaccgggaagttcgaccgtaagttaccgggaaacggttaaaagggacgggtaccttaagttacggttccgtttttaagaactttacggttccgggttacgggggaccccaagggggtaaccgtaaagggttccggg

SEQ ID NO: 113040 - DNA, 843 bp, Homo sapiens
  misc_feature: GYAE6OF01BYMIG.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtcgtgggggagccgttagggtaaacgccgtggggggtccccttaggacggttctccgtggttggtcgggtccctcgttgggtacttcgtaacttttcagttaatggctggatggtaggttcggggtccgccgaggcctccggaggggaagggggcgtgggaggttggggttaggtacgtttaacgaaaaaggttaaaaagtgtaagtgggtagaaagtaaaagtaggaacgtacggtagaccgtaacccggtaggaaaagggaagtaacttaccgaaccctagtacctacgaaaagtaagtaaacttaaaactttaaaccgaaaaaaccgggtacgggttaaggtttaacgtttaacggtaaccgttaaaaaagtacggtaaaaaccgtaaccggtaaccccgttaaaagggaaaaaacccccgggtagggtaaaccccaaaccgtacggtaccccggttactttaaacgttaaccgttacggtaaaccccaagtaaggtaccgttaacgggaagtcggaacctaagggttaaccgaaaaccgggttaaaaggggaccgtattaaggtgtttaccgttttagtaacgttaacgttcggggtaaccgggtaccccgtaagggaacttaaggttcccgggg

SEQ ID NO: 113041 - DNA, 883 bp, Homo sapiens
  misc_feature: GYAE6OF01BVCYR.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgttggttttcctgctgctatacgttaaaggtgtccagtgtagagtgcgaggtggtggagtcggtgggggacgtccgttagggtaacgtccggttcgggggtcccttaggtacgtccgttccgtggttggtcggtcctcgtggtacttctacgtttcgaagttaagtggacgtggagttggtaggttcgggtcccgcggacggccgtacgggaagggggaacgggggcggggtaggttcggggttacggtaaccggttttaaagaaaaaaggttaaaagtggtaaggttaggtaaggtaaaagtaaaaacgttacggtaaccggttaacgggtacgaacccgtaaacccgggtaaaggaaaacgggtaactacgttaaccgaacctaacgttaccgtaacgaaaaggtaagtaaactttaaacgttaaaccgtaaaaaacggttcgggtttaagtttaacggtttaacgaaaccgtaaaaagttacggaaaaccgtaaccggttaaacccgtaaacgggaaaaaccccggtacgggaaacctaccggtaaccgtacccgttaatttaaccgttaacgtaaccgtaaccctaacggtaagtaaccggttacgggaacgtacgaacgtacgtaacggtaaacggtaaacggtacggtacttacggttgttagtttacgagttccggttaccgggacccgggtaacccgaagggtaaccttaagggttccggtttacccg

SEQ ID NO: 113042 - DNA, 622 bp, Homo sapiens
  misc_feature: GYAE6OF01AIIJV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatggagttgggtccgcaggctccgaggggaagggggcgtgggagtggggttggacggtttacgaaaagtaaaatgagtggtagaagaaaatagacgtacggtgcacccgtagaaaggaagattcaccatctagaagagtataattacgaaaacgtacggtagtaatttgacaaatagaacagacctagaaaccgagacacgacgccgtactattactagtaccactagtacttacggaagtgacgagtacggaaacggtaaaggacggtactatgttcgttttagaattacgtccggttacgggggaccccgtaaggggtaacgtaaggttcggg

SEQ ID NO: 113043 - DNA, 583 bp, Homo sapiens
  misc_feature: GYAE6OF01BWT77.15.86.H09.1.454.CMB.1.raw
  modified_base (415)..(415): a, c, t, g, unknown or other
  misc_feature (415)..(415): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcacttttcagtaatggctggatgagttgggtccgcaggctccgaggggaagggctggagtgggttggacgtttacaaaagtaaaatgatgggtagaagaaaatagactacggtgcacccggtgaaaggagattcaccatctacaaganataatacaaaacgcggtagtatttgactaaagtgaacagcctagaaaccgaggacacagccgtactattacctgtaacccatagtattacggaagtgcagtacgaacgtaaaggnggtctagtcgtcttttagattagtcgtacggggcccaaggggctaagttcggg

SEQ ID NO: 113044 - DNA, 596 bp, Homo sapiens
  misc_feature: GYAE6OF01AXZHE.15.86.H09.1.454.CMB.1.raw
  modified_base (345)..(345): a, c, t, g, unknown or other
  misc_feature (345)..(345): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgaggggaggggctggaggtgggttggacgtttanaaaagtaaaatgagtggtagagaaaatagacgtacggtgcaccgtaggaaaaggaagacttcaaccatactacaagagataaattacaaaaacggtacggttagtatttgacaaaagtcgaaacagacctagaaaaccgagaccacagcccgtattaattaccagtaaccacgaagtacttggaagtcactatacgaacggtaaaggcgatagtgtcttttgattgtcggtgggacccaggggcaagtcgg

SEQ ID NO: 113045 - DNA, 596 bp, Homo sapiens
  misc_feature: GYAE6OF01CYBMC.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagccttgggtaaagccgtggggggtcccttagagtctcctgtgtggcctctggattcactttcagtaatggctggatgagttgggtccgccaggctccagggaggggctggagtgggtgacgttcaaaagtaaaatgatggtagaagaaatagactacggtgcacccgtagaaaggaagactacaccatctacaagagaatatacaaaacgcggtagtattgactaatgaacagacagaaaccgagacacgacgcgtactattactagtaccacgagattcggaagtcgacatacggaacgtaaggacggtactagttagtccgtttttagaagtttacgtacggttacggggacccgtaacggggactaggttaccggg

SEQ ID NO: 113046 - DNA, 593 bp, Homo sapiens
  misc_feature: GYAE6OF01E3TEA.15.86.H09.1.454.CMB.1.raw
  modified_base (468)..(468): a, c, t, g, unknown or other
  misc_feature (468)..(468): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaggggctggagtgggttggacgtttacaaaagtaaaatgatggtagaagaaaatagactacggtgacacccgtagaaaggaagattcaaccatctacaagagataattacaaaacgtcggtatatttgacaaatgaacagcctagaaaccgngacacagcctctatactacgaccagagtagttcgaagtgacagtaccgaacggtaaaggaggtctagtggtcttttagaacttagtccggtacgggggaccccaaggggtaacctaaggttcggg

SEQ ID NO: 113047 - DNA, 618 bp, Homo sapiens
  misc_feature: GYAE6OF01CBT95.15.86.H09.1.454.CMB.1.raw
  modified_base (405)..(405): a, c, t, g, unknown or other
  misc_feature (405)..(405): n is a, c, g, or t
  modified_base (451)..(451): a, c, t, g, unknown or other
  misc_feature (451)..(451): n is a, c, g, or t
  modified_base (472)..(472): a, c, t, g, unknown or other
  misc_feature (472)..(472): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaagccgtgggggtcccttagagtctcctgtgtggcctctggatctactttcagtaatggctggatgagttgggccgccaggcctcgagggagggctgggagtgggttggacgtttagaaaagtaaaatgatggtagaagaaaatgaactaggtgacgaccgtagaaagagatacacgatactanaagagaataataacgaaaacgtacggtagtatttagaactaaatanaacagaccgtagaaaaccggngaacacagcctatattaccgtacgtaaccagtagtacgttacggaagttcgactacgtacgaacgggtaaaggagggtcttagttcggttactttaggatttacgtaccgggttacgggacccggacgggtaataacggttcgggg

SEQ ID NO: 113048 - DNA, 626 bp, Homo sapiens
  misc_feature: GYAE6OF01A9XNL.15.86.H09.1.454.CMB.1.raw
  modified_base (386)..(386): a, c, t, g, unknown or other
  misc_feature (386)..(386): n is a, c, g, or t
  modified_base (439)..(439): a, c, t, g, unknown or other
  misc_feature (439)..(439): n is a, c, g, or t
tcagtctacgtagccacgaccggtgctcgatttagtgctatagacttgggtttgggggagaggaggccccagccttgggatccccaagtgttttcattcagtgatcaggactgaacacagaggactcaccatggagttcgggctgagctgggtttccttgctgctatcttaaaaggtgtccagtgtgaagtgcaggtggtggagtcgtgggggagccgttggtaaagccgtggggggtcccttaggagtcgtccgtgtggtcggcctctggtattctactttcagtaagtggcgtggatgtagttggtaccgccgaggctccgagggaagggctggacgtgggtcgacgtttacaaagtaaatgatggtagaagaaatagagtagngacaccgtagaaaggagagtacacatctacaagagtataatacgaaagtcgtntaattgactaaagtagaactagaccgtagaaaaccggagaactaccgagacccgttcgtaaactcgtacgtacccaacgtagtacgttaggaagacgacgaactcggtaacggtaaaggcggtccgttaagtgttacgtttagatacggttccgtacgggaaccccgtagggactacggttaccggg

SEQ ID NO: 113049 - DNA, 654 bp, Homo sapiens
  misc_feature: GYAE6OF01BHT30.15.86.H09.1.454.CMB.1.raw
  modified_base (357)..(357): a, c, t, g, unknown or other
  misc_feature (357)..(357): n is a, c, g, or t
  modified_base (604)..(604): a, c, t, g, unknown or other
  misc_feature (604)..(604): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcccttagagtctcctgtgtggcctcgtggattctactttcagtaatggctggatgagttcgggtccgcgaggctccgaggggagggctggagtgggttggacgtttacgaaaagtaaaangagtggtagaagaaaatagacgtacggtgaccgaacccgtagaaaacggaagtattacgaacctaatctaacgaaagagtaataaacgttaaccaaaaacggtacggttagttaatttagaactaaaagtacggaaacacggacctaacggaaaaacccgaggaaccaacgacggtaccgttacttaacttaccgtacgtaacccaagtaagtacgttacggaagtgacagtacgaacggtaaaggnggtctagtgtctttagattacgtcgtacgggacccagggacctaggtcgg

SEQ ID NO: 113050 - DNA, 643 bp, Homo sapiens
  misc_feature: GYAE6OF01EIK7I.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgttagggtaaagccgtggggggtcccttagagtctcctgtgtggcctctggattcactttcagtaatggctggatgagttgggtccgccaggctccgaggggaggggcgtgggaggtgggttggacgtttacaaaagtaaaatgagtggtagaagaaaatagacgtacggtgacacccggtagaaaaggagattcaacatctacaaagagaattaattaacgaaaaacggtacggttagtaatttagactaaatagaaacagacctaaggaaaaccgagaaccacgacgtcccgtataacttacctacgtaacccagaagtacgttaccggaagtcgactagtacggaaacggtaaagggacggtcttagtcggttctttagattacgttcggacggggacccaaggggtactaaggttcggg

SEQ ID NO: 113051 - DNA, 796 bp, Homo sapiens
  misc_feature: GYAE6OF01DVSKW.15.86.H09.1.454.CMB.1.raw
  modified_base (712)..(712): a, c, t, g, unknown or other
  misc_feature (712)..(712): n is a, c, g, or t
  modified_base (739)..(739): a, c, t, g, unknown or other
  misc_feature (739)..(739): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagtcgttgggttttccttgctgtctatacttaaaaggtgtcagtgtagaagtgcgtagggtggtggagtcggtggggtagtccgttagggtaaacggtccggttcggggggttacccttaggtacgttccgttccgtggttcggtcggtccctgtggtacttctactttacaagtaagtggcgtggtagtaggtcggttcggtccgacgacggtccgtacgggaaggggacgggtcgtagggtaggttggggttacggtaacgtttaaagtaaaaaggtaaaagtgtaagtaggtaaagaaagtaaaagtaacggtaacggtaacggtacgaaccgtaaccggtaaaggaaaggtaacgtaacgttaccaactaacgtactaagaaagtaagtaaataaagttaaaccgaaaacggtgttagttaattacgaaataaagtacgaaacgacgttaccaaaacggaaaccgtacgaacacgtacgtccctttaataccgttaacgtacgtaaccgagttaagttacgtacggaactcgaacgttaaagtaacccggaaaagggttaacgnggtacctttaggttccgttacggttanaacgtttccggtaccgggttaccggggaacccgtaaagggttacttggggttaccgg

SEQ ID NO: 113052 - DNA, 957 bp, Homo sapiens
  misc_feature: GYAE6OF01CKDTN.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtcccttagagtctcctgtgtggcctctggattctactttcagtaatggctggatgagttcgggtccgcgtaggctccggagggaagggcgtggagtgggttggacgtttagaaaagtaaaatgagtggtagaagtaaaagtagtacgtacggtcgacgaacccggtaggaaaaggaagtacttaccgaaccgtaattaccgtaacgaaagtaacgtaattaaacgttaaaccgaaaaaacggtacgggtttaagttaacgttttaacgggaaacctaaaaagttacggaaaaaccgtaacggaacccccgttaaaacggggaaaaaaccccgggaaagggaaaccccgtaaacccggtaaacgggttacccccggtttaaaaccgtttaaacgtttttaaacccccgtttaaccgggttaaacccccgttaaaaccggtaaacgggtttaaaccggtttaaacccgggggtaaaacggtttaccgggaaacccgttaaacgggttaaacccggggtaaaaacccggggggtttaaaaaaaacggggtaccggggtttaaaccgtttaaaacggttttaccggggtttttaaaccgttttttttacggggaaaacgtttttaacccgggttaccccgggggttttaaaccggggggggaaaccccccccgggttaaaagggggttaaaacccgggtttaaaacgggttttccccggggggg

SEQ ID NO: 113053 - DNA, 610 bp, Homo sapiens
  misc_feature: GYAE6OF01B3QIW.15.86.H09.1.454.CMB.1.raw
  modified_base (544)..(544): a, c, t, g, unknown or other
  misc_feature (544)..(544): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggctgggaggtgggttggacgtttacgaaaagtaaaatgatggtagaagaaaatagactacggtgacacccgtagaaaggaagattacaccatctacaagagataattacaaaacgtacggtatatttgacaaatgaacagcctaagaaaccgaggacacacgccgtactattactcgtaaccacagtattacggaagtcgacagtaccgaaacggtaaagggnggtacttagtcgttcgttttagattagtccggtacggggaccccaggggtaacgtaacggttcggg

SEQ ID NO: 113054 - DNA, 687 bp, Homo sapiens
  misc_feature: GYAE6OF01D5A1L.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttggtccgccaggctccgaggggaagggcgtgggaggtgggtggtacgtttacaaaagtaaaagtgagtaggtagaagaaaatagacgtacggtcgacgaacccggtagaaaggaagtattacaaccatactacgaaagaagtaattaaacttaacaaaaacggtacggttagttaatttacgaactaaagtacgaaacaacgacctaaggaaaacccggagaaccaaccgacgcccgttacttaacttaaccgtacgtaacccacgtaagtaacgtttacgggaaattcggaccaagtaccggtaaacggtaaaagggacggtcttagtcggttacgttttagacttaacggtccggtacggggaccccgaaggggtaactaaggttccggg

SEQ ID NO: 113055 - DNA, 540 bp, Homo sapiens
  misc_feature: GYAE6OF01B0AB1.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatgcagccacaccgaaggggacggactcccgatcgcttcagtggctccagttcgtgggctcgaccgctaccgtcaccatcctaccaaccctccagtctgacgatgagctgagtactcgtacgtggtaggagagacgaccacaacattgagtggaccgaaggtacgggttgggttggtcgggcgggaacgggaccaacgcgtacgaccgtccgtggtcgaccgg

SEQ ID NO: 113056 - DNA, 663 bp, Homo sapiens
  misc_feature: GYAE6OF01D5CTE.15.86.H09.1.454.CMB.1.raw
  modified_base (344)..(344): a, c, t, g, unknown or other
  misc_feature (344)..(344): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctccgtgtgtggcctctggattcactttcagtaatggctggatggagttgggtccgccaggctccgagggagggctggagtggttgtacgttanaaaagtaaatgatggtagaagaaaagtagacgtacggtgacgacccggtagaaaggagtacttacgaacatctacaagagtaataattaacgaaaaacggtcggttagttaactttagaactaaaagtacgaaacacgacctaaacggaaaaccgtaggaaccaaccgacggtacccttactaacttaccgtacgtaacccacgtaagtaaggttaccggaagtcgacaagtaccggtaaacggtaaagggtacgtacttagtaggttctttaggaattacgtacgggtcgggaacccgagggtaacctagttaccggg

SEQ ID NO: 113057 - DNA, 609 bp, Homo sapiens
  misc_feature: GYAE6OF01D2XVT.15.86.H09.1.454.CMB.1.raw
  modified_base (505)..(505): a, c, t, g, unknown or other
  misc_feature (505)..(505): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttggtccgccaggctccgaggggaaggggctggaggtgggttggacgtttacaaaagtaaaatgaatggtagaagaaaatagacgtacggtgacaacccgtagaaaggaagattacaccatctacgaagagaataatacgaaaaacgacggtagtatttagaacaaatagaaacgacgacccgaaaacgagaacacacgccgtatattacncgtaacacaagtacttaggaatgactaagacgaacgtaaaggagtacgtagtgtctttagaattagtacggtcggggacccaagggacctaagtcgggttaccg

SEQ ID NO: 113058 - DNA, 582 bp, Homo sapiens
  misc_feature: GYAE6OF01BCMRF.15.86.H09.1.454.CMB.1.raw
  modified_base (535)..(535): a, c, t, g, unknown or other
  misc_feature (535)..(535): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggaggggctgggagtgggttggacgtttacaaaagtaaaatgatggtagaagaaaatagactacggtgacacccgtagaaaggaagattcaccatctacaagagaataattacaaaacgtacggtagttatttagacaaatgaaacagcctagaaacccgaggacacacgccgtactaattacagtaccacgtagattacggaatgacagtacgagtaaaggngtctatgtctttgattagtcgtacggggacccagggactaagtcggg

SEQ ID NO: 113059 - DNA, 604 bp, Homo sapiens
  misc_feature: GYAE6OF01ACBQL.15.86.H09.1.454.CMB.1.raw
  modified_base (352)..(352): a, c, t, g, unknown or other
  misc_feature (352)..(352): n is a, c, g, or t
  modified_base (409)..(409): a, c, t, g, unknown or other
  misc_feature (409)..(409): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (497)..(497): a, c, t, g, unknown or other
  misc_feature (497)..(497): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttgggtaaagccgtggggggtcccttagagtctcctgtgtggcctctggattcactttcagtaatggctggatggagttggtccgcaggctcgagggagggcgtggagtgggttggacgtttacaaaagtaaangatggtagagaaatgacgtacggtgaccgaccgtagaaaggagtactcaccatctanaagagataatacgaaaacgtcggtatatttgactaaatgaacagacctagaaacccgngaccanacgcctactattactgtacccaanacgtattacgggaagttcacgtaagtcgaaacggtaaggacggtacctagttacgtcttttaggacttagtaccggtacggggaccccaaggggtcctaaggtcggg

SEQ ID NO: 113060 - DNA, 788 bp, Homo sapiens
  misc_feature: GYAE6OF01C7RA9.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaggtgtccagtgtgaagtgcgaggtggtggagtcgtggggagtccgttaggtaacgccgtgggggtcccttagagttctcctgtgtggcctcgtggattctactttcgagtaatggcgtggtatggtaggttcggtccgcgaggctccggaggggaaggggctgggaggttgggttacggtacgtttaagaaaaagtaaaagtgtagtaggtagaaagaaaagtagaacgtacggtcgaccgaacccggtaaggaaaggaacgtacttaccaacctagtacctaacgaaaggtaaagtaacttaaaacgttaaccgaaaaaaccggttacgggtttaagtttaaacgtttacgaaaaccttaaaagtacggaaaaccgtaacggtacccgtaaacgggaaaaaaccccgacggaaaccctaaccgaaccgttacccgttaactttaaacgtttaaccgtaccggtaaaccctacgtaacggtaacgttacccggtaaggtcgaactaacggttaaccggaaacgggttaaagggcgtacttagttcgtttaccgttttagaacgttacggtaccgggtaccgggacccgttaaagggacctaaggttccggg

SEQ ID NO: 113061 - DNA, 596 bp, Homo sapiens
  misc_feature: GYAE6OF01DSBRN.15.86.H09.1.454.CMB.1.raw
  modified_base (521)..(521): a, c, t, g, unknown or other
  misc_feature (521)..(521): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgaggggaaggggctgggaggtgggttggacgtttacaaaagtaaaatgatggtagaagaaatagactacggtgacacccgtagaaaggaagtattacaaccatctacaaagagaataattaaccgaaaaacgtcggttagtaatttagaactaaatagaaacagacctagaaaacccgaggacacgagccgtatattacctgtaaccanagtattcggaagtgacatacgaacgtaaggagcttatggtctttagatagtcgtacgggcccagggctaagtcgg

SEQ ID NO: 113062 - DNA, 613 bp, Homo sapiens
  misc_feature: GYAE6OF01EYC4R.15.86.H09.1.454.CMB.1.raw
  modified_base (478)..(478): a, c, t, g, unknown or other
  misc_feature (478)..(478): n is a, c, g, or t
  modified_base (557)..(557): a, c, t, g, unknown or other
  misc_feature (557)..(557): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagccgtggggggtcccttagagtctcctgtgtggcctctggattcactttcagtaatggctggatgagttggtccgccaggctccgagggaaggggctggaggtgggttggacgtttacaaaagtaaaatgagtggtagaagaaaatagactacggtgcacccgtagaaaggaagattacaccatctacaagagattaattacaaaaacggtacggtagtatttgacaaaatgaaacagacctagaaaacccgnggaacacgacgtccgtactaattacctagtaacccagtaagtacttcgggaagtcacaacgtacgtaaacggtaaaggnggtacttagcgttcttttagattagtccggtacgggacccagggtactaagtcggg

SEQ ID NO: 113063 - DNA, 629 bp, Homo sapiens
  misc_feature: GYAE6OF01C5BYX.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccgccaggctccgagggaaggggctgggagtgggtggacgtttacaaaagtaaaatgaagtggtagaagaaaatagactacggtgcaacccgtagaaaggaagatcaccatacacaagagataataacaaaacgaggttattagttagacaaatagaaacagacctaggaaaaccgaggaacacgacgcccgtatattaacgtgtaacccagtagtacttacgggaagtcgactaacgtcggaaacggtaaagggacggtactagttacggttcttttagattacgtccggttacgggggacccctaagggggaactaaggtttccgggg

SEQ ID NO: 113064 - DNA, 592 bp, Homo sapiens
  misc_feature: GYAE6OF01EVKUF.15.86.H09.1.454.CMB.1.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcggtggtttcgtgacgtgctatagtaaagtgtcagtgtgaagtgcaggtggtggagtctgggggagccttggtaaagcctggggggtcccttagagtctcctgtgtggcctntggattcactttcagtaatggctggatgagttgggccncaggctcagggaaggctggagtgggtgacgttnaaaagtaaaatgatggtagaagaaaatgataacgtgacaccgtgaaagganaacttcacatcanaagagaataatacaaaacgagtatacgttananaananaacacgacgaacgaacgaacgacacgacgactactactactacgtacactacgtacgtacgtaagtacgacgtacgtacggtaacggtaaaggtaacggtacgtagttagttagttagtagtacgttacggtacggtaccggaacggtacgtaagtacgg

SEQ ID NO: 113065 - DNA, 721 bp, Homo sapiens
  misc_feature: GYAE6OF01CMOSD.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgagtgcaggtggtggagtcgtgggggagccgttggtaaagccgtgggggtcccttagagtctcctgtgtggcctctggattctactttcaagttaagtggctggatggtaggttcggggtccgccgaggcctccggaggggaagggggcgtgggaggtgggttggacgtttacgaaaagtaaaatgagtggagaagaaaatagacgtacggtgaccacccggtaggaaaggaagacttaccaacctatactacgaaagtagtaattaacttaaccgaaaaacggtcggttacgttaagtttaggaactaaagtaggaaaccgagtaacccgtaaaggaaaaacccggaggaaccaacgacggtacccgttaacttaactttaaccgtacgtaacccaacgtaagtacgtttaccgggaagtcgacgtaacgtaaccggaaacggtaaagggccggtacgttaagttcggttcgttttaacgagtttaccgtacgggtacggggaccccgaaggggtaccgtaaggttcccggg

SEQ ID NO: 113066 - DNA, 755 bp, Homo sapiens
  misc_feature: GYAE6OF01BJUNJ.15.86.H09.1.454.CMB.1.raw
  modified_base (350)..(350): a, c, t, g, unknown or other
  misc_feature (350)..(350): n is a, c, g, or t
  modified_base (388)..(388): a, c, t, g, unknown or other
  misc_feature (388)..(388): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaacgccgtgggggtcccttaggacgtctccgtggtgtggcctcgtggattcgacttttcagtaatggactggatgagttggtccgccaggctccgaggggagggctggaggtggttggacgtttanaaaagtaaaatgaagtggtagaagaaatagactacggngacgaacccggtaggaaacggaagtacgttacaaccgtatactacgaaacggtagtaattaacgttaacgaaaaacggtacgggttattaacgtttagaactaaaagttacggaaacgtacggtacccgtaaacggtaaaaacccggaggtaaaccgaccgtaaccggtaccgttaccttaacttaccgtacgtaacccgaagtaccggtaaagttaccgggaaagttcgaacgtagtaacccggaacggttaaaaacgggcggttaacttaaggtcggtttaaccgttttcgggaaacttttaacccggtacggttacccggggggtaaccccgtaacgggggtaaccttaaacggggtttccggg

SEQ ID NO: 113067 - DNA, 641 bp, Homo sapiens
  misc_feature: GYAE6OF01EZ1PB.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggagggctggaggtgggttggacgttcaaaagtaaaatgatggtgaagaaatagactacggtgcaccgtagaaagagatcacatctacaagagaataattacgaaaaaacgtacggtagtaagtttgactaaaattaggaaacaaggacccttaaggaaaaacccgaggaaccacgaaggtacccgtctaacttacttagtaacccaagtaacgagttaccgggaagttcgactaagtaccggaaacggttaaaagggacggtcgttaagtcggtactttttaggacttaagtccgttagggggacccctaagggggactaaaggttcggg

SEQ ID NO: 113068 - DNA, 610 bp, Homo sapiens
  misc_feature: GYAE6OF01ENVOM.15.86.H09.1.454.CMB.1.raw
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (382)..(382): a, c, t, g, unknown or other
  misc_feature (382)..(382): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtctgcatctgccttgcgtgggagcctcgatcaagctcacctgcaacctaagtagtgagcactaccgaacctacaccatcgaatggtatcaacagagaccgagggaacgtccccccgagtatataanacgaaagttaagagtgatgcagccacgacggaaggggacggacnccgancgtctcagtcggctcgagttcgngggtctgaccgtctacctccgacctcgtccctacccaaccctccacgtactgaaccgtagtagacggtcgtagacgttactacacgttgggtaggaacgaggtaacgcccaacaacgtaagttcgaagtcggaacgtaacgggtcggggtttcgggttggtacggggtacgggaccgggaaaccgaggtcccgtacggtacccggtccgtacggaccgtaaccccggg

SEQ ID NO: 113069 - DNA, 783 bp, Homo sapiens
  misc_feature: GYAE6OF01D0CVD.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtggggagtccgttaggtaaacgccggtcgggggtcccttaggacgttcgtccgtggttgtcggtcctcgtggtactttccgtacttttacgaagttaagtggtcgtggagtggtaggttcggggtccgccgaggccgtaccggaaggggacggggcgtgggaggttgggttaggtaacgtttaacgaaaaagtaaaatgagtaggtaagaagaaaagtagtacgtacggtacgaccgaaccggtaggaaaaggaagtaacgttaccaacctaactacgtaacgaaagaacgtaaattaaacgttaaaccgaaaaacggtacgggttattaagtttacgaaactaaaagtacgtaaaacgacgtaaccgtaaacggaaaaacccggagtaacccaaccgtacggtacccgttacttaaactttacgtaaccgtaaccaagtaacgttacgttaacgggaagtcgactaacggtacggaaaggttaaaggcgtacgttaagttcgttagttttaggaactttacggttcccgggtacggggaacccccgtaagggtaaccgtaggtttccgggg

SEQ ID NO: 113070 - DNA, 632 bp, Homo sapiens
  misc_feature: GYAE6OF01AUGAK.15.86.H09.1.454.CMB.1.raw
  modified_base (414)..(414): a, c, t, g, unknown or other
  misc_feature (414)..(414): n is a, c, g, or t
  modified_base (468)..(468): a, c, t, g, unknown or other
  misc_feature (468)..(468): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttcctgctgctatcttaaaaggtgtccagtgtgaagtgcaggtggtggagtctgggggagccttggtaaagccgtgggggtcccttagagtctcctgtgtggcctctggattcactttcagtaatggctggatgagttggtccgcaggctccgagggaaggggctgggaggtgggttcggacgtttacaaaaggtaaaagtgagtggtagaagaaataggactacggtgaccgaccgtagaaagagatcacatctacaganataatacaaacgacggtagtattagactaaagtgaacagaccgaagaaaaccgngaaccgacacgccttacgtaacttacgtactaccaagacggtaagttaccgaagtacgactagtacgaaacggtaaagggagggaccttaaggtcgttaccgttttagtagtttaacggtccggttacgggggtaccccaaaggggttaccgaacgttacgggg

SEQ ID NO: 113071 - DNA, 671 bp, Homo sapiens
  misc_feature: GYAE6OF01BK0YW.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtccttagagtctcctgtgtggcctctggattcactttcagtaatggctggatggaggttgggtcccgccgaggcctccgaggggaaggggcgtgggaggtggggttggtacgtttacgaaaagtaaaatgagtggtagaagaaaagtagacgtacggtgacacccgtaggaaaaggaagtacttacacctatactacaaagagtaataattaaccgaaaaacggtacggttattaagtttacgaactaaaagtgaaacacggtacctaacggaaaacccgaggaaccaccgacgtcccgttactaacttacctacgtaacccaagtacgtagttacggaagtcgactacgtacggaaacgtaaagggcgtacttaagtcggttcttttagaattacgtcgggtacgggggtaccccaaggggtacctaaggtcggg

SEQ ID NO: 113072 - DNA, 652 bp, Homo sapiens
  misc_feature: GYAE6OF01DKNPF.15.86.H09.1.454.CMB.1.raw
  modified_base (328)..(328): a, c, t, g, unknown or other
  misc_feature (328)..(328): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtggtggagtcgtggggagccgttggtaaagccgtggggggtcccttagagtctcctgtgtggcctctggattctactttcagtaatggctggatgtagttgggtccgcaggctcgagggaagggctgggnggtgggttggacgtttacgaaaagtaaaatgagtggtagaagaaaatagactacggtgacacccgtagaaaggagtatacactatctacaagagaataacgttaacaaaaacggtacggttagttaagtttgaactaaagtagaaaccgagtacccgtaaggaaaacccggacggaaccaaccgacgtacccgttataacgtttacgtacgtaacccacgtaagtacgttcggaagtcgactagtacggaacggtaaaggcgtacgttagtcgttcgtttagacgttagtccggtacgggacccgaagggtactaggttccggg

SEQ ID NO: 113073 - DNA, 701 bp, Homo sapiens
  misc_feature: GYAE6OF01BNHYT.15.86.H09.1.454.CMB.1.raw
  modified_base (665)..(665): a, c, t, g, unknown or other
  misc_feature (665)..(665): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagccttgggtaaagccgtgggggtcccttagagtctcctgtgtggcctctggattcactttcagtaatggctggatgtagttgggtccgccaggctccgaggggagggctagggaggtgggttggacgtttacgaaaaagttaaaaatgaagtggtagaagtaaaagtagaacgtacggtagaccgtaacccggtaagaaaagggaacgtaacttaccgaacccgtaataccctaacgaaagtaaagtaaacttaaacttaaaccgaaaaacggttacgggttaagttaagttttagaaacctaaaagtacgaaaactaacggaccctaaaggaaaaacccggaggaaccaacgaacgtacccgttaacttaacttaaccgttacgtaacccaagtaacgtaagttaccgggaagtgaccagtacggaacgtaaaggcgtctagttgtntttagattacgtcgacgggacccagggactaggtcg

SEQ ID NO: 113074 - DNA, 681 bp, Homo sapiens
  misc_feature: GYAE6OF01C6FUF.15.86.H09.1.454.CMB.1.raw
  modified_base (397)..(397): a, c, t, g, unknown or other
  misc_feature (397)..(397): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccttggtaaagccgtgggggtcccttagagtctcctgtgtggcctgtggattcactttcagtaatggctggatgaggttgggtcccgccaggcctccggaggggaaggggctgggtaggtgggttacggacgtttacgaaaagtaaaagtgagtggtagaagaaaatagacgtacggtnactagtaccggtagaaaggatactacactatactacaagagtaataattaacgaaaacgtcggtagttaattacgaactaagtacgtaaacgacgtaccgtaaggaaaacccgagggaacccacgtacggtcccgtacttaacgttacgtaccgtaccaacgtagtacgttacggtagtacgactaacggtacggtaaaccgtaaaggggtaccgtacgttacgttcgttacggtttacgtagttacgttcggtaccggggcccgtaagggtacgttaaccggg

SEQ ID NO: 113075 - DNA, 787 bp, Homo sapiens
  misc_feature: GYAE6OF01B9B4S.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggttttccttgctgctatacgttaaaggtgtcagtgtgaagtgcgaggtggtggagtcgtgggggagtccgttagggtaaagccggtgggggtcccgttaggtcgttccgtcgtggtggtcggtccttcgtggtacttacttacttagtaagttagtggtgtaggtagtaggttacggtccggtccgaccggacggtccgtacggggaaggggacgggtcggtagggtagggttgggttacggttaacgttaaaacgtaaaaagtaaagtagtagtaggtaagaaaagtaacgtaacgtacgtacggtacgaaccgtaacggtaaggaaaggtaacgtaactacaactactactagaaacgtaataaagttaacgaaaaccgtaaacggttggttagtttaacgtagaaaacgttaaacgaacaaaccgaccgtaacccgaaaaaacggaaacggaccgaagacccgtacggttaccttaattaacgttcaacccggaaccaagttaacgttacggtaacggacgtgtaacccgtaaggaacccggtaaagggtaagacgttaccgttattcggtttacgtaagtaacgtccggttccgggggaaacccgtacggaaagtaaacgtttcggtccggg

SEQ ID NO: 113076 - DNA, 588 bp, Homo sapiens
  misc_feature: GYAE6OF01A5DTY.15.86.H09.1.454.CMB.1.raw
  modified_base (410)..(410): a, c, t, g, unknown or other
  misc_feature (410)..(410): n is a, c, g, or t
  modified_base (465)..(465): a, c, t, g, unknown or other
  misc_feature (465)..(465): n is a, c, g, or t
  modified_base (531)..(531): a, c, t, g, unknown or other
  misc_feature (531)..(531): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttggtccgcaggctcgaggggagggctggagtgggttggacgtttacaaaagtaaaatgatggtagaagaaaatagactacggtgacaccgtagaaaggagattacacatctacaaganaataatacaaaacgtacggtatatttagacaaatgaacagacctaagaaaaccgngaacacgagccgtactattactagtacccatagacttcggaagtgcaagtacgaacggtaaaaggnggtactagtgtcttttagattacgtcgtacggggaccctaagggaactaggttcggg

SEQ ID NO: 113077 - DNA, 637 bp, Homo sapiens
  misc_feature: GYAE6OF01DAN4G.15.86.H09.1.454.CMB.1.raw
  modified_base (217)..(217): a, c, t, g, unknown or other
  misc_feature (217)..(217): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (479)..(479): a, c, t, g, unknown or other
  misc_feature (479)..(479): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggganccttggtaaagccgtggggggtcccttagagtctcctgtgtggctctggatcacttcagtaatggctggatgagttgggtccgccaggctccgagggaggggctgggagtgggttggacgttttacgaaaagtaaaatgatggtgaagaaaatgactacggtcgacgacccgtagaaaggaagattacgaccatctacaagagataattacaaaacgtcggttagtatttagacaaagtnaaacngacctaggaaaacccgnggaacacgacgccgtactaattaaccgtagtaaccaactaggtacttacgggaagtgactaacgtacggaaccggtaaaagggcgtacttaagttcggtccttttttagacttaacgttccggagggggtacccccaaggggtaccaaggtttccggg

SEQ ID NO: 113078 - DNA, 702 bp, Homo sapiens
  misc_feature: GYAE6OF01DJYPS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtggggagccgttggtaaagccgtgggggtccctagagtctcctgtgtggcctctggattctactttcagtaatggctggatgtagttggtccgccgaggctaccggagggaagggcgtggaggtgggttaggtacgtttaacgaaaaagtaaaatgaagttaggtagaaagtaaaagtagacgtacggtgaccgaccgtagaaaggtaagtactacacctatctaacgaagtaagtaattaaacgttaacgaaaaacggtcggttagttaagtttacgaataaaacgtagaaaccgtacgtacccgtaaggaaaaacccggaggaaccaaccgtaacgtacccgttataacgtttaacctacggttaacccaagtaagtacgtttacggaagttagacgtaagtaccggaaacggtaaacggaggtacttagtgttaccgttttagacttacgtccggtacgggacccgtaaagggtactaaggttccggg

SEQ ID NO: 113079 - DNA, 637 bp, Homo sapiens
  misc_feature: GYAE6OF01D7T5P.15.86.H09.1.454.CMB.1.raw
  modified_base (496)..(496): a, c, t, g, unknown or other
  misc_feature (496)..(496): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctcgtggattctactttcagtaatggctggatgagttgggtccgcaggctccgaggggaggggcgtgggaggtggggttggacgtttacgaaaagtaaaatgagtggtagaagaaaagtagacgtacggtgacgacccggtaggaaaggagacttacacctatctagaagagaataagtacaaaacggtcggtattatttagactaaatgaaacacgaccgtaaaggaaaaccggngaacacgacgtacccgttactaacttacctacgtaacccaagtagtacgttacgggaagtcgactacgtacgaaacgtaaaggcgtcttatcggttctttagattacgtcggtacgggacccgaagggtacaggttccggg

SEQ ID NO: 113080 - DNA, 671 bp, Homo sapiens
  misc_feature: GYAE6OF01A15G8.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaagccgtgggggtcccttagagtctcctgtgtggcctctggattcactttcagtaatggctggatgagttgggtccgcgaggctccgaggggaaggggcgtgggaggtgggttggacgtttacgaaaagtaaaatgagtaggtagaagaaatagacgtacggtgaccgaccgtagaaaggaagattacacatactacgaaagagaataattacgaaaaacgtcggttagttaatttgaactaaatcgaaacgacgaccgtaaggaaaaccgagaaccacgtacgtacccgttacttaacttaaccgttacgtaaccgacgtaagttacgttaacgggaagtacgacgtaacgtaccgggtaaacggtaaaagggacggtacttatcgggttacttttagaacttacggtccggtacggggaccccgtaaggggtactagggttacggg

SEQ ID NO: 113081 - DNA, 756 bp, Homo sapiens
  misc_feature: GYAE6OF01C90OE.15.86.H09.1.454.CMB.1.raw
  modified_base (688)..(688): a, c, t, g, unknown or other
  misc_feature (688)..(688): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgtattttccggatttgcctaggaaaaccacgccctacccgacgttaaaccgggacaaccgtccgcccggccaacatacgccttcctcccgtcccccttcgcagtaacaccaagtacaggaatattaacctgttccatcgactacgcctttcgcctcgccgttagggtcactccacctcgccccgtattaacgtggaccacggtaacccttggtccttccggcgacggtccgggtccttttccgaccccgttcttttactcgtttaacttatcgtacacgtctacgttccgactaccgtttctaggtaccttaccctaccgagtcctacgtccgaccctaccaactacgacctaacctacccgttacaaccgtaacggttaccttaaccgaacgtaacccgtacccctacccccctaaacccaaaccaaccgtacctaacgttaacggtcccgtaccgtacccgtcgacccgtacgtacggttccgttacggtgtaccgttacggtttccgggttttaccccggtcccccgtttanaccctttccccgttaccccgaccttaacgtcccgttacgaccggttacctaacgggtacgtaaccggg

SEQ ID NO: 113082 - DNA, 819 bp, Homo sapiens
  misc_feature: GYAE6OF01D8VI9.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtgggggagtccgttagggtaaacgccggtcggggggttcccttaggacgtctccgtggtgtcggtcctcgtggtacttctacttttcagttaagtggctggatggtaggttcgggtccgccgaggtccgtaccggaggggaaggggtcgtaggggtaggttggggttagggtaacggttttaaacgaaaaaaggttaaaaagttggtaagttagggtaagtaaaaggtaaaaagtaggtaaaccgttaacgggtacgaaccgtaaacccggtaaggaaaaacgggtaaacggtaactttaccgaaacctaacgtaccgtaacgaaagtaaagtaattaaaacgttaaaccgaaaaaaccggttacggttaagtttaagtttaacgaactaaaaagttacgaaaacctacgaacccgttaaaggaaaaacccggacggaaaccaaccgtacggtacccgttaacgtaacttaccgtaacgtaaccacgtaacgtaacgttacggaacgtcgtacgaacgtacggaaacgtaaagggacggtacttaaggtcgtttacgtttagaacttacggtccggtacggggaccctaagggtaacttaaggtccgg

SEQ ID NO: 113083 - DNA, 652 bp, Homo sapiens
  misc_feature: GYAE6OF01BINZP.15.86.H09.1.454.CMB.1.raw
  modified_base (186)..(186): a, c, t, g, unknown or other
  misc_feature (186)..(186): n is a, c, g, or t
tcagtctacgtagccacgaccggtgctcgatttagtgctatagacttgggtttggggtccactgggcagtctcgaatagagctcttggaagtccctccaaccatggccctgggtctccttctacctactgcccttcattttctccacaggtctctgtgctctgcctgtgctgactcagcccccgtntgcatctggccttgctggggacgcctcgatcaagctcacctgccaccctaagtagtgagcatcgaacctacaccatcgaatggtatcaacagagaccagggaacgtccccccagtatataatgaaagttaagagtgatggcagcacacgaaggggacggatcccgatcgcttcagtgggctccgagttccgtggggctgaccgctacctcaccactcctacccaaccctccacggtcctggacgattgacggctgacgttatccaagtcggtggagaggtacgacccaagaacctaattaggtacgtcgggacccgaaaggggttaacccggggtttgggggtttacggggttaccgggggttccgggggaaacgggggtaaaccccggtaaacgggttaccggttaacccggggtaaccccgggtttccccggttaaacgggggtttcccgtaaacccccggggg

SEQ ID NO: 113084 - DNA, 774 bp, Homo sapiens
  misc_feature: GYAE6OF01DM7OE.15.86.H09.1.454.CMB.1.raw
tcagtctacgtagccacgaccggtgctcgatttagtgctatagacttgggtttgggggggagaggagccccagccttgggatccccaagtgttctcattcagtgatcaggactgaacacagaggactcaccatggagttcgggctgagcttgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgaggttcgggccgcgacggctccggagggaggggcgtgggaggtgggttggtacgtttacgaaaaagttaaaatgagtggtagaagaaaagtagaacgtacggtagacgacccggtaggaaaacggaagtaacttacgacctatactacgaaagagaattaaacttaacgaaaaaacggtacgggttagtttaagttttacgaacgtaaagtaacgaaaccgtaacgacccgtaaacggaaaaaccccggaaggaacccaaccgtaacggtacccggtttaacttaaccgtttaacccgttaagtaacccctaacgtaacggtaacgtttacgggaagtacggtaacgtaacgttacgggaaaaccgggttaaaaggggtaacgggtacgtttaaggttcggttaccgttttttaggaaacgtttacggttaccggggttaccggggggaccccggtaaagggggtaacccttaaacgggg

SEQ ID NO: 113085 - DNA, 638 bp, Homo sapiens
  misc_feature: GYAE6OF01BDSOB.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtcgtgggggagccttggtaaagcctgggggtccttagagtctcctgtgtggctctggattcactttcagttaatggctggatgtaggttggtccgccaggcgtccgaggggaaggggcgtgggaggtgggttggacgtttacgaaaagtaaaatagagtaggtagaagaaatagactacggtagcacccgtagaaaggagatcacatactacaagagataatacgaaaaagtcggttagtactttaggactaaaagtgaaacgacgtacctaagaaaaccggacggaacaacgacgtccgtacttaacgttactacggccaatagtacttacgggaatgacagtaccgaaaggtaaagggtacggctttaagtcgtactttttaggaattacgtccggtcgggggacccctaaggggactaagggttccgg

SEQ ID NO: 113086 - DNA, 628 bp, Homo sapiens
  misc_feature: GYAE6OF01EEESG.15.86.H09.1.454.CMB.1.raw
  modified_base (182)..(182): a, c, t, g, unknown or other
  misc_feature (182)..(182): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgatttttccggatttgcctaggaaaaccngcctacccgcttaaaccgggacaaccgtcgcccggcaacatacgccttctcccgtcccccttgcagtaacaccaagtacagaatattaacctgtttcccatcgactacgcctttcggcctcgccttaggggtcactcaccctgccccgtattaacgtggacacggtaacccttggtcttccggcgacggcggtcttttcacccgtctttatcgttacttatcgtcagctattcgctacttctgtactcctccagcatcgcctcacagcactacccttcaacgacggtaccttaacgacgaacccgccctaccccctaacccgaacaacgacctaataaccggccgtcgctcgccgctacgtcgttcgngtctagttcgtttaccgccccgtttacaccttcccttcccgaccttacttccgtagtaccgtcttaccggtagtacgg

SEQ ID NO: 113087 - DNA, 736 bp, Homo sapiens
  misc_feature: GYAE6OF01B3CCY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtggggggtcccttagagtctccgtgtgtggcctctggattcactttcagtaatggctggatgagtggtcgcagctcgaggaggctggagtggtgacgttacgaaaagtaaaatgagtggtagaagtaaaaatagaacgtacggtgacgtaacccggtagaaaaggaagacttacgaacctagtactacgaaagacgtaattaaacttaacgaaaaaacggtacggttagttaagtttagaactaaaagttagaaaacgtacgaaccgtaaacggaaaaaccggacggaaccaacgaaccggtaccggttaccttaagtttaacccgtacgtaacccaacgtaacgtaacgttaaccggaaaggttacgaccgtaagtaacccggtaaacggtaaaacgggacggtaccgttaagttacggttaccgtttttaaggaactttaacggtaccgggttaccgggggaacccccgtaaggggtaaacccgttaaaggtttacccggggg

SEQ ID NO: 113088 - DNA, 949 bp, Homo sapiens
  misc_feature: GYAE6OF01C3JZB.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagtccgttagggtaaacgtccggtacgggggggttccccttaaggacggttccttcccgttgggtcggtcggggtcccttacgtgggtaacttccttaccttttacgaacgttaagtgggtcgttagggtaagttaggtacggtttcggggtcccgaccgacgggtcctacccggaaggggggtaaacgggggtcctaaggggtacggtttgggggtttacgggtaaccgttttaacggaaaaaaaggtttaaaaaagtggtaaaggttagggtaggtaaaaggtaaaaaagttaaggtaaaccgttaacgggttacggacccgtaaaaccccgggttaaagggaaaaacgggtaaaacggttaacgtttaaccgaaacccctaacgttaaccgttaaccgaaaaaggtaagtaaaactttaaacgtttaaaccgaaaaaaccggttaccgggttaacgttaagttttaccgaaaacgtaaaacgttaacgaaaaccgtaacgtaccgttaaaacgggaaaaacccggaaggaaccaaaccggtacggtacccgttaataacgtttaaccgttacgtaaccccgtaaagtacggtaagttaccgggtaagtaccgtaacgtaacgtaaccggtaaaccgggtaaagggacgggtacttagttacggtttagttttaacgagtttacgttccgggtaacgggacccgtaaacgggacgttaacggttaccgggg

SEQ ID NO: 113089 - DNA, 591 bp, Homo sapiens
  misc_feature: GYAE6OF01BYU8W.15.86.H09.1.454.CMB.1.raw
  modified_base (350)..(350): a, c, t, g, unknown or other
  misc_feature (350)..(350): n is a, c, g, or t
  modified_base (576)..(576): a, c, t, g, unknown or other
  misc_feature (576)..(576): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttaggagtctcctgtgtggcctctggattcactttcagtaatggctggatgacttgggtccgccaggctccgaggggagggctggagtgggtgccaccataacaaaagntaggaagtgacacaacctagtgtagaactcgtagtgaatcggggaccgtattccaccgtctaccaggacgacgacgccaaacgactacaactacatctagactaaagtgaaacctaacctgaagacgacccgaaggaccgacggtcctaggtacgtaattacgtggtcgtagagtagattggtcgtggcgggttgggcccaggggaacccttggtccgaccgttcnccctcgcgtaccccg

SEQ ID NO: 113090 - DNA, 619 bp, Homo sapiens
  misc_feature: GYAE6OF01CN970.15.86.H09.1.454.CMB.1.raw
  modified_base (350)..(350): a, c, t, g, unknown or other
  misc_feature (350)..(350): n is a, c, g, or t
  modified_base (472)..(472): a, c, t, g, unknown or other
  misc_feature (472)..(472): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaaagccgtggggggtcccttagagtctcctgtgtggcctctggattcactttcagttaatggctggatggagttgggtccgccgaggctccgagggaaggggctgggagtgggttgacgtttanaaaagtaaaatgagtggtagaagaaaatagactacggtgaccacccgtagaaaggaagatcacatcgtacaagagaattaataacaaaaacggtcggttagtatttagacaaagtagaaacngaccgtaagaaaccgagacacacgccgtactacttactagtaccaacgtagtattacgggaatgacagtcgaaacggtaaggacggtctaattgtaccgttttgaattacgttcggacggggtacccaaagggtctaaggttccggg

SEQ ID NO: 113091 - DNA, 596 bp, Homo sapiens
  misc_feature: GYAE6OF01CHNQR.15.86.H09.1.454.CMB.1.raw
  modified_base (374)..(374): a, c, t, g, unknown or other
  misc_feature (374)..(374): n is a, c, g, or t
  modified_base (410)..(410): a, c, t, g, unknown or other
  misc_feature (410)..(410): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtccttagagtctcctgtgtggcctctggattcactttcagtaatggctggatggaggttcgggtccgcaggctcgagggaagggctggagtggtgacgttacaaaagtaaaatgagtggtagaagaaatgactacggtnacgaccgtagaaagagtactacacatctacaagtanataatacaaaacgtcggtagtattgactaaagtgaaacagacctaaggaaacgtacggacacgacgtcgtactacttacacgtaccaacgtagtacgtacggaagtgaactagtacggaaacggtaaggacgtctagtcgttactttagattacgtacggtacgggacccaggtactaaggttcgg

SEQ ID NO: 113092 - DNA, 713 bp, Homo sapiens
  misc_feature: GYAE6OF01CP97N.15.86.H09.1.454.CMB.1.raw
  modified_base (389)..(389): a, c, t, g, unknown or other
  misc_feature (389)..(389): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagccgtggggggtcccttagagtctcctgtgtggcctctggattcactttcagtaatggctggatgagttggtccgccaggctccgagggaaggggctggagtgggttaggacgtttacgaaaaagtaaaatgaagtaggtagaagaaaaatagaactaacggtnacgtaacccgtaggaaaaggaaagacttacgaacctagtacctacgaaaagtaagaattaattaaccgaaaaaaaccggacggttagttaagtttagaacctaaaaagtcgaaaactaggaacccttaaggaaaaacccgaggaaccacaacgtaccggttaactaacgttaactaccggtaaaccaaccgtaagtaagtttacggaaagttcgactaagttacggaaacggtaaaagggacggtacctagttaggtacccgtttttagaactttaacggtccgttaagggggccccccgtaaaggggctaaacggttccgggg

SEQ ID NO: 113093 - DNA, 668 bp, Homo sapiens
  misc_feature: GYAE6OF01B3RGP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagttaatggctggatggagttgggtccgccaggctccgaggggaggggctgggagtggggttgacgtttacgaaaagtaaaatgagtggtagaagaaaatagactacggtgacgaacccggtagaaaggaagattaccaaccatctacgaaagagaataaattacgaaaaacggtcggttagtaagtttgaactaaagtgaacagtaccgtaaggaaaacccggaggacaacgacgacccgttacttaacgttacctacgttaacccacgtaagtaacgttcgggaaagttcgactaacgttacggaaaccgggtaaagggacggacttagttggttctttttaggaattcggtcggtaccgggggacccaaggggacctaaggttccgggg

SEQ ID NO: 113094 - DNA, 870 bp, Homo sapiens
  misc_feature: GYAE6OF01DKS22.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaaaggtgtccagtgtgaagtgcgaggtggtggaggtcggtgggggacgtccgttagggtaaacggccggtggggggttcccttaaggtacgtccgttccgttggtcggtcggtccttcgtggtacttcctacttttcgaagttaagtggtctggagttggtaggttcgggtcccgccgaggtcccgtaccggaagggggaacggggcgtggggtaggttggggttaggtaacgtttaacgaaaaaagttaaaaagtgtaagtagggtagaaaagtaaaagtaggtaccgtaacggtcgaaccgtaacccggtaagaaaagggtagtacttaccaacctataccgtaacgaaggaagtaattaaacgttaaccgaaaaacggttacggttagttaagtttacgaaactaaaagttacgaaaaccgacggtaacccgtaaacgggaaaaacccggtacggaaaccaaccggtaaccggtacccgtttaaccgttaaaacgtttccgtaaaccggttaaccccgaaacgttaacggttaaacggtttaacgggaaacggttaccgaaccgttaacggtaaccggtaaaacgggttaaaacgggacggttaacctttaaggttaccggtttacgttttaggaactttaccgggtccgggtacccggggtaaccccgaagggtaaaccgtaaggtttccggg

SEQ ID NO: 113095 - DNA, 638 bp, Homo sapiens
  misc_feature: GYAE6OF01DCO6E.15.86.H09.1.454.CMB.1.raw
  modified_base (361)..(361): a, c, t, g, unknown or other
  misc_feature (361)..(361): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgttggtaaagccgtggggggtcccttagagtctcctgtgaagcctctggattcaccttgagcactttatggatgtacgttgggtccgccaggctccgaggggaaggggctgggaggtgggtcggccaccataacaaaaagntaggaagtagacacaacctatgtagaactctgtgagtcgggcctattccgacccgttctacccgaggaacggaaccgaccgacccaaacgaacctacaactaacaatcctagacaaatacgaaaccaacctgagacgaccgaggacacggctgtgtattacgtgtgtggagagtattggttcgtcgggtcgggtttcgggggcccgtaaacgggggtaaccccgttcgggttacccgtaaccccggttccctccccgtaccgtcccggtaccccccg

SEQ ID NO: 113096 - DNA, 570 bp, Homo sapiens
  misc_feature: GYAE6OF01B5M92.15.86.H09.1.454.CMB.1.raw
  modified_base (469)..(469): a, c, t, g, unknown or other
  misc_feature (469)..(469): n is a, c, g, or t
  modified_base (517)..(517): a, c, t, g, unknown or other
  misc_feature (517)..(517): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtgggttggacgtttacaaaagtaaaatgagtggtgaagaaaatagactacggtgcaccgtagaaaggagattcacatctcaagagataattacaaaacgtacggtgtaatttgactaaatgaaacagacctagaaaaccgnggaacacgagccgtatattactgtaaccactagattcggaagtgacancgtaacgtaaagngctangtctttgatatcgtacggggccagggctaagtcgg

SEQ ID NO: 113097 - DNA, 645 bp, Homo sapiens
  misc_feature: GYAE6OF01DZLZ5.15.86.H09.1.454.CMB.1.raw
  modified_base (395)..(395): a, c, t, g, unknown or other
  misc_feature (395)..(395): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtctgggggagccttggtaagcctggggggtcccttagagtctcctgtgtggcctctggattcactttcagtaatggctggatgagttgggtccgcaggctccgaggggaaggggctgggagtgggtggacgtttacaaaagtaaaatgatggtagaagaaatagactacggtgcaccgtagaaagganattcacatctacaagagaataatacgaaaacgacggtatatttagactaaatagaaacagacctaagaaaaccgaggaacacgagtacccgtacttaacttactacggtacccaacgaggtaacgtttaccgggaagttcgacgtaacgttacggaaacggttaaaagggagggtactttaagtcggttactttttaggaattacgtacggtacggggggacccctaagggggtaccaagggttccgggg

SEQ ID NO: 113098 - DNA, 686 bp, Homo sapiens
  misc_feature: GYAE6OF01EOIXT.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaagcgtgggggtccttagagtctcctgtgtggcctctggattcactttcagtaatggctggatgtagttggtccgcgaggctccgaggggaagggcgtgggaggtgggttggtacgtttacgaaaagtaaaatgagtggtagaagaaatagacgtacggtgacgacccgtagaaaggaagacttacacctatctacaagataataacgtaacgaaaacgtcggttattaatttcgaactaaagtacgaaacgacgtaaccgtaaggaaaaacccgaggaaccaccgacgttcccgtacttaacttaaccgtacgtaacccaacgtaagttaacgtttacgggaaagtcgaacgtaacgtaaccgggtaaaggtaaaaggggcgtacgttagttacggtttcttttaggaactttacggttcgggtaccgggggaccccgaaggggtaaactaaggttccgggg

SEQ ID NO: 113099 - DNA, 729 bp, Homo sapiens
  misc_feature: GYAE6OF01AHU89.15.86.H09.1.454.CMB.1.raw
  modified_base (338)..(338): a, c, t, g, unknown or other
  misc_feature (338)..(338): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtggtttcgtgacgtcgctatacgtaaagtgtcagtgtgaagtgcaggtggtggagtcgtgggggagtccgttaggtaaacggccgtggggggtcccttaggacggtctccgtgtgtcggcctcgtggattcactttcagtaatggctggatgagttcggtccgcgaggctccgaggggagggctggnggtgggtggtacgtttaacgaaaagtaaagtgagtggtagaagtaaaagtagaacgtacggtgaccgtaccggtaaggaaaggagtacttacgaacctatctaacgaagagtaacttaacgtaacgtaaaaccgggtcggttaggtaacttttacggaaactaaaagttcggaaaacctcggtaaccgttaacggaaaacccggtaggaacccacgtaaccgggtccttaacttaacgtttaaccgtaccggaaccctaacggtaacgttacggttacgggaactgaacccgttaaggtacggaaaccggtaagggactcgtaattcggtttacgtttaaggactttaccgtacggggacccgggaaccggtacgtaacgttgggttccgg

SEQ ID NO: 113100 - DNA, 564 bp, Homo sapiens
  misc_feature: GYAE6OF01EV9BU.15.86.H09.1.454.CMB.1.raw
  modified_base (466)..(466): a, c, t, g, unknown or other
  misc_feature (466)..(466): n is a, c, g, or t
  modified_base (493)..(493): a, c, t, g, unknown or other
  misc_feature (493)..(493): n is a, c, g, or t
  modified_base (523)..(523): a, c, t, g, unknown or other
  misc_feature (523)..(523): n is a, c, g, or t
  modified_base (531)..(531): a, c, t, g, unknown or other
  misc_feature (531)..(531): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggaaggggctggagtgggttggacgtttacaaagtaaaatgatggtagagaaaatagactacggtgcacccgtagaaaggagattcacatctcaagagataattacaaaacgacggtagtatttagactaaatgaaacagacctagaaaaccgnggacacagccctatatactagtaccanagtatacggaagtgacatacgagtaaaggnggctatgntttgattagtcgtagggacccagggcagtcggg

SEQ ID NO: 113101 - DNA, 593 bp, Homo sapiens
  misc_feature: GYAE6OF01A5LKH.15.86.H09.1.454.CMB.1.raw
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (479)..(479): a, c, t, g, unknown or other
  misc_feature (479)..(479): n is a, c, g, or t
  modified_base (534)..(534): a, c, t, g, unknown or other
  misc_feature (534)..(534): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatcttaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctcgaggggagggctggagtgggtgacgtttanaaaagtaaaangatggtagaagaaaatgactacggtgacaccgtagaaagagtatacacatctacaagagataatacgaaaagtcgtatattgactaaatgaacagacctaagaaaaccgaggacacgacgtaccgtntaacttacgacgtaaccagtagtacgttaggaagtgactagtacgaagtaaaggngtactagtcgttgtttagacgttacgtcggtacggggaacccagggtactaggttccgg

SEQ ID NO: 113102 - DNA, 641 bp, Homo sapiens
  misc_feature: GYAE6OF01DFZT2.15.86.H09.1.454.CMB.1.raw
  modified_base (246)..(246): a, c, t, g, unknown or other
  misc_feature (246)..(246): n is a, c, g, or t
  modified_base (350)..(350): a, c, t, g, unknown or other
  misc_feature (350)..(350): n is a, c, g, or t
  modified_base (485)..(485): a, c, t, g, unknown or other
  misc_feature (485)..(485): n is a, c, g, or t
  modified_base (521)..(521): a, c, t, g, unknown or other
  misc_feature (521)..(521): n is a, c, g, or t
tcagtctacgtagccacgaccggtgctcgatttagtgctatagacttgggtttggggggagaggagccccagccttgggatccccaagtgtttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtccttagngtctctgtgtggcctctggattcactttcagtaatggctggatggtaggttgggtcccgcgaggctccgaggggaaggggctgggagtgggttggacgtttaanaaaaagtaaaatgaatggtagaagaaaatagacgtacggtgacgaacccgtagaaaggaagatcacatcacaagagaataataacaaaacgtacggtagttaattgacaaatagaaacagacctaagaaaaccgngaaccacgacgaccgtctaattacctagtaacccanaagtaagttacgggaagttcgactaacgtaacggaaacgggttaaaaggcggtacttaagttggttcgttttagaagtttacgtcggtacggggaccccgaagggtacgtaaggttcggg

SEQ ID NO: 113103 - DNA, 1153 bp, Homo sapiens
  misc_feature: GYAE6OF01DXKAD.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttcctgctgctatacttaaaagtgtcagtgtgaagtgcgaggtggtggagtcgtgggggagtccgttaggtaaaacgtccggtcggggggttccctttaaggtacgttccgttcccgttggttcggttcgggtcccgttcgttagggttactttaccgttacctttttaccgtaaaggtttaaagttcgggtaccgttaggggtaagttagggttaacggggttttccgggggttccccgggaccccgtaacgggggtccccgttaacccccggggaaagggggggtaaaacgggggggttccggttaggggggttaaggggttttcggggggttttaacggggtttaaacccgggttttttaaaaccggtaaaaaaaaagggtttaaaaaaagttagggttaaaaggtttaggggtaaaggtaaaaaggtaaaaaaagttaacggtaaaccgttaaggttagggtacggaacccgtaaacccgggtaaagggaaaaacgggtaaacgtaacgttaacccgtaaaccgtaacgttaaccgtaacgtaaaaaggtaacggttaaaactttaaaaccgtttaaaaccggaaaaaaaaccgggttaccgggtttaaggtttaaacgtttttaaacggaaaccgttaaaaaggttacggaaaaacccgtaaccggtaaaccccggttaaaaaccgggaaaaaaccccgggtaacggaaaacccctaaccggtaaaccggttaccccggtttaaacccttttaaacggtttaaaccccgttaaccgttaaaacccccgtaaacgttaacgggttaaaccgttttaaccggggtaaacggttccggtaaaccgtttaaacgggtaaacccgggttaaaaaccggggttaaaaggggtaccggttaacttaacggtttacgggttttaccgttttaaggtaacgtttaaccgggttaccgggttaacccggggggtaaccctaaacggggtaacgttaaaccgggg

SEQ ID NO: 113104 - DNA, 831 bp, Homo sapiens
  misc_feature: GYAE6OF01C9EAL.15.86.H09.1.454.CMB.1.raw
  modified_base (469)..(469): a, c, t, g, unknown or other
  misc_feature (469)..(469): n is a, c, g, or t
tcagtctacgtagccacgaccggtgctcgatttagtgctatagacttgggtttggggggagaggagccccagccttggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttaggtaagccgtgggggtcccttagagtctcctgtgtggcctctggattcactttcagtaatggctggatcgaggttcggtccgcgaggccgtaccgaggggaaggggtctgggaggttgggttcggtaaccgttttaacgaaaaaagttaaaaaagtgtaagtagggtagtaaagaaaaagtacgaaccgtaacggtacgacctaacccggtaagaaaaggtaaatagttaccaacgtaactaccgtaanaaagaacgtaataaacttaacgaaaaaaccgtacggttaagttaagtttaggtaactaaaaagtacggtaaacctaacggtaacccgtaaacgggaaaaaacccgtacgggaaacccaaccgaaccggttaacccgttacgtttaaacctttaaccgtacgttaaacccccaaacgtaaacggttaacggtttaaaccgggtaaacggttcgaacccgtaaacgtacccgggtaaaacgggttaaaaacgggaccgggtaacgttaaggtttcgttaccggtttttaaggacctttaaacgtcccgggttaacccgggggaaccccgttaaaggggtaaacccgtaagggttttacccgggg

SEQ ID NO: 113105 - DNA, 758 bp, Homo sapiens
  misc_feature: GYAE6OF01DTRMS.15.86.H09.1.454.CMB.1.raw
  modified_base (218)..(218): a, c, t, g, unknown or other
  misc_feature (218)..(218): n is a, c, g, or t
tcagtctacgtagccacgaccggtgctcgatttagtgctatagacttggggtttgggggggagaggagccccagccttgggactccccaagttgttttcattcagtgatcaggactgaacacagaggactcaccatggacgttcgggctgagtcgttgggttttccttgctgtctattacttaaaggtgtctagtgtagagtgacgtaggtggtaggngttcggtggggacgtccgttagggtaacggtccgggttcggggttaccttaggacgttctcgtgtgtcgtcctcgtgtacttcttacttagtagttagtggcgtaggtagtggtaggttccgggtcccgcgacggtccgtacgggagggggtagggcggtgggtagggttcgggttaggtaacgttaaagaaaagtaagtgtagtaggtaagtaaagaatagtacgtacggtacgacgaacggaaggaaagaactacgtaccaactagtacgaaagtagaataacgttaaacgtaaccggaaaaaccggttgttaagtttaacgtacgaaaactttaaacggaacgaaacctaaacgtaacccgtaaaaggaaacccggtaacgaacctaacgttcccggtaaccggtttaattaacgttaccgaaccgtaacgaacggtattaaccggtaggacctcggaactacgtaacgggtaaagaaggttccgatttaggtctttggtacaggtacgtccggacgggacctaaggacgttggtcg

SEQ ID NO: 113106 - DNA, 562 bp, Homo sapiens
  misc_feature: GYAE6OF01A3FCY.15.86.H09.1.454.CMB.1.raw
  modified_base (402)..(402): a, c, t, g, unknown or other
  misc_feature (402)..(402): n is a, c, g, or t
  modified_base (492)..(492): a, c, t, g, unknown or other
  misc_feature (492)..(492): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcacttttcagtaatggctggatgagttgggtccgccaggctccaggggaagggggctggagtgggttggacgtttacaaaagtaaaatgatggtagagaaaatagactacggtgcacccgtgaaaggaagattnaccatctacaagagataattacaaaacgacggtagtatttagacaaatgaacagctagaaaccgagacacacgctctatactagtaccanagattcggaagtgcatcgaacgtaaggagctatgcttttgattatcgtcgggacccagggacaagtcggg

SEQ ID NO: 113107 - DNA, 640 bp, Homo sapiens
  misc_feature: GYAE6OF01DXELW.15.86.H09.1.454.CMB.1.raw
  modified_base (348)..(348): a, c, t, g, unknown or other
  misc_feature (348)..(348): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtcggcctctggattcactttcagtaatggctggatgagttggtccgccaggctccgaggggaaggggctgggaggtggggttggacgtttanaaaagtaaaatgatggtgaagaaaatgactaggtgacaaccgtagaaaggaagatcacatctacaagataataattacaaaaacgcggttagtaatttagactaaatagaaacagacctaagaaaacccgaggaaccacgacgtaccgtactaattaccgtacgtaacccaacgtagtaacgttaccgggaagtcgactaagtacggaaacggtaaagggaggtcttaatggttcttttagaagttacgtccgggtacgggggtaccccaaggggtacctaaggttccgggg

SEQ ID NO: 113108 - DNA, 758 bp, Homo sapiens
  misc_feature: GYAE6OF01DB4FN.15.86.H09.1.454.CMB.1.raw
  modified_base (247)..(247): a, c, t, g, unknown or other
  misc_feature (247)..(247): n is a, c, g, or t
  modified_base (676)..(676): a, c, t, g, unknown or other
  misc_feature (676)..(676): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttcctgctgctatacgttaaaaggtgtccagtgtgaagtgcaggtggtggagtcgtggggagccgttaggtaaagccgtgggggtcccttagngtctctgtgtggcctctggattcactttcagtaatggctggatgagttgggtccgccgaggcctaccggaggggaaggggtcgtgggtaggttggggttaggtaaccggttttaacgaaaaaaggttaaaaaagttggaagttagggtaagaaaggtaaaaataacggtaacgtaacggttacgaaccgtaacccggtaagaaaaacgggtaagtaacttacaaacccgtagttaccaagaaaggtaacgtaaattaaagttaaacccgaaaaaacggtaacgggttaagttaattttaacgaaccgtaaaaagttacggaaaaccgtaacggaaccccgtaaaggaaaaaacccggaacgggaaccaaaccggacgacccgttattaacttactacgtaacccacgtaagtacgttacggaagtcganagtaccgaaagtaacgaggacttagtgtcgttttagaatttacgtaccggtacgggaccccgaaggggtctaagggttccgg

SEQ ID NO: 113109 - DNA, 575 bp, Homo sapiens
  misc_feature: GYAE6OF01DTQZL.15.86.H09.1.454.CMB.1.raw
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (503)..(503): a, c, t, g, unknown or other
  misc_feature (503)..(503): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtgggttggacgtttcaaaagtaaaatgatggtgaagaaatagaactacggtgcgaacccgtgaaaggaagattcaccatctacaagagaataattacaaaaacgcggtagtatttgacaaatagaaacagaccgtagaaaaccgaggaacacagccgtntattactntaaccanagattcggaagtgcagtcgaagtaaaggagctatgtctttagattagtcgtacgggcccaagggcagtcggg

SEQ ID NO: 113110 - DNA, 520 bp, Homo sapiens
  misc_feature: GYAE6OF01BMNKT.15.86.H09.1.454.CMB.1.raw
  modified_base (397)..(397): a, c, t, g, unknown or other
  misc_feature (397)..(397): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacgggactccccgatcgcttcatgggctccagttcgtggggctgaccgctacctcaccntctcccaacctccagtctgacatggagctgagtatcactgtaggagagagccacacatgatcggacgaaggcgggttgggtgtcgggcggagggaccaaggtctggacccgtcgtggtcacgg

SEQ ID NO: 113111 - DNA, 873 bp, Homo sapiens
  misc_feature: GYAE6OF01A6JGE.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacgccgtcggggggtcccttaggacggttccttccgtggtcggtcgggcccttcgtgggtaactttcctacttttcgaagttaagtggtctggattggtaggtttcggggtcccgaccgagggtcctaccggaagggggaacgggggtcgtggggtaggttcgggggtttacgggtaaccggttttaacgaaaaaaaggtttaaaaaacgtggtaaagttagggtaaggtaaaagtaaaaaagtaacggtaaccggttaaccgggtacgacccgtaaacccggttaaggaaaaacgggtaacgtaacgtttaccgaacccgtaagttacccgtaacgaaaacggtaacgtaaacgtttaaaacgttaaacccggaaaaaacgggttcgggttaagtttaacgtttacggaaactaaaaagttacgaaaacctacggtaaccctaaacgggaaaaacccggagaaacccgaaccgtacggttaccccgttaattaacgttaccgtaacgtaacccaacgtaggttaacgttaccggaaagttcgaacctaaggtaccggtaaaacggtaaagggacgtcgttaagtcggtttacctttagacttaacgttccgggtacgggacccgtaagggtaactaagggttcgg

SEQ ID NO: 113112 - DNA, 747 bp, Homo sapiens
  misc_feature: GYAE6OF01BMVPT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtgggggtcccttagagtctcctgtgtggcctctggattcactttcagtaatggctggatggagttgggtccgcgaggctccgaggggaggggctgggagtgggttggtacgtttacgaaaagtaaaatgagtggtagaagtaaaagtagaacgtacggtcgaccgtaacccggtaaggaaaaggtaagtaacgtttaccaacccgtaacttaccgtaacgaaaagtaagtaaacttaaaacgtttaacccgaaaaaacggtaccgggtttaagtttaacgttttacgaaacgtaaaagttacgaaaacgtacgtaacccgtaaacggaaaaaccccgggaggtaacccaacgtaacgtaccgttacttaacgtttacctaacgtaacccagtaagttacgttacgggaagtcgaccgtaagtaccgaaaggtaaagggacgtaccgttagtacgttcgtttttagaagttacgttaccgggacggggtaaccccaaggggtactagggttacggg

SEQ ID NO: 113113 - DNA, 578 bp, Homo sapiens
  misc_feature: GYAE6OF01BARDG.15.86.H09.1.454.CMB.1.raw
  modified_base (532)..(532): a, c, t, g, unknown or other
  misc_feature (532)..(532): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgccaggctccgagggaaggggctggaggtgggttggacgtttcaaaagtaaaatgatggtgaagaaaatagactacggtgcaccgtagaaaggaagattcacatctacaagagataattacaaaacgacggtagtatttgactaaatagaaacagacctagaaaaccgaggaacacagccgtatacttactagtaccactagattacggaagtgacatcggaacgtaaagggngctatgtctttagattagtcgtcggggacccaggggacaagtcggg

SEQ ID NO: 113114 - DNA, 650 bp, Homo sapiens
  misc_feature: GYAE6OF01DCTVJ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagcctggtaaagccgtgggggtcctagagtctctgtgtggcctctggattcactttcagtaatggctggatgagttggtccgcaggctcgaggggaagggctggagtggtaggtacgtttaacgaaaagtaaaatgaagtggtagaaagaaaagtagacgtaacggtgacgtaacccggtaggaaaaggaacgtaagttacaacctatacgtacaaagaagaataaattaacaaaaacgtacggtagtatttagactaaaatacgaacaagacccgtaagaaaaccgaggaacaaccgacgtacgtcttaagttacgaacgttacccagtagacgttacggaagttgactatacggaaacggtaaaggacgtactagtacgttcgtttagattacggttacggaccgggtaccgaaagggacgtaaggttcggg

SEQ ID NO: 113115 - DNA, 751 bp, Homo sapiens
  misc_feature: GYAE6OF01CU8XU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctccgtgtgtcggcctctggattcactttcagttaagtggctggatggtagttcgggtccgccgaggccgtaccgagggggaaggggcgtgggagttggggttaggtaccgtttacgaaaaaggttaaaatgagtaggtagaagtaaaatagaacgtaggtcgaccgaacccggtaggaaaacggaagtactaccaaccgtattaccgtaacgaaagtaacgtaatttaaacttaaccgaaaaaacggtcggttaagtttaacttttacggaacttaaaagtacgaaaccgacgtacccgtaaacggaaaaacccggtggaaccaacgtacggtacccgtttaaccttaacgtttaaccgtacgtaacccgaacgttaggtaacgtttaccgggaagttcgaccgtacgtacgggtaaacgtaaaggggacgtcttagttcggtttcttttagaacgttcgtaccgggtacggggacccaaggggtactaacggttcgggg

SEQ ID NO: 113116 - DNA, 650 bp, Homo sapiens
  misc_feature: GYAE6OF01BDB8K.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgcgaggctccgaggggagggctggagtgggttggacgtttacaaaagtaaaatgagtggtagaagaaatagacgtacggtgacgaccgtagaaaggaagacttacacatctacgaaagagtaataattaacgaaaacgtacggtagttagtttagactaaagtacgaacagtaccgtaagaaaccgacgaacacgacgtccgtacttacttacgtacgtaaccagtacgtacgttacggaagtcgactacgtaccggtaacggtaaaggacggtacttagttaggttcgtttttagaagttacgttccgggtacggggacccctaagggggtaacctaagggttccggg

SEQ ID NO: 113117 - DNA, 1011 bp, Homo sapiens
  misc_feature: GYAE6OF01DG5FH.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtggttttccttgctgctatacgttaaaggtgtcagtgtgaagtgcgaggtggtggagtcgtgggggagtccgttaggtaaacggtccggttggggggttaccccttaaggtacgttcctccgtggtgtcggccttcgtggtactttcctacttttacgaagttaagtcggtcgtaggtatggtacggtttcggggtcccgccgtaggtccgtaccgggaaggggggaacggggtccgttaggggtacgggtttagggggtttacggttaaaccggttttaaacgaaaaaaaggtttaaaaaagttggtaaaggttagggtaagaaaaggtaaaaacgttacggtaacggttaacgggtagtaacccggtaaaccccggtaagggaaaaacgggtaaacgttaacgttacccgaaaccctacttaccgtaacgtaaaaggtaagtaaacgtttaaaacgtttaaacccgaaaaaaccgggttcgggttttaagttaacgttttacggaaaaccttaaaagttaaccggaaaacgtaccggtaacccgtaaaacgggaaaaaaccccgggacggtaaacccgtaaccgtaacccggtacccttttaacgttaaaccgttttaacccgttaacggtaaaccccgtaacggttaacgggttaaacggttttaaccgggtaaacgggttcgtaacccgttaaaacggttaacccggggtaaaacgggtaaaaacggggtaccgggtttaacttaaaggttttacggtttaaccgttttttaaacgggaacgttttaaaccgggttcccgggggaacccgggttaacccccgggtaaaggggtaacccgttaagggttttaccccgggg

SEQ ID NO: 113118 - DNA, 711 bp, Homo sapiens
  misc_feature: GYAE6OF01BGP2M.15.86.H09.1.454.CMB.1.raw
  modified_base (647)..(647): a, c, t, g, unknown or other
  misc_feature (647)..(647): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaagccgtggggggtcccttagagtctcctgtgtggcctctggattcacttttcagttaatggctggatgtaggttgggtcccgcgaggcctccgaggggaaggggcgtgggagttggggttggtaacgtttacgaaaaaggttaaaaatgaagttgggtagaagtaaaaagtagaacgtacggtcgaccgaacccggtagaaacggtaagacttacaacctatacctagaaacgaagtaattaaacgttaacgaaaacggtaggtttagttaatttagaactaaaagtacgaaacgtacgaaccttaacgggaaaaccggtacggaaccaacgaacggtcccgttacgtttaattaaccgttacgtaacccaagttacgtaagttacgggaagtcgactaacgtacggtaacggtaaagggngtacttaggtgttccgtttagaattacgtcggtacgggaaccccagggtaacctagggttcggg

SEQ ID NO: 113119 - DNA, 705 bp, Homo sapiens
  misc_feature: GYAE6OF01DB7WU.15.86.H09.1.454.CMB.1.raw
  modified_base (143)..(143): a, c, t, g, unknown or other
  misc_feature (143)..(143): n is a, c, g, or t
  modified_base (187)..(187): a, c, t, g, unknown or other
  misc_feature (187)..(187): n is a, c, g, or t
tcagtctacgtagccacgaccggtgctcgatttagtgctatagacttgggtttggggtccactgggcagtctcgaatagagctcttggaagtcccctccaaccatggcctgggtctccttctacctactgcccttcattttcnccacaggtctctgtgctctgcctgtgctgactcacgcccccgtntgcatctgccttgcgtgggagcctcgatcaagcctcacctgccaccctaagtagtgagcatcgaacctacaccatcgaatggtatacaacagacgaaccgagggaacctcccccagtaactataagtagtaaagttaagagtagagtaggcacgaccgaacgaaccggaaggggacggacgtcccgatccgctcgagtcggctccgtagttccggtgggcgtacggacccgtccgtaccctccaccgtacctaccctaccctaaccccgtaccgtacgtaccgttacggaaccgtagtacggaggtaccgtaggtaacgttactaccgtacgttaggtaggacggacggaaccgaccaacctaacgtaagttaggtaacgtaccggtaacccggtaagggttaaccggggtttggggttaccggggttaccgggaccgggggtaaaccggggtacccgaacgggtcccggttaaccgggtaccccggttaccggttaccgggtaccgtaacccccggg

SEQ ID NO: 113120 - DNA, 653 bp, Homo sapiens
  misc_feature: GYAE6OF01DRTKG.15.86.H09.1.454.CMB.1.raw
  modified_base (430)..(430): a, c, t, g, unknown or other
  misc_feature (430)..(430): n is a, c, g, or t
  modified_base (493)..(493): a, c, t, g, unknown or other
  misc_feature (493)..(493): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttcgggtccgccaggcctccgaggggaaggggcgtgggaggttggggttggtacggtttacgaaaagtaaaatgtatggtagaagaaaatagacgtacggtcgacgacccgtagaaggaagaattcaccatctcaaaganataattaacaaaacgcggtagtactttagactaaatagaaacacgaccgtaagaaaacccggnggaaccacgaacggtccctattaagttaaccgttacgtaaccccagtaacgtagttaacgggaacgtgacaagtaccgaaacggtaagggaggtaaccgttagtagttcttttagaattacgttcgggtcggggaacccaggggtaacgtagtcccgggg

SEQ ID NO: 113121 - DNA, 589 bp, Homo sapiens
  misc_feature: GYAE6OF01BQ42F.15.86.H09.1.454.CMB.1.raw
  modified_base (185)..(185): a, c, t, g, unknown or other
  misc_feature (185)..(185): n is a, c, g, or t
  modified_base (347)..(347): a, c, t, g, unknown or other
  misc_feature (347)..(347): n is a, c, g, or t
  modified_base (395)..(395): a, c, t, g, unknown or other
  misc_feature (395)..(395): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctgatcaagctcacctgccaccctaagtagtgagcatcgaacctacaccatcgaatggtatcaacagagaccagggaacgtccccccagtatataatagaaagttaagagtagatggacagcacacggaaggggacggacncccgatcgcttacagtcggctcgtagttcgtgggctcgaccgctaccnctaccgatcctacccaacctccacgtcctagacgtagtcgaggctaggagtatcaacgtggtaggacgtagacgacccaactaacgagttacgagtacggaccgtaaaggtacggggttagggtggttaccgggacggggacgggtaacccaagggtcctacggtacccgtaccgttacgggtcgaaacccggg

SEQ ID NO: 113122 - DNA, 620 bp, Homo sapiens
  misc_feature: GYAE6OF01CURJ9.15.86.H09.1.454.CMB.1.raw
  modified_base (217)..(217): a, c, t, g, unknown or other
  misc_feature (217)..(217): n is a, c, g, or t
  modified_base (452)..(452): a, c, t, g, unknown or other
  misc_feature (452)..(452): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
  modified_base (573)..(573): a, c, t, g, unknown or other
  misc_feature (573)..(573): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggganccgttaggtaaagccgtgggggtccctagacgtctcctgtgtggcctctggattcactttcagttaatggctggatggtaggttcgggtccgcgaggccgtaccggaggggaaggggctgggaggttggggttacggtacggttttaacaaaaaggttaaaatgaagtgggagaaagaaaagtgaacgtacggtcgaccgaccgtagaaaggaagactacaccatctacaagaanataactaacaaaacgtgtagttaattagaataaatgaaacngaccaaggaaaccgngacacgagcccttatattacagtaaccagtagtacgttacgagtcacgaacgtacgaaggtaagngtactagtgttctttgatcgtcgacgggccaagggtaccaggttccg

SEQ ID NO: 113123 - DNA, 595 bp, Homo sapiens
  misc_feature: GYAE6OF01ANJCC.15.86.H09.1.454.CMB.1.raw
  modified_base (208)..(208): a, c, t, g, unknown or other
  misc_feature (208)..(208): n is a, c, g, or t
  modified_base (446)..(446): a, c, t, g, unknown or other
  misc_feature (446)..(446): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtggtttcgtgacgtcgctatacgtaaagtgtcagtgtgaagtgcaggtggtggagtntgggggagccgttggtaaagccgtggggggtcccttagagtctcctgtgtggcctctggattcacttttcagtaatggctggatgagttgggtccgccaggctccgagggaaggggcgtggagtgggttggacgtttacaaaagtaaaatgatggtagagaaaatgacgtacggtgcacccgagaaaggagattacacatctacaagatactaataccaaaagacggttagtagtttnacgaaataggaacagacctagaaaaccgagacaacgcgtaccgtactagttactacgtaccacagtatcggaangnagtcgaacgtaaaggcggtatgtagtcttttaggacttagtcggttcgggacccggacggacgtaagttcggg

SEQ ID NO: 113124 - DNA, 759 bp, Homo sapiens
  misc_feature: GYAE6OF01EB856.15.86.H09.1.454.CMB.1.raw
  modified_base (180)..(180): a, c, t, g, unknown or other
  misc_feature (180)..(180): n is a, c, g, or t
  modified_base (393)..(393): a, c, t, g, unknown or other
  misc_feature (393)..(393): n is a, c, g, or t
  modified_base (531)..(531): a, c, t, g, unknown or other
  misc_feature (531)..(531): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtntcagtgtgaagtgcaggtggtggagtcgtgggggagccgttaggtaaacggccgtggggggtcccttagacgttctcctgtgtcggcctctggattcactttcagtaatggctggatgagttggtccgcaggctccgaggggaagggcgtggaggtgggttggtacgtttacaaaagtaaaatgagtggtagaagaaaagtagaacgtacggngacgtaacccggtaggaaaaggaagtacttaccgaacctatactacaaagaagtaattaaacttaacgaaaaaccggtacggttattagtttagaacgttaaagtacgaaactacgtacccgtaggtaaaaacccggngaaccaacgacgtacccgttacttaactttaaccgtacggttaacccaacgtacggtaacgtttacgggaacggttacgaccgtaacgtaaccgggaaaacgggtttaaaacggggaacgggttacccgtttaaggttcggtttaacccgttttttaggtaactttaaacggttcccgggttaacgggggacccccgtaaggggtaaaccgttaggtttaaccggggg

SEQ ID NO: 113125 - DNA, 727 bp, Homo sapiens
  misc_feature: GYAE6OF01DMHEZ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtccttagagtctctgtgtgcctctggattcactttcagtaatggctggatggtagttgggtccgccgaggcctccgaggggaggggcgtgggagtgggttggacgtttacgaaaagtaaaatgagtggtagaagaaaatagacgtacggtgaccgaacccggtagaaaaggaagacttacaacctatacctacgaaagaagtataaatttaccgaaaaaacggtacggttagttaagtttacgaactaaaagttggaaaactaacgacccgttaaaggaaaaaaccccggacgggaaaccaaccgaacggaccgttaccttaacgtttacctaacgtaacccgactaacggttacgttaaccgggtaagtcgaacgaagttaccggaaacggtaaaaggggacggtaccttaaggttcggttcgtttttaggaatttacggttaccggtcggggaacccccgaagggggtaacctaaggttcccgggg

SEQ ID NO: 113126 - DNA, 797 bp, Homo sapiens
  misc_feature: GYAE6OF01B9E5N.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtgtccagtgtgaagtgcgtaggtggtggagtcggtgggggagccgttagggtaaacgccggttggggggttaccccttaggacgttccgtccgtggtgtcggcctcgtggactttcacgttttcagtaagtggtcgtggtagtggtaggttcgggtcccgccgaggccgtaccggaaggggaacggggtcgtagggtaggttggggttacggtaacggttttaacgtaaaaaaggttaaaaagttaggtaagttagggtaaggaaaggtaaaaacgtaggaaccgttaaccgggtagaacccgaaacccgggttaaggaaaacgggtaacgtaacttaccaacccgattaccgtaagaaaaggacgtaaacttaaacgttaaccaaaacggtacggttacgttaagttagaactaaaagtacgaaacgtaacgaacctaacggaaaaccgacgaacacgtaaccggtccttaacgttaacttaaccgtaacgtacccaaagtacgtaacgttacggaagtcgactaacggtaaccggtaaggtaaaggacgttactaagtcggttacgtttagaaccgttagtacccgggtacgggacccagggtaaccgtggtaccgg

SEQ ID NO: 113127 - DNA, 551 bp, Homo sapiens
  misc_feature: GYAE6OF01B0IKN.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgccaccctaagtagtgagcatcgaacctacaccatcgaatggtatcaacagagaccagggaacgtccccccagtatataatgaaagttaagagtgatggcagccacaccgaaggggacggactccccgatcgcttcagtcgggctccagttcgtggggctcgaccgctacctcaccatcctcccaacctccagtctgacgatgaggctgagtatcacgtgtaggagagagccaacacaattgagtggaccgaaggtacgggttgggtggttacggggcgggaacgggaccgaaggtcgtacggacccgtccgtaggtccgaacccggg

SEQ ID NO: 113128 - DNA, 717 bp, Homo sapiens
  misc_feature: GYAE6OF01DQOXL.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggaggtcgtgggggacgtccgttagggtaaaacggccggttcggggggttaccccttaaggacgttccgttccgttggttcggtcggtccttcgtggtactttctactttcgaagttaagtggtctggatggtaggttcgggtccgccgacggcctaccggaaggggaacggggtcgtaggggtaggttggggttacggtaacgtttaaacgaaaaaagtaaaagtgtaagtagggtaagaaagaaaagtacgacgtaacggtcgacgtaaccgtaaggaaaaggaagtactaccgaactatactaacgaagtaagtaataaacttaaccgaaaaacggtcggttagttaatttacgaaactaaagtacgaaactacgaacctaaaggaaaccgagaacacgactcgtactaacttcgtaacgaccagtagtacttacggatcgacagtacggaacgtaagcgtactagtgttcttagacttcggtccggtcggaccgaaggtactaggtcgg

SEQ ID NO: 113129 - DNA, 696 bp, Homo sapiens
  misc_feature: GYAE6OF01EWVV2.15.86.H09.1.454.CMB.1.raw
tcagtctacgtagccacgaccggtgctcgatttagtgctatagacttgggtttgggggggagaggagccccagccttgggatccccaagtgttttaattcagtgatcaggactgaacacagaggactcaccatggagttcgggctgagctgggttttccttgctgctatcttaaaaggtgtccagtgtgaagtgcaggtggtggagtcgtgggggagccttggtaagccgtggggggtcccttagagtctcctgtgtggcctctggattcactttcagtaatggctggatgagttgggtccgccaggctccgaggggaaggggcgtgggaggtggggttgggacgttttacgaaaaggtaaaatggatggtagaagaaaagtagacgtacggtgacgacccgtaggaaaggaagattacaccatctacaagagaataattacgaaaaacgtacggttagttagtttagacaaagtagaaacacgaccgtaaggaaaacccggaggaaccaacgacggtccgtacttaacttacgtacgtaacccacgtaagtaacgttaccgggaaagtcgacgtaacgtacggaaaccgggttaaaagggacggtacgttaagttggttacgtttttaggaatttaggttacccggttacgggggaccccgtaaggggtaaccgtaaaggttcggggttacccgg

SEQ ID NO: 113130 - DNA, 628 bp, Homo sapiens
  misc_feature: GYAE6OF01AZ472.15.86.H09.1.454.CMB.1.raw
  modified_base (581)..(581): a, c, t, g, unknown or other
  misc_feature (581)..(581): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcacttttcagtaatggctggatgagttggtccgcgaggctccgaggggaaggggctggaggtgggttggacgtttacgaaaagttaaaatgagtaggtagaagaaatagacgtacggtgaccaccgtagaaaggaagattcacctatctacaagagaattaacttacaaaacgtaggtagttaatttgacaaatagaacagacctaagaaaaccgaggaacacgacgaccgttactaacttactacgtaccacagtacttacgggaagttgactaagtacgaacggtaaaggcggtactagttacggttntttagattacgtcggtacggggaccccaggggtacctaaggttccgg

SEQ ID NO: 113131 - DNA, 605 bp, Homo sapiens
  misc_feature: GYAE6OF01EK4L7.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttgggtccgccaggctccgaggggaaggggctgggaggtgggttggacgtttacaaaaggtaaaatgatggtagaagaaaatagacgtacggtgacgacccgtagaaaggaagacttcaccatcacaagagaataattacaaaaacgtacggtagtatttgacaaagtacgaacagaccctaagaaacccgagacacgagacctactattactacgtacacagtactacggaagtcgacatacggaagtaaaggaggtactagtgtctttagattacgttcggacgggaccgagggtacgaggttccggg

SEQ ID NO: 113132 - DNA, 703 bp, Homo sapiens
  misc_feature: GYAE6OF01B7B8Z.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctcgtggattcactttcagtaatggctggatgtagttgggtccgccgaggcctccgaggggaaggggcgtgggaggtgggttaggacgtttacgaaaaagtaaaatgaagtggtagaagaaaagtagaacgtacggtcgaccgtaccggtaagaaaaggaagtataccaacctatacgtaacaagagtaattaagttaacgaaaaacggtcggttattatttacgaactaaaagtcgaaacacgtacctaaaggaaaacccgaggaaccaacgacggccgttacttaattaaccgtacgtaacccagtaaggtaacgttacgggaaacgttcgacgtaacgtaccggaaacgggttaaaaagggcggtaccttagttcggttaccttttagaattacgtaccgggtacggggaccccaaggggtaaccgtaaggttacccgggg

SEQ ID NO: 113133 - DNA, 700 bp, Homo sapiens
  misc_feature: GYAE6OF01CKSC1.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttgggtcccgccgaggcctccgaggggaaggggctgggagtgggttggacgtttacaaaagtaaaatgatggtagaagaaaatagactacggtcgcaccgtagaaaggaagacttacaactatactacgaaagacgaataaattaaccgaaaaacggtcggttagttaatttacggaaactaaattacgaaaacacggtacccgtaaacggaaaacccggacggaaccaacgtacggtacccgttacttaacgttaaccgttacgtaacccaacgtaggtaacgtttacggaaagtcgactacgttaccgggaaacgtaaagggtgtaacgtagttacggttacttttaggaactttacggttccggtacgggggaccccgaaagggtacgtaaggtttaccgggg

SEQ ID NO: 113134 - DNA, 877 bp, Homo sapiens
  misc_feature: GYAE6OF01DC07A.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtgggagtcgtgggggagccgttagggtaaacgccgttggggggtcccttaggagttctcctgtgtggcctcgtggattctactttcagtaatggctggatggtagttcgggtccgccgaggcctccggaggggaaggggcgtggggaggttggggtttacggtaacgttttaacgaaaaaggtaaaagtggaagtagggtagaaagtaaaataggaacgtacggtacgaccgtaacccggtaggaaaaagggtaaacgtacttaccgaaccgtaattaccgtaacgtaaaggtaagtaaacttaaacggtttaaaacccgaaaaaaacgggttaccggggttttaagtttaaacgttttacggaaaccttaaaaagttaacgggaaaaacctaacggtaaccccgttaaaacgggaaaaaccccgggtaaagggaaaccctaaccggtaaccggttaccccgtttaacgtttaaacgtttaaccctaccggttaaaccccaaccggtaaggttaacggtttaaccggggaaaggtttcgaaacccgttaacggtacccgggtaaaacgggttaaagggaacggttacctaagtttacggtttcgtttttaagaaacgtttacggtccggttaacggggggaaccccgtaaaggggtaacgtaaacgggttcccgggg

SEQ ID NO: 113135 - DNA, 594 bp, Homo sapiens
  misc_feature: GYAE6OF01CJWZ5.15.86.H09.1.454.CMB.1.raw
  modified_base (421)..(421): a, c, t, g, unknown or other
  misc_feature (421)..(421): n is a, c, g, or t
  modified_base (461)..(461): a, c, t, g, unknown or other
  misc_feature (461)..(461): n is a, c, g, or t
  modified_base (541)..(541): a, c, t, g, unknown or other
  misc_feature (541)..(541): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtggggttggacgtttacaaaaggtaaaatgatgggtagagaaaatagactacggtgacacccgtagaaaggaagattcaccatctacaaganaataattacgaaaacgcggtagtatttgacaaatgaaacngacctagaaaaccgaggacacagacctatattactagtaaccacagtattacgggaagtcgacagtacgaacgtaaaggnggtctattgtcttttagattacgtcggtacgggacccagggactaagttcggg

SEQ ID NO: 113136 - DNA, 913 bp, Homo sapiens
  misc_feature: GYAE6OF01B84ZT.15.86.H09.1.454.CMB.1.raw
tcagtctacgtagccacgaccggtgctcgatttagtgctatagacttgggtttggggggagaggagccccagccttgggatccccaagtgtttcattcagtgatcagactgaacacagaggactcaccatggacgttgggctgagtcttgggtttcctgctgtactagtacgttaaaagtcgtacctagtggtagaagtcgagaagggtggtaggacggtccggtaggggtacgtaccgttagggtaaacgtccggtcgggggtacccttaaggcgttcgtcgttggtcgtcggtccttcgtggtactttctaaccgtttacgaacgttaacgtcggtaccggttaggtacgtaacggttacgggttccgggttacccgacggtaccggtaccgttacccggggaaggggtaaccggggtacgtacggggttacggttacggttaacgtaaccggtttaaacgtaaaaagtaaaacgtgtacgtaaggtagtaaaaggtaaacgtacggtaccgtaacggtcgaaccggtaaacccggtaaggaaacggtaacgtaccgtaacgaacccgtataaccggtagtaaataacgggtaacttaacgtaaacgaaaccggttggttacgtattacgaacgttaaagtaccgaaacgtacgtacccgtaaaggaaccggaatacccggaacgtacgtccgttaacgtaactttcgaaccgttaccaacggtacgtaacggtacgtacggtacaaccccggtaagttaacccgggtaaacgtaaacggggtcgttaaccggttttaagtaccgggttttaaccccgttttaaagggacccctttttagggggtaacccccgggtaacgggaaacccccgggtttaagtaaaaccccccgggttggttttacccccgggg

SEQ ID NO: 113137 - DNA, 668 bp, Homo sapiens
  misc_feature: GYAE6OF01ERKNN.15.86.H09.1.454.CMB.1.raw
  modified_base (595)..(595): a, c, t, g, unknown or other
  misc_feature (595)..(595): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgccgaggctccgaggggaaggggctgggaggtgggttggtacgtttacaaaagtaaaatgagtggtagaaagaaatagacgtacggtgacgacccgtagaaaggaagattacacctatcctagaagaagtaataaacttacgaaaaacggtcggttagttaagtttacgaactaaaagtacgaaacgtacgaccgttaaacggaaaacccggagaaccacgacgacccgttactaacttacgtacgtaaccacgtaagtagttacggagtgactacgtacggaacgtaaaggnggacttagtacgttcgtttagtaacgttacgttccggtacggggaacccgtaggggaacctaggttacccggg

SEQ ID NO: 113138 - DNA, 797 bp, Homo sapiens
  misc_feature: GYAE6OF01A4LYM.15.86.H09.1.454.CMB.1.raw
  modified_base (715)..(715): a, c, t, g, unknown or other
  misc_feature (715)..(715): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtgggggagtccgttggtaaagccgtgggggtcccttagagtctcctgtgtcggcctctggtacttctactttcgaagtaagtggtcgtggagtggtaggttcggggtcccgaccgacggcctaccggaggggaacggggtccgtgggagggttggggttacggtacgttttaacgaaaaaggttaaaagtaggtagtagggtagaaagtaaaagtaggtaaccgtacggtacgaccgtaacccggtaaggaaacggtaacgtacttaaccgaacctaacgtactacgaaagtaagtaacgttaaacttaacgaaaaaccggtacggttagtaactttacggaaccttaaaagtacgaaacctacggtaacccctaaaggaaaacccgtacggtaaccaaccgtacggtacccgttaacgttaacgtttaaccgtacgtaacccaagtaacggtacgttacggtaacggtcgaacgtaacggtaaccggtaaacggttaaaacggggngttaccgttagttacggttacttttaggaactttacggtacgggtaccggggaacccgtacgggtaaccgtaaggttccggg

SEQ ID NO: 113139 - DNA, 859 bp, Homo sapiens
  misc_feature: GYAE6OF01DG5L0.15.86.H09.1.454.CMB.1.raw
  modified_base (293)..(293): a, c, t, g, unknown or other
  misc_feature (293)..(293): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaacggccgttggggggtccccttaggacgttcctccgtggtgtcggcctcgtggtacttctaccttnagtaagtggctggtatggaggttcgggtccgccgaggccgtaccgagggggaaggggtccgtgggtacggttgggggttaggtaaccggtttaacgaaaaaaggttaaaatgggtaagtaggggtaagtaaaggaaaagtacggacgttacgggtacgacccgaacccgggttaaggaaaagggtaaacgtacttaccgaaccgtattacctaacgaaaggtaaagtaaagttaaacgttaaaccgaaaaaacgggttcgggtttaaagttaacgttttaacggaaacttaaaagttaccggaaaaactaccgggtaaaccccgttaaacggaaaaaaccccgggtagggaaaccctaaccggtaaccggtaccccgttttaacgttaacttttaacccgtacggtaaaccccaaggtaacggttaacggttaacccggtaaggtcgaccgtaaaggtaccggtaaaccgggtaaaagggtcgggtaacttaaggttcggtttccgtttaagtagttacggttccgggtacccggggaccgtaagggtaccgtaagggttcccggg

SEQ ID NO: 113140 - DNA, 581 bp, Homo sapiens
  misc_feature: GYAE6OF01BU791.15.86.H09.1.454.CMB.1.raw
  modified_base (301)..(301): a, c, t, g, unknown or other
  misc_feature (301)..(301): n is a, c, g, or t
  modified_base (461)..(461): a, c, t, g, unknown or other
  misc_feature (461)..(461): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccnccaggctccagggaaggggctggagtgggttggacgtttacaaaagtaaaatgatggtagagaaatagactacggtgcaccgtagaaaggagattcacgatctacaagagataatacaaaacgacggtagtatttgacaaatgaacagcctagaaaccgngacacagccgtactattacctgtaccatagattcggaagtgacagtcgaacggtaaaggaggccttaagtcggtcttttagattacgtcgtaggggacccctaagggactaagttcgggg

SEQ ID NO: 113141 - DNA, 683 bp, Homo sapiens
  misc_feature: GYAE6OF01D1OG2.15.86.H09.1.454.CMB.1.raw
  modified_base (428)..(428): a, c, t, g, unknown or other
  misc_feature (428)..(428): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctgtggattctactttcagttaatggctggatggtaggttcgggtccgccaggcctccggaggggaagggcgtggaggtgggttggtacgtttacgaaaagtaaaatgagtggtagaagaaaatagacgtacggtgcgacccgtaggaaaggatattcactatctanaagagaataataacgaaaacgcggttagttatttagactaaatagaacagaccgtaaggaaaacccgaggaaccaacgacgtaccttacttaacttaccgtacgtaacccagtacgtaacgtttcgggaaagtcgtacgtagtaccgggtaaacggtaaaagggaccgggtacttaagttcggttaccgttttaggtaacttacggttccgggtaccgggggacccgtaaggggtaacctaagggtttcccgggg

SEQ ID NO: 113142 - DNA, 851 bp, Homo sapiens
  misc_feature: GYAE6OF01AO5GA.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaaggtgtccagtgtgaagtgcgaggtggtggagtcgtgggggagccgttaggtaaacgccgttgggggtcccttaggacgtctccgtggtggtcggtcctacgtggtactttctacgtttcaagttaagtggtctggagttaggtacgggtttcggggtacccgccgtaagggcccttaccgggaagggggtaacgggggtccgttaggggtagggtttacggggtttacgggtaaccggttttaaacgaaaaaaggttaaaaacgttggtaagttaggggtaagaaacggtaaaaagttaggtaaccgttaacggtacgaccgtaacccggtaaggaaaacggacgtaacgttaccaaccgtaactctaacgaaaggtaagtaaacgttaaacgtaaccgaaaaacggtcggttaagttaattagaactaaaagtacgtaaacgacgtaaccgtaaaggaaaaccgtacgaactaacgacgtacccgtaacttaacgttaaccttacgtaacccgaagtaacgtaaccgttacgggaaagtcgaacctaacgggtaaacggtaaaacccgggttaaaggaacgggttacccttaaggtttacgtttacgttttaacggtacttaacggttccggaacccgggggtaacctaacggggtaaacctagggtttcccggg

SEQ ID NO: 113143 - DNA, 817 bp, Homo sapiens
  misc_feature: GYAE6OF01CQDLG.15.86.H09.1.454.CMB.1.raw
  modified_base (215)..(215): a, c, t, g, unknown or other
  misc_feature (215)..(215): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttcctgcgtgctatacttaaaggtgtccagtgtgaagtgcaggtggtggagtcgtgggganccgttaggtaaagccgtgggggtcccttagacgtctccgtgtgtggcctcgtgattcactttcgagtaatgggctggattggtacggttcggggtcccgaccgacggccgtacccggaagggggtaacggggggccgttaggggaagggttcgggggtttacgggtaaccggtttttaaacgaaaaaaagggttaaaaatggtaagttagggtaagaaacgtaaaaagttgaaccggtacggttacggacccgtaacccggtaaaggaaaagggtaacgtacgttaacccaacgtaactactaaaccgaaaggtaacgtaattaaacgttaaacggaaaaaaccggtcggtttaagttaagtttaacgaactaaaagtagaaacctagaaccctaagggaaaacccgaaggtacccaaccgacgtaccgtacttaacgttaaccgtacgtaacccaacgtagtaacgtcggtaaacgtgaacctaaacggtaaccggtaagggtaaagggacggttaacgttagtttagttccgttttaaggaacttttacggtacccggttacgggggacccctaaaggggtaacctaggtttaccggggg

SEQ ID NO: 113144 - DNA, 697 bp, Homo sapiens
  misc_feature: GYAE6OF01CXN89.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattctactttcaagtaatggctggatgtagttgggtccgccaggctccgaggggaggggctgggagtgggttggacgtttacaaaaataaatgataggtagaagaaaatagactacggtgacgaaccgtagaaaggaatacttaccaacctatctacgaaagtaagtaattaactaaccgaaaaacggtcggttaagttaatttaggaacctaaaagtacgaaaacctacggaccctaaaggaaaaacccgaggaaccaacgtacggtacccttaattaacgtttaacctacggttaaccccaagtaacgttagtttaaccgggaagttcgacctaacgttaccggaaacggttaaaagggcggtacttagtcggttactttttagaattcgtaccggtacgggggaccctaaggggactaaggttcgggg

SEQ ID NO: 113145 - DNA, 600 bp, Homo sapiens
  misc_feature: GYAE6OF01B9DTA.15.86.H09.1.454.CMB.1.raw
  modified_base (423)..(423): a, c, t, g, unknown or other
  misc_feature (423)..(423): n is a, c, g, or t
  modified_base (557)..(557): a, c, t, g, unknown or other
  misc_feature (557)..(557): n is a, c, g, or t
  modified_base (574)..(574): a, c, t, g, unknown or other
  misc_feature (574)..(574): n is a, c, g, or t
  modified_base (592)..(592): a, c, t, g, unknown or other
  misc_feature (592)..(592): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgttggtaaagccgtggggggtcccttagagtctcctgtgtggcctctggattcactttcagtaatggctggatgagttcggggtccgccgaggctccgagggaagggggctgggagtgggttggacgtttacaaaagtaaaatgatggtagaagaaaatagacgtacggtgacacccggtagaaaggaagatcaaccatctanaagagataaattacaaaaacgtacggtagtatttgacaaatcgaaacagacctaacgaaaaccgagacacgacgccgtactaattactcgtaaccacgtaagtagttacggaatcgacagtacgacgtaaaggngtactagtatcgtttanatgtcgcgggaccagggnaggttcgg

SEQ ID NO: 113146 - DNA, 576 bp, Homo sapiens
  misc_feature: GYAE6OF01DI3I3.15.86.H09.1.454.CMB.1.raw
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
  modified_base (472)..(472): a, c, t, g, unknown or other
  misc_feature (472)..(472): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctggaggtgggtggacgtttcaaaagtaaaatgatggtnaagaaatagactaggtgcaccgtagaaaggaagattcaccatcncaaagagaataattacaaaacgcggtagtaatttagactaaatagaacagacctagaaaccgagacanacgctatatatgtaccacagattcggaagtgacagtacgacggttaaaggagggctaattgtcttttagattacgtcgtaggggcccaaggggataggtacggg

SEQ ID NO: 113147 - DNA, 694 bp, Homo sapiens
  misc_feature: GYAE6OF01C98DQ.15.86.H09.1.454.CMB.1.raw
  modified_base (318)..(318): a, c, t, g, unknown or other
  misc_feature (318)..(318): n is a, c, g, or t
  modified_base (500)..(500): a, c, t, g, unknown or other
  misc_feature (500)..(500): n is a, c, g, or t
  modified_base (596)..(596): a, c, t, g, unknown or other
  misc_feature (596)..(596): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtcagtgtgagtgcaggtggtggaggtcgtgggggacgtccgttagggtaaacggccgttcggggggggttacccctttaagggacggttccttccgttggtcggttcgggtcccttcgtagggtaattctaccttttnaagtaagtggtctgggaatcggtaggttcggggtcccgccgaggcttccggaggggaacggggcgtgggaggttggggttaggtaacgtttacgaaaaagtaaaatgtagtggtagaaagtaaaatgaacgtaggtacgccgtaacccgtaggaaagaagtactacaaccatacacaagganaattaataacgaaaacgtggtaagtagttagactaaatacgaatacgaccgtaagaaacccgagtaccactacgcgtactagttactagaacccanagtagtacggaattcgagttataccggaaggtaaaaggcgtaacgttagttggttctttagacttagtcgggtacgggccgaagggcgtaaggtcggg

SEQ ID NO: 113148 - DNA, 727 bp, Homo sapiens
  misc_feature: GYAE6OF01A6EFI.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcgaggcctccgaggggagggctgggagtgggttgacgtttacgaaaagtaaaatgagtggtagaagtaaaatacgtacgtacggtcgaccgtaacccggtagaaaacggaagtattaccaacctactctacgaaagagtaattaaacttaaccgaaaaaccggtacggttagttaagttttacgaactaaaagttgaaaccgtacgtacctaaggaaaacccggaggaaccacgtacggacccgttacttagttaaccgtacgtaaccctaacgtaaggtacgttacggtaagtccgtacgtaacggttacggtaaaacggtaaagggacggtaccgttaagttacggtttacgttttacgaagtttaccgttacgggtacccgggggtaccccgtaaagggggtaaccgtaaggtttaccgggg

SEQ ID NO: 113149 - DNA, 654 bp, Homo sapiens
  misc_feature: GYAE6OF01BRB9H.15.86.H09.1.454.CMB.1.raw
  modified_base (522)..(522): a, c, t, g, unknown or other
  misc_feature (522)..(522): n is a, c, g, or t
  modified_base (571)..(571): a, c, t, g, unknown or other
  misc_feature (571)..(571): n is a, c, g, or t
  modified_base (593)..(593): a, c, t, g, unknown or other
  misc_feature (593)..(593): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttagggtaaagtccgtgggggggtccccttaggagtcctccgtgtgtggcctctggattctactttcagtaatggctggatgaggttggtccgccaggctcggaggggaggggcgtggaggtgggttggacgtttaacaaaagtaaaatgaagtggtagaagaaaagtagaacgtacggtcgaccgaacccggtaagaaaggtaagacttacacctatactacaaagagaattaaactaacgaaaaacgtcggtagttagtttagaactaaagtacgaaacagtacctaacggaaaaccgngaaccagacgtaccgtactaagttacacgtaccagtagtagtacggaangactagtacgtaaaggtaaagnggtacttagtgttactttaggattacggtcgtacggggacccaagggtacctaggttcggg

SEQ ID NO: 113150 - DNA, 636 bp, Homo sapiens
  misc_feature: GYAE6OF01BJEKF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgaggggaaggggctgggagtgggtggacgtttacaaaagtaaaatgatggtagaagaaaatgactacggtgacaccggtagaaagagtattcaccatactacgaagagaataaattacgaaaaacggtcggtagttattagactaaatgaacagacctaagaaaccgaggaacacgagacccgtataacttactacgtaaccacgtagtacgtttacgggaagtcgactaacgtaccggaaacggtaaagggacgtacgttaagtggttccttttaggaatttacgtccggtcgggggtaccccaaggggtacctaaggttcgggg

SEQ ID NO: 113151 - DNA, 676 bp, Homo sapiens
  misc_feature: GYAE6OF01BHGQX.15.86.H09.1.454.CMB.1.raw
  modified_base (395)..(395): a, c, t, g, unknown or other
  misc_feature (395)..(395): n is a, c, g, or t
  modified_base (435)..(435): a, c, t, g, unknown or other
  misc_feature (435)..(435): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaagccgtgggggtcccttagagtctcctgtgtcggcctctggattcactttcagtaatggctggatggtaggttcgggtccgccgaggccgtccgaggggaaggggcgtgggaggtggggttggtacgtttacgaaaagtaaaatgatggtagaagaaaatagacgtacggngccgaacccggtagaaaggaagtacttaccaaccatctanaagagtaattaaatacgaaaaacggtcggttagttaatttagaactaaaagtgaaacacgaccctaaaggaaaacccgaggaacaccgacgtcccgttactaattactacgtaacccagtagtagtttacggaagtgacagtaccggaaaggtaaagggacggtacttaagttcggttacgtttttagacgtttacgtccgggtaccggggaaccccgaaggggtaacctaaggttccggg

SEQ ID NO: 113152 - DNA, 712 bp, Homo sapiens
  misc_feature: GYAE6OF01D360U.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtggggagccgttggtaaagccgtgggggtcccttagagtctcctgtgtcggcctcgtggattctactttcagttaagtggctggatggtaggttcggggtcccgccgaggcctaccgagggggaacgggctggggaggttggggttggaacgtttacgaaaaaggttaaaatgaagtaggtagaaagaaaagtagaacgtacggtcgaccgaccgtaggaaaggaacgtataccacatcctacgaagagtaataactaacgaaaacgtcggttattagtttacgaataaagtacgaaactacgaccctaaaggaaaacccgaggaacctaccgacggtacccttattaacgttaacctacggtaacccaagtacgtaacgttacgggaacgtcgacctaaggtaccggtaaaacggtaaaggaacgggtcttaagttcggttacttttagaacttacgttccgggtacgggggacccctaaaggggccttaagggttccggg

SEQ ID NO: 113153 - DNA, 737 bp, Homo sapiens
  misc_feature: GYAE6OF01A8JJA.15.86.H09.1.454.CMB.1.raw
  modified_base (467)..(467): a, c, t, g, unknown or other
  misc_feature (467)..(467): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttggtccgccaggctccgaggggaagggctgggagtgggttggacgtttacaaaagtaaaatgaatgggtagaagaaaatagaacgtacggtgaccgaccgtaggaaaggaagtacttcaaccatctacaaagagtaataacttacgaaaaacgtcggtagttaaggtttanaacaaaagtgaaactagacccgtaacggaaaaacccggaggaaccaacgaacggtacccgttacttaacttaaccgtacgttaaccccaacgtaacgggtaacgtttaacccgggaaaggttccggaacgtaaacgttaaccgggtaaacggttaaaaacggggacgggttacgtttaaggttacggttacgttttttaggaacgttttaacggttcccggttaccggggggaaccccgtaagggggtaaaccctaaagggtttccgggg

SEQ ID NO: 113154 - DNA, 883 bp, Homo sapiens
  misc_feature: GYAE6OF01B0A10.15.86.H09.1.454.CMB.1.raw
tcagtctacgtagccacgaccggtgctcgatttagtgctatagacttaggttagggggagagggagccccacgccttgggattccccgaagtgtttcattcgtacgtgtatcaggttaactggaacaccagaggactcggaccactgggaggttcgggctgggagccgtgggttttccctgcctggctactctaaaggtgtccagtgtgtagtcgctaggtggttcgtagtacgttggggatcccttaggtaaacgccgtagggggttcccgttacggacgtcgtcctcgtaggtcggccgtctggattcgtacgttcaagttaatggctaggatggagttcgggtcccgccgaaggtaccttacccgaaggggaacggggtacgttcgggtaggtagggggttacggtaacgttttaccgaaaaaacggttaaaaattcgtaacgtagggtaagaaacgtaaaaattacgaacgtaacggtacgtactacccgtagaaaacgaagtactacaaccgtactacgtaacgaacgaacggtaactaacgtaaccgaaaaacggtaccgggttagtttaagttttacggaacgtaaaagttacggaaaacgtaacgggtacccgtaaacggaaaaaccccggaacgggtaaaccctaacggtaacggtaacccccgttaaacgtttaacgtttaaccgtaccgggttaacccttaacggtaacgtaacgggttacccggaaacgggttccgaccgtaacgtaccgggtaaaccggttaaaccgggtacccggtaacgttaacgtacggttaccgtttacgaaccgtttaacccgttcccgggtaaccggggacccgtaacggggtaaccgtacgggttacccgggg

SEQ ID NO: 113155 - DNA, 566 bp, Homo sapiens
  misc_feature: GYAE6OF01AOG8M.15.86.H09.1.454.CMB.1.raw
  modified_base (460)..(460): a, c, t, g, unknown or other
  misc_feature (460)..(460): n is a, c, g, or t
  modified_base (518)..(518): a, c, t, g, unknown or other
  misc_feature (518)..(518): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgcaggctccagggaaggggctggagtggttggacgtttacaaaaggtaaaatgatggtagaagtaaaatagacgtacggtgcacccgtgaaaggagattcgaccatctacaagagataatacaaaacgcggtagtattgacaaatgaacagcctagaaaacgnggacacagccgtactatacacgtaccatagattcggaatcgactatcgaagtaaaggngtactagtgtctttgaacttagtcgaggggcccagggactaagtcggg

SEQ ID NO: 113156 - DNA, 837 bp, Homo sapiens
  misc_feature: GYAE6OF01DCIG7.15.86.H09.1.454.CMB.1.raw
  modified_base (325)..(325): a, c, t, g, unknown or other
  misc_feature (325)..(325): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttcgggtccgccaggctccgaggggaaggggctggngtgggttggacgtttacaaaagtaaaatgagtggtagaagtaaaagtagaacgtaggtcgacgtaaccccggtagaaaacgggaaagtacgttacaaccctagtacctacgaaaaggtaacgtaattaaaacgttaaccgtaaaaaaaccgggtaccgggtttaaggtttaacgtttttacggaaaccgttaaaagttaacggtaaaaacctaacggtaaccccgtttaaaggaaaaaaacccccggtaagggaaacccgtaaaccgtaacggtaccccgtttaaccgtttaacgtttaacccgttaaccgttaaccccgtaaacgtacggttaaacgtttaccggggtaaacgttacggtaccgtaaacgttaaccgggtaaaccggttaaaaacgggaacgggttcccttaaaggtttacggttaccgttttttaaggtaaacgttaacggtttcccggttaacgggggggccccttaaaacggggggccgttaaaaggtttcccggggg

SEQ ID NO: 113157 - DNA, 845 bp, Homo sapiens
  misc_feature: GYAE6OF01BV62M.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggggagtccgttagggtaaagccgtggggggtcccttaggagtctcctgtgtggcctcgtggattccactttcagtaatggctggatggagttgggtcccgccgaggctccgaggggaaggggctagggaggttggggttaggacgttttaacgaaaaagtaaaaatgtaatagggtagaaagaaaagtacggacgtaacggtcgaccgtaacccggtaaggaaaagggaaacgtaacttaccgaaaccctacgttacccgttaacgaaaacggtaaagtaaacgtttaaaactttaaaccggaaaaaaaccggggttacccgggtttaagtttaacgtttttacggaaaacccgttaaaaagtttaacgggaaaacgtaaaccggtaaccccgttaaaacgggaaaaaaccccgggaaaccgggtaaaccaacccgtaaccgggtaccccggttttaaccttaaaccgttttacccgtaacggtaacccccgtaagaacgtaacggtttaccggaagtcgtacaacggttaacgaaacgggtaaacgggacggtacttaagtcggtttcgttttagaacgttaacgtttccgggacggggtaaccccggaaggtaccgtaagggttcccggg

SEQ ID NO: 113158 - DNA, 787 bp, Homo sapiens
  misc_feature: GYAE6OF01BNPF1.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtcccttagagtctcctgtgtggcctctggattcactttcagtaactggctggatgaggttcggtccgccaggctccgaggggaacggggcgtgggtaggtgggttggtacgtttaacgaaaaggtaaaatgtatggtagaaagtaaaagtagacgtacggtcgaccgtaacccggtaggaaacggtaagaactttaccgaaccgtactaccgttaacgaaaggtaaagtaacttaaagttaaccgtaaaaaacggtaccgggttttaagtttaactttacgggaaaccctaaaagttaccggaaaacgtaacggtacccgtaaacggaaaaaccccggtagggaaccctaaccggacggtaccccgtttaacttaaacgtttaccgtaacggttaaccccaacggttaacggttaacgttacccgggtaaagttccgaacgtaacgttaccggaaacgggttaaaggtacggtacgttagttcggttattttacgagttacggttaccggtaccgggggacccgtaaggggtaaccgtaaggttccgggg

SEQ ID NO: 113159 - DNA, 824 bp, Homo sapiens
  misc_feature: GYAE6OF01DRBNK.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaaaggtgtccagtgtgaagtgcgaggtggtggagtcgtgggggagtccgttagggtaaacggtccggtcggggggttcccttaaggtacgttcctccgttggtggtcggtccttcgtggtacttcgtacttttacgtaagttaagtggcgtggtagtggtaggttcgggtcccgccgaggccgtaccggaaggggaaggggtcgtgggtaggttaggggttaacgtacgtttaaacgaaaaagttaaaaagtggtaagtagggtaagtaaaggtaaaagtagaacgttacggtacgaccgtaacccggtaaggaaaaggaagtactaccaacgtactacgtaacgaaagtaagtaattaaacgtaacgaaaacggtacggttagttaagtttacgaaactaaagtagaaacctagtaacccgtaaagaaaacccggtagaaccgaaccgtaccggtaccttaacgttaacgtttaaccgtaaccgtaaccctaacggtaacggtaacggttaaccgggaagttacgaacgttaacggtaaccggtaaaacgggtaaacggtacggtacttaaggttcggttttagtttagtaagttccgtaccgggttaccgggggaccccgtaaaggggttacgtaacgggtttaccggg

SEQ ID NO: 113160 - DNA, 695 bp, Homo sapiens
  misc_feature: GYAE6OF01EW03W.15.86.H09.1.454.CMB.1.raw
  modified_base (309)..(309): a, c, t, g, unknown or other
  misc_feature (309)..(309): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatacttaaaaggtgtccagtgtgaagtgcaggtggtggagtcgtggggagccgttggtaaagccgtgggggtccctagagtctcctgtgtggcctgtggattctactttcagtaagtggctggatggtagttgggtccgccgnggctccggagggacggggcgtggaggtgggttggtacgtttaacgaaaaggtaaaatgaagtggtagaagaaatagacgtaaggtcgactaccgtaagaaaggaacgtacttacaactactactacgaaagaagtaattaataaccgaaaaacggtacggttagttatttagaactaaaagtacgaaacagaacctaacggaaaaaccggtcgaacacgaacgtcccgtaacttacttacgtacgtaaccgaactaggtaattaccgggaagtgaaccctaaggtaacccgggtaaacgttaaaagggacggttacgttaagtcgttacgttttagaattacggttccgtaccgggggaaccctaacggggtagtaacggttcggg

SEQ ID NO: 113161 - DNA, 655 bp, Homo sapiens
  misc_feature: GYAE6OF01AP77R.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgaggggaggggctggaggtgggttggacgtttacaaaagtaaaagtgagtggtagaagaaatagactacggtgacacccgtaggaaaggaagacttacacctatacctacaaagagaattaactacgaaaacgtacggttagtaatttaggaactaaagtcgaaacagacccgtaagaaaaccgaggaacacgacgacccgtactaacgttacgtacgtaaccacgtacggtaacttacgggaagtcgacgtaagtaccggaaacggtaaagggacggtacttagtcggttacttttaggattacgttccgggtacggggacccgtaagggacctaaggttcggg

SEQ ID NO: 113162 - DNA, 803 bp, Homo sapiens
  misc_feature: GYAE6OF01D3JCQ.15.86.H09.1.454.CMB.1.raw
  modified_base (627)..(627): a, c, t, g, unknown or other
  misc_feature (627)..(627): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtgggttttccttgctgctatacttaaaaggtgtcagtgtgaagtgcaggtggtggagtcgtgggggagtccgttggtaaacgccggttgggggtcccttagacgtctccgtgtgtcggcctcgtggacttctactttcgagttaagtggcgtggatggtaggttcggggtcccgccgaggtccgtaccggaaggggaacgggggtcgtaggggtaggttggggttacggtaacggtttaacgtaaaaagtaaaagtgtaagtagggtaagaaagtaaaaagtagtaaaccgtacggtacgtaccgaacccggtaaggaaaaacgggtaagtaacgttaccgaaacccgtaacttaccgtaacgtaaaaggtaacgtaaacttaaaacgttaaaccgaaaaaaccgggtacggtttaagttaacgtttagaaacctaaaagttacggaaactacggtaacccgtaaacggaaaaaccggnggtaaaccaccgtacgacccgtttaactaactttaaccgtaacgtacccaagtaagttaccgttaacgggaactagaaccgtagtaaccggtaaggtaaaaggcggtactagttacgtttacgtttagaacgttacgtccgggttaccggggaccaagggtaccaaggttcccggg

SEQ ID NO: 113163 - DNA, 877 bp, Homo sapiens
  misc_feature: GYAE6OF01CIJW3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagcttgggttttccttgctgctatacttaaaggtgtccagtgtgagtgcgaggtggtggagtcgtgggggagtccgttagggtaaacgccggtcggggggtccccttaaggtacgttccgttccgttggttcggtcggtcccttcgtggtactttcctaccttttacgaaggttaagtcggtcgtggtagttggtaggtttcggggtaccccgccgtacggcccgtaccgggaagggggaaggggccgttaggggaggttggggtttacggtaaccggttttaacgaaaaaaggttaaaaagttggtaaagttagggtaagtaaaggtaaaaagtacggaacgttaacgggtacgacccgtaacccgggtaaggaaaacgggtaacgtaactttacccgaacgtactacgtaaccgaaaggtaaacgtaacttaaacgttaaaccgtaaaaaaccggtacgggtttaagtttaacgtttaacgaaacgttaaaaacgtcggtaaaaccgtaaccggtaaccccgtaaacgggaaaaaccccggtacggaaccctaaccgaccggtacccgtttaacttaactttaacccgttacgtaacccaacgtaaggtacgtttaacggaagttagacccgtaacgttaacgggaaaccggtaaaaggcgtacgttagttcgttcgtttagactttaccgtcgggttaccgggacccgaacgggtacgtaggttccggg

SEQ ID NO: 113164 - DNA, 752 bp, Homo sapiens
  misc_feature: GYAE6OF01CCH3L.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaacgccgtgggggtcccttagagtctccgtgtgtggcctctggattctacttcagtaatggctggatgagttggtccgcaggctccgagggagggctgggagtgggttggaacgtttacgaaaaggtaaaatggaagtgggtagaagaaaagtacgacgtacggtagacgaacccggtaggaaaaggaagtaattaccaccgtatacgtacgaaagagtaacttaaagttaaccaaaaacggtgtttagggtacgttaagtttcggaaactaaaagtacgtaaaccgaaggtaaccctaaacgggaaaaacccgtacggaaccaacgtacggacccgttaacttaacgttaacgtacgtaacccaagtaacggttaacgttacgggaacgttcggaaccgttaacggtaccggtaaaaccgggttaaagggacggttaactttaagggttccgtttacgttttaacggtaacttacggttacccgggtaacgggggaacccccggtaaaggggaccctttaaacgggg

SEQ ID NO: 113165 - DNA, 634 bp, Homo sapiens
  misc_feature: GYAE6OF01D6Z8I.15.86.H09.1.454.CMB.1.raw
  modified_base (393)..(393): a, c, t, g, unknown or other
  misc_feature (393)..(393): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccttggtaaagcctggggggtcccttagagtctcctgtgtggcctctggattcactttcagtaatggctggatgagttggtccgccaggctccaggggagggctgggagtggggttggacgtttacaaaagtaaaatgatggtagagaaaatagactacggtgcacccgtgaaaggaanattcaccatctacaaagagaataattacgaaaaacgtacggtagtatttagactaaatagaaacagaccctaggaaaacccgaggaacacgagcccgtactacttaacctgtaaccacgagtacgttacgggaagtcgacaacgtaacgaccggtaaaagggacggtacttaagttcggttactttttaggattaagttccggtacggggggaccccctaaggggtaccaaggttacgggg

SEQ ID NO: 113166 - DNA, 708 bp, Homo sapiens
  misc_feature: GYAE6OF01C7PUU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaagccgtggggggtcccttagagtctcctgtgtggcctctggattcactttcagtaatggctggatgaggttgggtccgccaggctccgaggggaggggctgggaggtggggttggacgtttacgaaaagtaaaatgagtaggtagaagtaaatagacgtacggtcgaccgacccggtagaaaggaagtacttacaccatctacaagaagaattaattaacgaaaaacggtcgggttagttaagttttagaactaaagttacgaaacacggaaccctaaggaaaacccggaaggaaccaaccgaacggacccgttacttaactttaaccgtaccgtaacccaacgtaaggtacgtttaaccgggaaggttcgactaacggtacggaaaccggttaaagggacggtacttaagttcgttacgtttttagagttaacgttcggtaaccgggggtacccgaacggggtaccgtaaggttccgggg

SEQ ID NO: 113167 - DNA, 699 bp, Homo sapiens
  misc_feature: GYAE6OF01EB9MH.15.86.H09.1.454.CMB.1.raw
  modified_base (356)..(356): a, c, t, g, unknown or other
  misc_feature (356)..(356): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatcttaaaaggtgtccagtgtgaagtgcaggtggtggagtcgtgggggagccgttggtaaacggccgttggggggtcccttagagtcctccgtgtgtggcctctggattcactttcagtaatggctggatgtagttgggtccgccaggctccggagggaaggggctgggaggtgggtggtacgtttanaaaagtaaaagtgagtggtagaagaaaatagaacttagtggtacgaccgtaaccggtagaaaaggaagtacttacgaaccattcctacgaaagaagaattaaacgttaaccaaaaaacggtcgggttattaagtttacggaactaaaagtagaaacctacgacccgtaaacggaaaaccggaggaacaaccgacgtaccgtacttattacgtacgtacccaagtacgtagttacggaagtacgtaccaagtaccggtaaaccgtaaagggacgtacgttagtttctaacgtttttagaactttacggtacggtaccggggaccccggtagggtaccgtaacgg

SEQ ID NO: 113168 - DNA, 632 bp, Homo sapiens
  misc_feature: GYAE6OF01A9WCU.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagttaatggctggatggtaggttcgggtccgccgaggctccgaggggaaggggcgtgggtaggtgggttggacgtttacaaaagtaaaatgagtggtagaagaaatagacgtacggtgacaccgtagaaggagatacacatctacaagagataattacgaaaacgtcggttattaacgtttagaactaaatcgaaacagtacctaaggaaaacccgtggaacacgacgtccgtactattaacgtacgtaacccactaagtacttacgggaatgacctaagtaccggaaagtaaagggcgtaactagtcgttcgttttagattacgtcggtacgggaccctagggactaaggtcggg

SEQ ID NO: 113169 - DNA, 671 bp, Homo sapiens
  misc_feature: GYAE6OF01CSUE3.15.86.H09.1.454.CMB.1.raw
  modified_base (466)..(466): a, c, t, g, unknown or other
  misc_feature (466)..(466): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattctactttcagtaagtggctggattgaggttcggggtccgccaggcctccggaggggaaggggctgggaggtgggttaggacgtttacgaaaagtaaaagtgaagtggtagaagaaaatagactaggtgacaccgtagaagaagaatacacactactactagaagatataaacgaaacgaacggtgttattacgtanaaataagtaacagtaccgaagtaaaccggaacggacaccagaccggttacctaagtttactacgtaaccgaacgtagtagttaccggtaaggtagacgaccgtacggtaacggtaaagggtaacgggtcgtattcggtttaccgttttagtagttaacgttcccgggttacggggcccggtaaacgggtaaggtacggttacggg

SEQ ID NO: 113170 - DNA, 650 bp, Homo sapiens
  misc_feature: GYAE6OF01B85KS.15.86.H09.1.454.CMB.1.raw
  modified_base (481)..(481): a, c, t, g, unknown or other
  misc_feature (481)..(481): n is a, c, g, or t
  modified_base (498)..(498): a, c, t, g, unknown or other
  misc_feature (498)..(498): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttaggtaaagccgtgggggtcccttagagtctcctgtgtcggcctcgtggattctacttcagtaatggctggatggtagttcgggtccgcgaggctccgaggggaagggctgggaggtgggttaggtacgtttacaaaagtaaagtgtagtaggtagaagaaatagacgtacgtgacgaaccgagaaaggatactcaactactctacaagagtaattaactaacgaaaacgtggttagttattcgaataaagtacgaanacgactaagaaaaccgnggaacacgagtcgtacttactaactgtaaccagtagaacgttacggaagttcgacgtaacgtacgaaacgtaaagggcgtactagttacggtttacctttagaattacggttccggtacgggtaccgaaagggtaccgtaaggtttcccggg

SEQ ID NO: 113171 - DNA, 592 bp, Homo sapiens
  misc_feature: GYAE6OF01D3JXW.15.86.H09.1.454.CMB.1.raw
  modified_base (393)..(393): a, c, t, g, unknown or other
  misc_feature (393)..(393): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttggtccgcaggctccagggagggctggagtgggtggacgtttcaaagtaaaatgatggtagaagaaaatagacgtacggtgcacccgtagaaagganagtcacatctacaagagaataatacaaaacgtacgtagtattgacaaatagaacagacctagaaaaccgagacacacgcgtctaattactagtaccacgtagtacgttacggaagtgacagtccggaacgtaaagggaggtcttaagtgttcttttagattatcggtacggggaccccaaggggtactaggttacgggg

SEQ ID NO: 113172 - DNA, 779 bp, Homo sapiens
  misc_feature: GYAE6OF01AVHYK.15.86.H09.1.454.CMB.1.raw
  modified_base (247)..(247): a, c, t, g, unknown or other
  misc_feature (247)..(247): n is a, c, g, or t
  modified_base (708)..(708): a, c, t, g, unknown or other
  misc_feature (708)..(708): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcggctgagcgtggtttcctgactgctatacgttaaaggtgtccagtgtgaagtgcaggtggtggagtcgtgggggagccgttaggtaaagccgtgggggttcccttaagngtctccgtgtgtggcctcgtggatttcacttcagtaagtgcgtggatgtagttcggtcccgacgaggtccgtaccggaggggaaggggtcgtgggtacggtggggtttaggtaacgttttaacgaaaaaggtaaaaagtggtaagtgggtaagaaacgtaaaagtacgtaacgtaacggtcgaaccgtaacccggtaaggaaaacggagtaacttaccgaactataccgtaacgaaaggtaactaagtaaacttaacgaaaacggtacggttagttaacttagtaaccaaagtcgaaacgaacgtacccgtaaggaaaaacccggacggaaccaacgtaccgtacccgttaagttaaactttaccgtaccgtaaccaacgttaacgtacggttaacgaacgttcgaaccgtagttaaacgggaaaccgtaaaaggggtaccgtacgtttagttacgggttnttttaaggtacgttacggttccggggtaacccggggtaccgtaacggggttaaccgtaaggggtttcccgg

SEQ ID NO: 113173 - DNA, 797 bp, Homo sapiens
  misc_feature: GYAE6OF01C2OSE.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctccgtgtgtggcctctggattcactttcagtaatggctggatggaggttggggtccgcgaggctccgagggaggggctggagtgggttggacgtttacaaaagtaaaatgagtggtagaagaaaatagaacgtacggtagaccgaacccggtaggaaaaggaagtattacgaacctagtctacgaaagaagaattaattaacgaaaaacggtacggttattaagtttagaactaaagtacgaaacaggaccctaagaaaacccggaagggaaccaacgtaacggtacccgttaaccttaacgtttaacctacggttaaccccaacgttaaggtaactttacccggggtaaaggttccgaccgtaaacggttacccgggaaaacgggttaaaacggggtacgggtaaaccctttaagggtttaccggtttaacggttttttttaaacgggaacgttttaaaccgggtttacccggggttttaaccccgggggggaaccccccgggttaaaacgggggtaaacccggttaaaacgggttttaccccgggggg

SEQ ID NO: 113174 - DNA, 667 bp, Homo sapiens
  misc_feature: GYAE6OF01EWOLN.15.86.H09.1.454.CMB.1.raw
  modified_base (180)..(180): a, c, t, g, unknown or other
  misc_feature (180)..(180): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacccgcttaaaccgggacaaccgtcgcccggccaacatagccttcctcccgtcccccttcgcacgtaacaccaagtacaggaatacttaacctgtttcccatcgactacgcctttcggcctcgcgttagggtcactcacctgccccgattacgtgacaggacccttggtcttccggcgaggcggtctttccacccgtctttactcgttacttatcgtcagtctattcgctacttctgactacctcagcatcgcctcacacgccacctaccttacacacggtacttaccaacgaacccgtccctaccccctaacccaaccaaccgcaacgtaacgccggtccgccgtacggcccgacgtacggtcccttacgggtcgtaccgttaggttccgggtttaacccgttcccccgtttacaccgtttcccctttccccggacccttacgttcccgtacgtaaccggtacccgtacggtaacgtaccgg

SEQ ID NO: 113175 - DNA, 706 bp, Homo sapiens
  misc_feature: GYAE6OF01DHVGP.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttggtaaagccgtggggggtcccttagagtctcctgtgtggcctctggattctacttcagtaatggctggatgtagttgggtccgccgaggctccgaggggaaggggctgggaggtgggtggacgtttacaaaagtaaaatgagtggtagaagaaaagtagaactacggtgacgaacccggtagaaaggaagacttcaaccctatactacaaagagtaataaacttaacgaaaaacgtacgggttagttaactttaggaactaaaagtacgaaaacacggaccctaaggaaaaacccggagggaaccaaccgagacccgttacttaatttaaccgtacgttaacccagtaacggtaacgtttaccgggaagtcgaaccgtaagtaaccggtaaacgggtaaagggacggtaaccttagttcggttcgtttttaggaatttacgtccggttacgggggacccctaaggggtaaccgaggtttccggg

SEQ ID NO: 113176 - DNA, 675 bp, Homo sapiens
  misc_feature: GYAE6OF01D7IJC.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccgaggctccgagggaagggctggagtgggtggtacgtttacgaaaagtaaatgatggtagaagaaatagacgtacggtgaccgtaacccggtagaaaggaagatttaccgaacctatcgtacgaaagaagtaataacttaacgaaaaacgtacggttagttaatttagaactaaagtacgaaacacgaccgtaacggaaaacccggagaaccaacgacgtaccgtacttaacgttaccgtagtaacccgaacgtacgtaacgtttaccggaagttcgacgtacgtacggaaccggtaaagggacggtccgttaagtcggttacttttagagttacgttcggtacgggggaccccaagggacgtaggttacggg

SEQ ID NO: 113177 - DNA, 703 bp, Homo sapiens
  misc_feature: GYAE6OF01D4F54.15.86.H09.1.454.CMB.1.raw
  modified_base (529)..(529): a, c, t, g, unknown or other
  misc_feature (529)..(529): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggttttccttgctgctatacttaaaggtgtccagtgtgaagtgcaggtggtggagtcgtgggggagtccgttggtaaacgccgtggggggtcccttagagtctcctgtgtggcctctggattcactttcagtatggctggatgagttggtccgccaggctccgaggggaaggggctgggaggtgggttggtaacgtttacgaaaagtaaaatgatagggtagaagaaaatagacgtacggtgaccgaacccggtagaaaggaataacgttaccaacctatactacgaaagaagtaattaacttaacgaaaaacggtcggttaagttaattttaggaactaaaagtagaaacgtacgacccgttaaggaaaaaccccgnggaaccaacgtacgtacccggttaacttaacgttaacgtaccggtaaccaaccgtaaggtaactttaccgggaaagttcgactaacgtacggaaacggtaaaggacggtcttaagttcgttagttttaggattacggttcggtacggggaccctaagggtactaaggttccggg

SEQ ID NO: 113178 - DNA, 696 bp, Homo sapiens
  misc_feature: GYAE6OF01A0017.15.86.H09.1.454.CMB.1.raw
  modified_base (561)..(561): a, c, t, g, unknown or other
  misc_feature (561)..(561): n is a, c, g, or t
  modified_base (598)..(598): a, c, t, g, unknown or other
  misc_feature (598)..(598): n is a, c, g, or t
  modified_base (639)..(639): a, c, t, g, unknown or other
  misc_feature (639)..(639): n is a, c, g, or t
  modified_base (650)..(650): a, c, t, g, unknown or other
  misc_feature (650)..(650): n is a, c, g, or t
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagcgtgggttttccttgtctgctatacttaaaaggtgtccagtgtgaagtgcaggtggtggaggtcgtggggagtccgttaggtaaacgccgttcgggggggttcccctttaggacgtccttccctggttggtcggccctcgtgggtatttcctaacttttccaagttaaacgtcggtccgttgggattggtacggtttcggggtcccgccaggcctcccgaggggaaggggcgtggaggtgggttggacgtttacgaaaaagtaaaatgaatggtagaagtaaaatagacgtacggtcgaccgaacccggtagaaaaggacgtacttacaacctatactacaagagaattaaactaaccgaaaaacgtcggtatactttaggactaaatgaaactagacctaaggaaaacccgnggaacacgagtacccgtataataccgtagaaccctanagtagttacggaagtcgactagtaacgacgtaaaggcggtnttagtcggttntttggactttacgcggtacggggacccaggggtacctaaggtccgg

SEQ ID NO: 113179 - DNA, 687 bp, Homo sapiens
  misc_feature: GYAE6OF01ALM2P.15.86.H09.1.454.CMB.1.raw
  modified_base (351)..(351): a, c, t, g, unknown or other
  misc_feature (351)..(351): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccttggtaaagccgtgggggtcccttaggacgtctcctgtgtcggcctcgtggtattctactttcagttaagtcggtctgggatggtaggttcgggtcccgccgacggcctaccggagggggaaggggcgtgggnggtgggttcggtaacgtttacgaaaaggtaaaaatgaagtggtagaagaaaagtagacgtacggtcgaccgaccggtaagaaaggaatatacaaccatacgtacaagagtaataacttaacgaaaacggtcggttagttaagttcaactaaagtgaaaccaggtaccctaaggaaaaccggaggaaccaacgtacgtaccgtaccttaattccgtactacccgataggtacttacgggaagtcgacgtagacggtaacggaaggtacgtacttggttagtccgtttagaagtttacgtccgggttacggggacccgacgggtaactagggttccgg

SEQ ID NO: 113180 - DNA, 669 bp, Homo sapiens
  misc_feature: GYAE6OF01COJ44.15.86.H09.1.454.CMB.1.raw
  modified_base (329)..(329): a, c, t, g, unknown or other
  misc_feature (329)..(329): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttgggtccgccaggctccgagggaaggggcgtggngtggggttggacgtttacaaaagtaaaatgataggtagaagaaaatagacgtacggtgacacccggtagaaaggaagattacaaccatactacgaagagaattaataacgaaaacgtaggtagttaatttacgaactaaatagaactacgacctaaggaaaaccgaggaacacgacgacccgttactaacttaccgtactaacccgaacgtagtacgttacggaaaggttcgaaccagtaccggaaacggtaagggaacggtacttaaggtagttacgtttttagaaagtttacgtccggttacggggggaccctaaacgggggactaagggtttccggg

SEQ ID NO: 113181 - DNA, 709 bp, Homo sapiens
  misc_feature: GYAE6OF01DBZ67.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcaggtggtggagtcgtgggggagtccgttaggtaaacgccgtggggggtcccttagagtctccgtgtgtggcctcgtggattctactttcagtaatggctggatgtagttgggtccgccaggctccgaggggaaggggctggaggtgggtggacgtttacaaaagtaaaatgaagtggtagaagaaaatagacgtacggtgaccgaacccggtaggaaaaggaagtacgttaccaacccatacgtacaaagaagtaattaacttaacgaaaaacggtaccgggttagttaagtttaggaacctaaagtacgaaacgacggtacccgtaaaggaaaacccggaggaaccaaccgacgtacccgttaccttaactttaaccgtacgtaacccgtaacgtagtaacggtttacggaagtcgacacgttaaccggaaacggttaaagggacggtacttaggtacgttcttttaggatttacggtccggtacgggaccccggaagggaccgtaggttcggg

SEQ ID NO: 113182 - DNA, 730 bp, Homo sapiens
  misc_feature: GYAE6OF01AT2XE.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaagccgtggggtccttagagtctcctgtgtggcctctggattcactttcagtaatggctggatgagttggtcgccaggcctccgaggggagggcgtgggagtgggttggtacggtttacgaaaagtaaaatgaagtggtagaagtaaaagtagacgtacggtcgacgacccggtagaaaggaacgattcactactctacgaaagaagtaataaagttaaccgaaaacggtacggttagttaactttagaactaaaagtacggaaacctaacgaccccgtaaaggaaaacccgaaggaaccaaccgtaacggtaccccgttaactttaacgttaacccgttaacggtaaccctaacgtaaacggtacgtttaacgggtaacgtacggacctaacggtaccggtaaaaccggtaaaagggtacgggtacttaaggttcggtttaacgtttttagaaacgtttacgtcgggttaccgggggaccccaaggggtaaccgtaggtttacccggg

SEQ ID NO: 113183 - DNA, 677 bp, Homo sapiens
  misc_feature: GYAE6OF01EUYYW.15.86.H09.1.454.CMB.1.raw
  modified_base (264)..(264): a, c, t, g, unknown or other
  misc_feature (264)..(264): n is a, c, g, or t
  modified_base (327)..(327): a, c, t, g, unknown or other
  misc_feature (327)..(327): n is a, c, g, or t
  modified_base (358)..(358): a, c, t, g, unknown or other
  misc_feature (358)..(358): n is a, c, g, or t
  modified_base (391)..(391): a, c, t, g, unknown or other
  misc_feature (391)..(391): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggnttcacttttcagtaatggctggatgagttgggtccgccaggctccgagggaagggcgtgggangttgggacggttacttaacgaaaaattaagngtaggtagtgaaaataaagtataacgtacggtnacccgtacgaaggaaaggaatactaccaactactccaagaagagtaaatttactaaaacgaaaacggttcggtaatttagttgaaaactagacaaagaccgttacgaaaaccgaaaccggagaacccaagaccggtacccgtaatttaacctacgtaccgtaacctaagtaagttacgtaacggtaagtccgaagtacgtaaccgtaaagggtaaggacgtaacttaggtcgttttacgttagacgttaccgtcgggggtacccgaacgggtaggaacttacgggg

SEQ ID NO: 113184 - DNA, 847 bp, Homo sapiens
  misc_feature: GYAE6OF01EO65G.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtgggggagtccgttggtaaacgccgtgggggtcccttaggacgtctccgtgtgtcggtcctcgtggtattcctacttttcagttaagtggcgtggatggtaggttcgggtcccgccgaggccgtaccggaggggaaggggtcgtgggtaggttggggttacggtaacgtttaacgaaaaaggttaaaaagtggtaagtagggtaagaagtaaaagtagtaacgtacggtacgaccgaacccggtaaggaaaaggtaagtacttaccgaacctaataccgtaacgaaagtaacgtaattaaacgtttaaccgaaaaacggttacgggttagtttaatttacggaaccgtaaaaagtacgaaaccgaacgtacccgttaaacggaaaaacccggtaggaaccctaaccgtaacggtaccccgttaacgttaacgtttaacccgtacggttaaaccccaacggtaacggttaacgtttaccggggaaacgtcggaaccgttaaacgtaccgggtaaaaccgggttaaaaagggtcgtaaccgtttaagttacggttaccgtttttagggaaatttaacccggttaccgggttacgggggtaacccccgtaaaggggtaacccgtaagggtttcccggg

SEQ ID NO: 113185 - DNA, 710 bp, Homo sapiens
  misc_feature: GYAE6OF01DP5CM.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtggggggtcccttagagtctcctgtgtggcctcgtggattcactttcaagtaagtggctggatgtagttgggtccgccgaggctccgaggggagggcgtgggagtgggttggaacgtttacgaaaagtaaaatgagtagggtagaaagaaaagtagacgttacggtgaccaccgtaggaaaggaagtacttacgaaccatactacaaagagtaataacgttaacgaaaaacgtcgggttaattagtttacgactaaagtaggtaaacacggtaccgtaaggaaaaaccccggtaggaaccaaccgacggtacccgttacttaacgtttaccgttacgtaacccaacgtaaggtaacgtttacgggaagttgacctaacgtacggaaaccggttaaagggacgggtacttagttacggttacttttaggattaacggttcggtaccggggaccctaaaggggtactaagggttccggg

SEQ ID NO: 113186 - DNA, 735 bp, Homo sapiens
  misc_feature: GYAE6OF01EX21A.15.86.H09.1.454.CMB.1.raw
  modified_base (573)..(573): a, c, t, g, unknown or other
  misc_feature (573)..(573): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttagggtaaacgtccggttggggggtacccctttaggacgttccttccgtggtggttcggcccttcgtggtattcctactttcagtaatggcgtggatggtagttcgggtccgccgaggcctaccggaggggaacggggcgtgggtagggttggggttaggtaacgtttaacgaaaaagttaaaagtggagttaggtagaaagtaaaagtagacgtacggtacgaccgaaccggtaagaaaggtaacgtacttaccaactagtctaacgaaagtagtaattaacttaacgaaaacggtcgttagtaatttacgaataaacgtagaacgaacgaccgtaacggaaaaccgngaaccacgacgtacccgtattaacgttaccgtacgtaacccgacgtagtaacgttacggaatcgactaagtacccggtaaaggtaaaggcgtacttagttcggttacttttagaagtttacgtaccgggttacgggaacccgtaagggactaaggttccggg

SEQ ID NO: 113187 - DNA, 904 bp, Homo sapiens
  misc_feature: GYAE6OF01CG75N.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtctgggttttccttgctgctatacttaaaggtgtccagtgtgaagtgcaggtggtggagtcgtggggagtccgttagggtaaagccgtgggggtacccttagacggttctccgttggtggtcggtccttcgtggtaatttcgtacttttacgaagttaacgtcggtcgtgggtaatggtaggtttcggggtacccgtccgtacggacgtaccggaaggggtaaacgggtcgtagggtacggttggggttacggtaacgtttaacgtaaaaagtaaaagtgtaagtgggtaagaagtaaaacgtagtaacgtacggtacgacgtaaccggtaaggaaaggtaaacgtacgttaccaacgtactactaacgtaaaggaacgtaagtttaaacgttaacggtaaaaaacggtacgggtttaagtttaacgtttaaacggaaactaaaacggttaacgaaaaccgttacggtaaaccccgtaaaagggaaaacccgtaaacggaaacccgtaaccgtaaacggacccgttttaacgtaactttaacccgtaacggttaacccaaaggttaccggtaaacggttacgggtaaacggttcggaaccgttaacggttaacccggaaaggggttaaagggaacggggtttacccttaaagggttcggttttaaacgttttaaacgggtaacctttaacggttacccggggtttaacgggggaacccccgttaacggggtaacggttaaagtttccccggggggg

SEQ ID NO: 113188 - DNA, 663 bp, Homo sapiens
  misc_feature: GYAE6OF01DW60Z.15.86.H09.1.454.CMB.1.raw
  modified_base (326)..(326): a, c, t, g, unknown or other
  misc_feature (326)..(326): n is a, c, g, or t
tcagtctacgtagccacgaccggtgctcgatttagtgctatagacttgggtttgggggagaggagcccagccttgggatcccaagtgtttcattcagtgatcaggactgaacacagaggactcaccatggagttcgggctgagctgggttttccttgctgctatcttaaaggtgtccagtgtgaagtgcaggtggtggagtctgggggagccttggtaaagcctgggggtcccttagagtctctgtgtggcctctggattcactttcagtaatggctggatgagttggtcgccagctcgaggaagggctggagtggtggacgtttnaaaagtaaatgatggtagagaaatagactaggtacgcgaccgtagaaaggaagagttcacatcgtacaagagaataatcgaaaaacgtaggtagtagtttagacctaaaagtgaaacagaccttaggaaaaacccgaggaaccaacgacggaccgttacttaagttaacccgtacggtaaccctaaccggtaggtaaactttcggggaaaacgttgacccgtaaagtaccggaaccgggtaaaaagggtagggcccgttaagtagtccggttttaagtagttaacgtcccggttagggggacccccctaagggggttaacccaaacgggtttcgggg

SEQ ID NO: 113189 - DNA, 847 bp, Homo sapiens
  misc_feature: GYAE6OF01CL71B.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcgggctgagcgttgggttttccttgctgctatacgttaaaagtgtccagtgtgaagtgcgaggtggtggaggtcgtggggacgtccgttggtaacgccggtcgggggtccttagcgtctcgtgtgtcggcctcgtgtacttctactttcgaagttaagtggcttggtaagtggtaggtttcggggtccgccgacggccgtaccggaagggggaaggggtccgttggggtaggttggggttacggtaacggttttaaacgaaaaaaggttaaaaagtggtaaggtagggtaaaggtaaaaggtaaaaagtaacggtaaacccggttacgggtaacgacccggtaaacccgggttaaaggaaaaagggtaaactaacgttaccaaacccgtaataccgtaaagaaagtaagtaaagttaaacgttaaacgaaaaacggttacgttacgttaaagttacgaaacgtaaaactaggaaaaccgtaacgaacccgtaaacggaaaaccgacggaacccaacgtaaccgtaccgttaccttaacgtttaaccgaaccgttacccgaaagtacgtaacgtttaccggaagtacggtaccaaaggtaaccgggaaaggtaaaggtacggtaacttaaggttagttccgtttttaaagacgttaacggttcccgggtaccggggaacccgtttaaagggaacccgttaagggttccggg

SEQ ID NO: 113190 - DNA, 700 bp, Homo sapiens
  misc_feature: GYAE6OF01E090K.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccgaggctccgaggggaaggggcgtgggaggtggggttggtacgtttacaaaagtaaaaatgagtggtagaaagaaaatagaacgtaacggtgaccgaacccggtagaaaagggtaagtacttaccaacctaactcttaacgaaagaagtaattaaactttaacgaaaaaaccggtacggttagttaagttttagaactaaaagtaggaaactaacggaccctaaggaaaaacccggagaaccaaccgaagtcccgtattaacttactacgtaacccaacgtaagtacgttacggaagtcgacaagtaccggaaacggtaaaagggacggtacttaagtcggttcttttaggactttacgtccgggtacggggaccccgaaggggacgtaaggttcggg

SEQ ID NO: 113191 - DNA, 850 bp, Homo sapiens
  misc_feature: GYAE6OF01EH1YP.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtggtggagtcgtgggggagccgttaggtaaagccgtggggggtcccttagagtctcctgtgtggcctcgtggtattcactttcagttaagtggctggatggtaggttcggggtcccgccgagggcctacccggaagggggaacgggggcgtggggtagggttgggggtttagggtaccgttttaacgaaaaaaggttaaaaagtggaagttagggtaagaaaaggtaaaaacgtaggaaccgttacgggtacgacccgtaaacccggtaggaaaaagggaaacgtaacttaccgaaccctaagttacctaacgaaaaggaagtaaactttaaaacgttaaccgaaaaaaaccggttcgggtttaagttaattttacggaaacctaaaagttacggaaaacgtaaccgaaccccgttaaacggaaaaacccgggaaggaacccaaccgtaacggtaccccgtttaacttaactttaaccgtaccgtaaaccccgtaagtaacgtttaacgttaccggggaaagtacggtaacgaacgttaaccggaaaacgggtaaaaggggccgtaacgtttagttacggttactttttaaggaatttaccgttccgggtaccgggggtaacccgaagggggtaacctaagggttacccggg

SEQ ID NO: 113192 - DNA, 937 bp, Homo sapiens
  misc_feature: GYAE6OF01CGBZ5.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagcttggtaaagccgtgggggtccttagagtctcctgtgtggcctcgtggacttctactttcaagtaagtggcgtggatggtaggttcgggtcccgccgacggccgtaccggaagggggaacggggcgtgggaaggttgggttacggtacgtttaacgaaaaaggtaaaaagtgaagtgggtaagaaagtaaaaagtacgtaaccgtaacggtcgaccgtaacccggtaaggaaaaacgggtaaagtaacttaccgaaaccgtactaccgtaaacgaaaaggtaagtaaacgtttaaaacgtttaaaaccgaaaaaaaccgggttacgggtttaagtttaacggttttaacgaaaaccgtaaaaagttacggaaaaaacccgtaacgggttaaccccgtaaaaacgggaaaaaaaccccgggaacggaaaccccgaaaccggtaacccggtaccccgttaaaccttttaaaccgtttaacctaacccggttaaaccccgaaacggtaaacggtttaaacggttaaccggggtaaaacgttccgaaaccgtaaacgggttaacccgggtaaaaaccgggttaaaaaggggtaccgggtacctttaaagggttaccggtttaccgttttttaaacgggtaaacttttaaccgggtacccgggggttaccccgggggaaaccccggttaaaacgggggtaaaccgtaaacgggttttccccggggg

SEQ ID NO: 113193 - DNA, 785 bp, Homo sapiens
  misc_feature: GYAE6OF01BQ4IK.15.86.H09.1.454.CMB.1.raw
  modified_base (357)..(357): a, c, t, g, unknown or other
  misc_feature (357)..(357): n is a, c, g, or t
tcagtctacgtagccacgaccggtgctcgatttagtgctatagacttgggtttggggggagaggagcccccagccttgggatccccaagtgttttcattcagttatcaggactgaacacagaggactcaccatggagttcgggctgagctgggttttccttgctgctatcttaaaaggtgtccagtgtgaagtgcaggtggtggagtcgtgggggagccgttggtaagccgtgggggtcccttagagtctcctgtgtggcctcgtggattctactttcagtaatggctggatgagtggtccgcgaggctcgaggacgggctggagtgggtgacgtttacaaagtaaatgagtggtanagaaagtagacgtacggtcgcgaacccgtagaaacggaagtacttcaaccagtactacgaagaagtaagtaattaaccgaaaacggtacggttagttaagtttacgaactaaagtagaaaccgtaacgtacccgtaacggaaaaccgacggaacctaacggacgtacccggttacttaactttaacccgtacgtaacccgtaacgtaaccgggttagttaaccggggtaaacggttacggaaccctagggttaacccgggttaaaaccggggttaaaaaggggacgggttaaaccccgtttaaggttaccggttttaacccggttttttaaggaacccgttttaaccggtacccggggtttaaacccgggggaccccccgggtaaaggggttaacccggttaaacggtttcccggggttaaccccggg

SEQ ID NO: 113194 - DNA, 591 bp, Homo sapiens
  misc_feature: GYAE6OF01B7G1F.15.86.H09.1.454.CMB.1.raw
  modified_base (537)..(537): a, c, t, g, unknown or other
  misc_feature (537)..(537): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtccttagagtctcctgtgtggcctctggattcactttcagtaatggctggatgagttggccgccaggctcgagggagggctggagtgggttgacgtttacaaaagtaaaatgaagtggtagaagtaaaatagaactacggtgactaacccggtagaaaaggagtattcaacctatctacaagagtaataatacaaaagcggtgtaatttagactaaatgaaacagaccctaagaaaaccgagacaacgagccgtatatacgagtaccactagattcggaatgacagtacgaacgtaaaggnggtacttagtgtcttttagattacgtcggtacgggacccagggactaagttcgg

SEQ ID NO: 113195 - DNA, 578 bp, Homo sapiens
  misc_feature: GYAE6OF01DD6NW.15.86.H09.1.454.CMB.1.raw
  modified_base (377)..(377): a, c, t, g, unknown or other
  misc_feature (377)..(377): n is a, c, g, or t
  modified_base (458)..(458): a, c, t, g, unknown or other
  misc_feature (458)..(458): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagccccccgtctgcatctgccttgctgggagcctcgatcaagctcacctgcaccctaagtagtgagcatcgaacctacaccatcgaatggtatcaacagagaccagggaacgtccccccagtactataatagaaagttaagagtgatggcagccacacgaaggggacggatccccgatcgcttcatcgggctccgagttcgnggggctcgaccgctacctccacctatcctacccaaccctccacgttctgaccgagtcggacggcctggagtactcacgtgngggtaagaggacgccgacaacgtagttagacgtcgggaccgaaggtacgggtttggggtggtttcgggacgggacgggaaccgaaggtcctacggacccgttaccgtgggtcaacccggg

SEQ ID NO: 113196 - DNA, 782 bp, Homo sapiens
  misc_feature: GYAE6OF01CJOKJ.15.86.H09.1.454.CMB.1.raw
  modified_base (735)..(735): a, c, t, g, unknown or other
  misc_feature (735)..(735): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgtagggtggtggagtcggtgggggacgtccgttagggtaaacgtccggtcggggggttcccttaggacgttccgttccgttggttggtcggtcccttcgtgggtactttcctacgttttacaggttaagtgggtcgtggtagttggtaggttccggggtaccgccgacggtccgtaccggaagggggaacggggtcgtaggggtacgggttggggtttacggtaaccgttttaaagtaaaaaagttaaaaagtggtaagtagggtaagaaagtaaaagtaggtaccgttaacggtcgaaccgtaacccggtaaggaaaaggaacgtacgttacaaccgtataccgtaacgaaagtaaacgtaattaaacgtaaaccgaaaacggtacgttagtaactttacggaaactaaagtacgtaaacaacggacctaaacggaaaccgagaacaccgacgtctaactaacgtacgtaacgtaccaacgtagtacgttacgaagtcacaagtacgaaacgtaaggcgacttagtacgttgtttanaacgtttacgtccgggtacgggacccgtaaggtacgtgggttcccgg

SEQ ID NO: 113197 - DNA, 671 bp, Homo sapiens
  misc_feature: GYAE6OF01BTZIP.15.86.H09.1.454.CMB.1.raw
  modified_base (466)..(466): a, c, t, g, unknown or other
  misc_feature (466)..(466): n is a, c, g, or t
  modified_base (622)..(622): a, c, t, g, unknown or other
  misc_feature (622)..(622): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagcgttgggttttccttgctgctatacttaaaggtgtccagtgtgaagtgcgaggtggtggagtcgtggggagtccgttaggtaaacgccggtcgggggttcccttagacgttcctccgttgtggtcggccttcgtggtacttctactttcgaagttaagtggctggatgtagttcgggtccgccgaggcctccgaaggggacgggcgtagggaggttgggttggtacgtttaacaaaaaggttaaaaatgaagttggtagaaagaaaatagacgtaggtgaccaacccgtagaaaggaagactacgactatctacaaaganataactaacgaaaacgtacgtattacgttgaacaaatgaaacacgacctaacgaaaaccgagaacacgtaacggccgtacttaacttactacgtaacccaagtaagtacgttacggaatcgactataccggaaggtaaaaggcggtctagtcgttntttagattacgttcggtaccgggacccgagggaaccgtaaagttccggg

SEQ ID NO: 113198 - DNA, 752 bp, Homo sapiens
  misc_feature: GYAE6OF01A1YE1.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtggggggtcccttagagtctcctgtgtggcctcgtggattctactttcaagtaagtggctggagttggtaggttcggggtcccgccgaggcctccggaaggggaaggggctgggtaggtggggttaggtacgtttaacgaaaaaggtaaaagtgtaagtaggtagaaaggtaaaaagtacggaacgtaacggtacgaccgtaacccggtaggaaaagggaagtaacgttaccaaccgtataccgtaacgaaaggtaagtaacgttaaacttaaaccgaaaaaacggtcgggtttaagtttaacgtttaacgaaacttaaaagtacgaaaaccgtacgtaacccgtaaaggaaaaacccggaggaaccaaccgacgtacccgttacttaagtttacctacggtaacccagtaagtaacgttacggaagtacgacgtaacgtacggaaacggtaaagggagtacctagtcgttactttagacttacgtcggtacgggacccgaaggtaaccgtaggtccgg

SEQ ID NO: 113199 - DNA, 646 bp, Homo sapiens
  misc_feature: GYAE6OF01CRK50.15.86.H09.1.454.CMB.1.raw
  modified_base (343)..(343): a, c, t, g, unknown or other
  misc_feature (343)..(343): n is a, c, g, or t
  modified_base (549)..(549): a, c, t, g, unknown or other
  misc_feature (549)..(549): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattctactttcagtaatggctggatgagttgggtccgcaggctccgagggaggggctggagtgggtgacgtttanaaaagtaaaatgagtggagaagaaaatagaacgtaggtgaccgaacccgtaggaaaaggaagtacttacaaccgtactctacgaaagagaattaattaacgaaaaaacggtacgggttattaatttacgggactaaaaagtggaaaccaggtacctaacgaaaaacccgggaactacgacgaccgtactaattaactcgaaccaanagtacttcgggaagtcgacatacccggaaagtaaagggagtctagtcgttactttagattagtcgtacggggacctaacgggaactaaggttccggg

SEQ ID NO: 113200 - DNA, 732 bp, Homo sapiens
  misc_feature: GYAE6OF01BOGU0.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaacgccgtggggggttcccttagacgtctccgtgtgtcggcctcgtggtacttctactttcagtaatggctggatgtagttcggtccgcgacggcctccgaggggaaggggcgtggaggtggggttggtacgtttacgaaaaagtaaaatgagtaggtagaagtaaaagtagaacgtacggtcgacgaacccggtaggaaaaggaagtaacgttacaaccactactacgaaagaaacgtaattaaacgttaacgaaaaaccggtacggttaagttaagtttagaactaaaagtacgaaacaacggtacccgtaaacggaaaacccggacggtaaccaacgacgtacccgtaacttaacgttaacctacgttaacccaacgtagtaacgttacggaagtacgaacacgtaccggaaacggtaaaagggacggtacgttaagtcggttaactttagtaacgttaacgtccgggtccgggaaccgtaacgggaacgtaaaggttcccggg

SEQ ID NO: 113201 - DNA, 613 bp, Homo sapiens
  misc_feature: GYAE6OF01AHL3I.15.86.H09.1.454.CMB.1.raw
  modified_base (302)..(302): a, c, t, g, unknown or other
  misc_feature (302)..(302): n is a, c, g, or t
  modified_base (385)..(385): a, c, t, g, unknown or other
  misc_feature (385)..(385): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctctgtgtgcctctggattctactttcagtaatggctggatgagttgggtccncgaggctccgaggggaaggggcgtggtaggtgggttggacggtttacaaaaggtaaatgagtggtagaagaaatgactacggngacgacccgagaaagagtatacaccatctanaaganataatacaaaacgtcggtagttaattgactaaatacgaacacgactaggaaaccgacgacaaccgacgtcgtacttattacctagtaccatacgtactacggaagtgacagtaccgaaaggtaacggaggtactagtacgttcttttaggtatacgttcggtacgggaccgtagggaccgtaggttaccggg

SEQ ID NO: 113202 - DNA, 664 bp, Homo sapiens
  misc_feature: GYAE6OF01DIOJW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatggagttgggtccgccaggctccgaggggaaggggctgggagtgggttggacgttacaaaagtaaaatgagtaggtagaagaaatagaactacggtgaccgaaccgtaggaaaggaagtacttccaaccatctacaaagagtaataattaacgaaaaacgacggttagttaagtttagaactaaatagaaacagaccgtaaggaaaacccggaggaaccaacgtagacccgttacgttaacttaaccgtacgtaacccacgtagtacgttacgggaagttcgactaacgtaccggaaacggtaaagggacggtacttagttcgttacgttttagattacgtcggtacgggacccgaagggacctaaggttcggg

SEQ ID NO: 113203 - DNA, 1087 bp, Homo sapiens
  misc_feature: GYAE6OF01C6MPW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtccagtgtgaagtgcaggtggtggagtcgtgggggagtccttagggtaacgccgtgggggtcccttagagtctcctgtgtcggcctcgtggattctactttcaagttaagtggcgtggtatggtacggtttcgggtcccggccgaaggtccgtacccggaaggggggtaaacggggggtcgttaggggtacgggtttgggggtttacggggtaaccgttttaacgtaaaaaaaggttaaaaagtaggtaagttagggtaagaaagtaaaaacgtagtaaaccgttacgggtacgacccgtaacccggtaaggtaaaacgggaaacgtacgttaaccctaacccgtatttaccgtaacgtaaaacgtaacggtaaaactttaaacgtttaaaacccggaaaaaaaccgggttaccggggtttaagttttaaacgttttaacggaaacccgttaaaaaacgtttaacgggaaaaacccgtaacccgggtaaacccgttaaaacggggaaaaaaaacccccgggtaacgggtaaaccccaaacccggttaaacccggttaacccccggtttaaccgttttaaaccgttttaaacccgtaaaccgggtttaaaaccccctaaaccgggttaaacggttaaccgggttttaaaccggggttaaaaaccgggtttccgggtaaaacccggttaaaccgggttaaaaccccgggttaaaaaaccggggggtttaaaacggggtaaacccgggtttaaaccgttttaaacgggttaaccggttttttaacccggttttttaaaacgggtaaacccggttttacggttttaaccccggggggttaaccccgggggggtaaccccgggttaaaaaccgggggtaaacccgtttaaaacgggggttttaacccggggg

SEQ ID NO: 113204 - DNA, 605 bp, Homo sapiens
  misc_feature: GYAE6OF01D4PUG.15.86.H09.1.454.CMB.1.raw
  modified_base (477)..(477): a, c, t, g, unknown or other
  misc_feature (477)..(477): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtatggctggatgagttgggtccgccaggctccgaggggaaggggctgggaggtgggttggacgtttacaaaagtaaaatgatggtagaagaaaatagactacggtgcaccgtagaaaggagattcacatctcaaagagaataattacaaaaacgcggttagtatttagactaaatgaaacagacctaaggaaaacccgnggaacacgagaccgtcttataactcgtaaccaactagatttcggaagtcgactaagtacgaaacggttaaaggcggtactagtgtactttgattagtccgtaggggacccaaggggactaagttcggg

SEQ ID NO: 113205 - DNA, 672 bp, Homo sapiens
  misc_feature: GYAE6OF01DIB7S.15.86.H09.1.454.CMB.1.raw
  modified_base (360)..(360): a, c, t, g, unknown or other
  misc_feature (360)..(360): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgagtgcaggtggtggagtcgtgggggagccgttagggtaaacgccgtggggggtcccttaggacgtctccgtgtgtcggcctcgtggtattcactttcagtaatggcgtggatggtaggttgggtccgccgaggctccgaggggagggcgtgggaggtgggttggtacgtttanaaaagtaaaatgataggtagaaagaaatagacgtacggtgaccgaaccgtaggaaaggtaagtacttccaacctatactacgaaagtagtaaattaagttaacgaaaaaccggtcggttaagttaatttagaactaaagtacgaaacgtacgtacctaaggaaaacccgnggaaccacgtacgtcccgttatacttacgtaccgtaaccacgtagtacgttcggaagttcgacaagtcggaaacggtaaagggcgtactagttggttactttagattacggtcggtacgggaccgaagggtctaggttcggg

SEQ ID NO: 113206 - DNA, 708 bp, Homo sapiens
  misc_feature: GYAE6OF01CRGR2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggttttccttgctgctatcttaaaaggtgtccagtgtgaagtgcaggtggtggagtcgtgggggatccgttggtaaaggccgtgggggtcccttaggagtctccgtgtgtggcctctggattctactttcagtaatggctggatgagttcggtccgccaggctccggagggaggggcgtgggaggttgggttggtacgtttaacgaaaaagtaaaagtgtagtagggtagaagaaaataggaacgtacggtagaccgtacccggtaaggaaaggtaagtacgttacaacctactactaacgaagaagtaattaaacgttaacgtaaaaacggtacggttagttaattagaactaaagtaacgaaccagtacccgtaaagaaaaccgtagaccaacgtacgtaccgtacgttaacttaaccgtacgtaccaacgtaagtacgttacggaagtcgtaacacggtacgaaacgggtaaagacggtcgttaagtggtttcgttttaagtacgttacgtccgggtccgggaacccggtaacggggtaacgtacgggttccggg

SEQ ID NO: 113207 - DNA, 706 bp, Homo sapiens
  misc_feature: GYAE6OF01CQ1EA.15.86.H09.1.454.CMB.1.raw
  modified_base (341)..(341): a, c, t, g, unknown or other
  misc_feature (341)..(341): n is a, c, g, or t
  modified_base (413)..(413): a, c, t, g, unknown or other
  misc_feature (413)..(413): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcggctgagctggttttccttgctgctatcttaaaaggtgtccagtgtgaagtgcaggtggtggagtcgtggggagccgttggtaaagcccgtggggggtcccttagagttctcctgtgtggccttcgtggacttctactttcgagtaagtggtctggatggaggttcgggtcccgccgaggctaccgaggggaaggggctgggngtgggtggacgtttacaaaaaggtaaatgatggagaagaaaatagactaggtcgacgaccgtaggaaagganacttacaaccatactacgaagagaattaacttaacgaaaaacggtcggttagttaatttacggaacctaaagtagaaaccgtacgtacccgtaacggaaaaacccggacggtaaccaacgtacgacccgttaacgttaacgtttaacctaccggtaaccctaacgtaggtaacgttacgggaagttcgaaccgtacgtacgggtaaaacgtaaagggacggtcgttaactggttcttttaaggaatttacgtccggtaccggggacccgtaacgggactaaaggttcccgggg

SEQ ID NO: 113208 - DNA, 591 bp, Homo sapiens
  misc_feature: GYAE6OF01BVOFB.15.86.H09.1.454.CMB.1.raw
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (478)..(478): a, c, t, g, unknown or other
  misc_feature (478)..(478): n is a, c, g, or t
  modified_base (544)..(544): a, c, t, g, unknown or other
  misc_feature (544)..(544): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggctgggaggtgggttggacgtttacgaaaagtaaaatgagtggtagaagaaaatagactacggtgacaccgtagaaaggagactcacatactanaaganataattacaaaacgtcggtagtatttagactaaatgaaacagacctaagaaaaccgnggaacacacgtccgtatattactacgtaaccagtagattacggaagtgacagtacgaagtaaaggngtctatgtctttagattacgtcgtcggggacccagggactagtcggg

SEQ ID NO: 113209 - DNA, 702 bp, Homo sapiens
  misc_feature: GYAE6OF01AZ452.15.86.H09.1.454.CMB.1.raw
  modified_base (652)..(652): a, c, t, g, unknown or other
  misc_feature (652)..(652): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttggtaaagccgtgggggtcccttagacgtctcctgtgtggcctcgtggattctactttcagtaagtggctggatggtaggttgggtcccgcgaggccgtaccgaaggggaaggggtcgtgggtaggtgggttaggtaacgtttaacgaaaaagtaaaatgaagtgggtagaagtaaaatagtaacgtacggtagaccgaacccggtagaaaaggaacgtacttaccaacctataccgtacaaaggaagtaattaacttaacgaaaacggtacggttagttaatttgaactaaatgaaactacgtacccgaaggaaaacccgagaaccaacgacgtaccctttactaatttacctaacgtaccctaagtagttaacgttacgggaagtcgtaccagtacccggaaagtaacgggagtacctagttacggttnttttaggaattacgtaccggtcggggaaccctaggggactaaggtccggg

SEQ ID NO: 113210 - DNA, 849 bp, Homo sapiens
  misc_feature: GYAE6OF01BR4L4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatgggagttcgggctgagcgttgggttttccttgctgctatacgttaaaggtgtccagtgtagaagtgcgtaggtggtggagtcggtgggggagtccgttaggtaaacggtccggttcggggggttacccttaggacgttccttccgtggtcggtcggtccttcgtggtacttcctactttcgtaagttaagtggtcgtggtagtggtacgggttcggggtccccggaccgacgggtccgtaccgggaagggggtaacgggggtcggttagggggtagggtttcgggggtttaacgggttaacggttttaaaacgtaaaaaaggttaaaaacgtggtaagttaggggtaagtaaaagtaaaagtaacggtaacgttacggtacgaacccgtaaccggtaaggaaaacgggtaacgtaacttaccgaacctacgttacctaaacgaaagtaagtaaacttaaacgttaaaaccgaaaaacgggttcggtttaagtttaacgtttacgaaaactaaagtaacgtaaaaccgaccggtaaccgtaaaggaaaacccggaggtaaccaacgaacgttcccgttaacttattacctaacgtaacccaagtacgtaacggttacggaagtcgaactaagaaccggtaaagtaaaggccgtacttaggtcgtttagtttagaagttacggtccggtacggggaccgtaagggaacttagggtcgg

SEQ ID NO: 113211 - DNA, 660 bp, Homo sapiens
  misc_feature: GYAE6OF01E4RSW.15.86.H09.1.454.CMB.1.raw
  modified_base (345)..(345): a, c, t, g, unknown or other
  misc_feature (345)..(345): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttgggtccgcaggctccgaggggaggggctggagtgggttggacgtttanaaaagtaaaatgagtggtagaagaaaatagactacggtgaccacccggtagaaaggaagtacttacaccatctacaaagagaattaaattaacgaaaaacggtacggttagttaattttacggaactaaaagtacgaaacacgtacccgtaaggaaaacccggaggaacccacgacgtacccgttacttaacgtttacctacggtaacccacgtaacgtacgtttacggaagtcgacgagtacggaaacggtaaagggaggtacttatggtcttttagaattgtccggtacggggacccagggaacaggttcggg

SEQ ID NO: 113212 - DNA, 1019 bp, Homo sapiens
  misc_feature: GYAE6OF01BMSFS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcggtggggggagtccgttagggtaaacggtccgttcgggggggttaccccttaaggtacggttccttcccgttgggttcggttcggggtccccgttcgttacggggtactttttaccctaaccgtttttacccgaaaggtttaaaaggttcggggtaccgtttaggggtaacgtttaggggttaacggggtttttccgggggggtcccccggtacccccggaaacggggtccccgttacccccggggaaagggggggggtaaacggggggggtccggttagggggtaacgggggttttggggggtttacgggggttaaaccggtttttaaaacggaaaaaaagggttaaaaaaagttgggtaaaggttaggggtaaggtaaaaaggtaaaaacgtaacggtaaaccgttaacgggtacggtacccggtaaacccggtaaagggaaaagggtaaacggtaactttaccaaccgtaactaccgtaacgaaacgtaaggtaaattaaaacgttaaaccgaaaaacgggttaccggtttaagtttaactttacgaaacgtaaaagttacgaaaaccgtaccgtaacccgtaaacggtaaaaacccggacggaaaccgtaccgaacccggttacccgttaactttaacgttaacccgtaacgtaaaccccgtaacgtaacgttacggtaacggtaagtacgacctaacgtaacgggtaaacggtaaaacggggtcggtaccttaagttcggtttactttaggtaaacgttcgtaccgggtaccggggaacctaacgggtaacgtaagggttcccggg

SEQ ID NO: 113213 - DNA, 645 bp, Homo sapiens
  misc_feature: GYAE6OF01AD689.15.86.H09.1.454.CMB.1.raw
  modified_base (508)..(508): a, c, t, g, unknown or other
  misc_feature (508)..(508): n is a, c, g, or t
  modified_base (521)..(521): a, c, t, g, unknown or other
  misc_feature (521)..(521): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagttaatggctggatggaggttggggtcccgccgaggctccgaggggaagggggcgtgggaggtggggttggtaacggttttacgaaaaaggtaaaatgagtgggtagaagaaaataggaacgtacggtcgacgacccgtaggaaaggaagtacttacaccatctacgaagagaataattacgaaaacgtcggttagttattagacaaatgaactagacctaagaaaccgngacacacgacctntatactgtaccagtagtacgttacggaatcgactaacgtacggtaaacggtaaagggcggtacttagtacggttcttttaggattacgttaccggtcggggacccaagggtactacggttcggg

SEQ ID NO: 113214 - DNA, 870 bp, Homo sapiens
  misc_feature: GYAE6OF01DL71N.15.86.H09.1.454.CMB.1.raw
  modified_base (246)..(246): a, c, t, g, unknown or other
  misc_feature (246)..(246): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaagccgtgggggtccttagngtctctgtgtgcctctggattcgtactttcagtaagtggctggtatggtaggttcgggtcccgcgaggcgtaccggagggaaggggtctagggtaggtgggttggtaacgtttaacgaaaaagtaaaatgagtagggtagaaagaaaagtaggacgtaacggtcgaccgtaacccgtaaggaaaaggtaagaacgtttaccaaactaacttaccgttaacgaaaagtaagtaaacgttaaaacttaaccggtaaaaaaaccgggtgggttttaacgttaagtttttaaccggaaacgttaaaaaacgtttacggaaaaaccgtaaacggtaacccggttaaaacgggaaaaaaacccggacgggtaaaccaaaccggtaaccggttaccggtttaaccttaaactttaaccggttaaccggtaaaccctaaacggtaagttaaacggtttacgggtaaaaggtcgaaaccggtacgttaaaccgggtaaaacggtaaaacgggaacggttaccgttaagttaacgggtttaccgtttttaaggaaaacccgttttacgggttacccggggttaacccggggtaaacccggtaacggggtaaaccgtaagggtttttcccggggg

SEQ ID NO: 113215 - DNA, 569 bp, Homo sapiens
  misc_feature: GYAE6OF01AGIAH.15.86.H09.1.454.CMB.1.raw
  modified_base (497)..(497): a, c, t, g, unknown or other
  misc_feature (497)..(497): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcacttttcagtaatggctggatgagttgggtccgccaggctccagggaaggggctggagtgggttggacgttttacaaaaggtaaaatgatagggtgaagaaaatagactacggtgcacccgtgaaaggagattcaccatctacagagataattacaaaacgacgtgtatttgacaaatgaacagacctagaaaaccgaggacacagcgtactaattactagtacccanagattcggaatgacatcgaacgtaaggaggtctatgcttttgatacgtcgtacgggaccagggcaagtcggg

SEQ ID NO: 113216 - DNA, 763 bp, Homo sapiens
  misc_feature: GYAE6OF01DAJX6.15.86.H09.1.454.CMB.1.raw
  modified_base (367)..(367): a, c, t, g, unknown or other
  misc_feature (367)..(367): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcacttttcagtaatggctggatggagttggccgcaggctccgagggaaggggctgggagtgggtaggacgttttacgaaaaagttaaaatggagtggtanaaagtaaagtagacgttaggcgaaccgtacggtaaggaaaggaagtactacaactactactaacgaagtaagtaattaacgtaaaaccgaaacgggttacgttattaagttacgaaacttaagaacgtaaccgtaacgtaccgtaaaacggaaaacccggacgaaaccgtaccgtaaccggtaccgttaaccgtttaaatttaccgtaacccgtaacccgtaaaccgtaaggttaacggttaaccggggttaaatccgtaacgtaaaccggtaaaccgggtaaacggggttaaaacggaacggttcgttaaaggtttccggtttagtttttaacgtaaacgttactttaccgggacggttaacccggacccgggttaaggaaaccggtttaacggg

SEQ ID NO: 113217 - DNA, 728 bp, Homo sapiens
  misc_feature: GYAE6OF01DQ9IR.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtcgtgggggagtccgttggtaaagccgtggggggtcccttagagtctcctgtgtggcctcgtggattcactttcagtaatggctggatgaggttggtccgccaggctccgagggaacggggcgtggaggtgggttggacgtttagaaaagtaaaatggataggtagaagaaatagacgtacggtagaccgaacccgtaggaaaaggaagtactacaacgactacacgaaacgaagtaattaacgttaaacgaaaaaccggtcgggttaagttaacgtttagaactaaaagtacggtaaaacacggtaacccgtaacggaaaaacccgacgggtaaaccaacgtacggaccccgttagtttaacttaaccgttacgtaaacccagtaacgtagtttaccgggaagttcggacctacgtaccgggtaaacggtaaaagggcgggtaccttaagttcgttagttttacggaatttacggttcgggttaccgggggacccaaagggggtaccttaaggttaccgggg

SEQ ID NO: 113218 - DNA, 686 bp, Homo sapiens
  misc_feature: GYAE6OF01EJ1P9.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctattttaaaaggtgtccagtgtgaagtgcaggtggtggagtcgtgggggagccgttggtaagccgtgggggtccttagagtctctgtgtgcctctgattcacttcagtatggctggatgtagttgggtccgccgaggctccgaggggaggggcgtgggaggttggggttaggtacgtttacgaaaaagtaaaagtgagtggtagaagtaaaagtagacgtacggtgaccgaaccggtagaaaggaagtacttaccaacctatacgtacaaagaagtaaattaaacgttaacgaaaaacggtcggttagttaatttacgaacttaaaagtacgaaacgacgtacccgtaaagaaaacccggagaaccacgacgtaccgttactaacttacgtcgtaacccagtaagtacgttacggaagtcgactaagtacggaaacggtaaaggagtacgttagttgttacgttttgaagttacgtaccgggtacggggaccccgaagggaacctagggtcggttaccgg

SEQ ID NO: 113219 - DNA, 843 bp, Homo sapiens
  misc_feature: GYAE6OF01D8L1N.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatacgttaaaaggtgtccagtgtgaagtgcgaggtggtggagtcgtgggggacgtccgttagggtaaacgcccggttcggggggttacccctttaaggacgttccttcccgttggttcggtcggtcccttcgttggtactttcctaaccttttcgaagttaagtggcttggtatggtaggttcgggtccgccgacggccgtaccggaggggtaaggggcgtgggtaggttgggttcggtaacgtttaacgaaaaagttaaaagtgtagtaggtagaaagtaaaagtagaacgtacggtcgaccgtaaccggtaaggaaaagtaacggtaactttaccgaaccgtaacttacgtaaacgaaaaggtaacgtaaacttaaaacgtttaaaccggaaaaaaccggttacggtttaagtttaagttttaacggaaactaaaaagtcggaaaacctacggtaaccctaaacgggaaaaacccggcggaaacctacgaacggttaccccgtttaacttaacgttaaccgtaccgttaacccgaacgttaaacggtacgtttaaccgggaagtcgaacctaaggtaacccggtaaaacggtaaagggtcgtaccgttaatcgtttcgttagagttacgttccgggtaacgggacccgtaagggtaactaagggttcccggg

SEQ ID NO: 113220 - DNA, 1071 bp, Homo sapiens
  misc_feature: GYAE6OF01C4XUI.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcgttgggtttttccttgctgctattacgttaaaaggtgtccagtgtagaagtgcgaggtggtggagtcggtggggacgtccgtttagggtaaacggtccggttcggggggttacccgttaggtacgttccgttccgttggttcggttcgggtcccttcgttagggtactttccttacgttttacgtaaggttaagtgggtcgttaggtagttaggttacgggtttccggggtcccggaccgtaacgggtcccgtaccgggaaggggggtaacgggggtcgttagggggtaggggtttacgggggtttacgggttaaccggtttttaaaacgaaaaaaggtttaaaaagtagggttaacggttagggtaaggtaaaggtaaaaagttacggtaacggttacggtacgtaaccggtaaacccgggtaaggaaaacggtaacgtacttacccgaaccgtacgtacccgttaagaaaacggtaaagttaacgttaaaacgttaaacccggtaaaaaccgggtttacgggttaagtttaacggttttaacgaaacgttaaaaacgttaccggaaaaccggtttacccgaaacccgggtttaaaacgggaaaaaaccccgggaccggtaaaccctaacccggttaacccggttaacccggtttaccttttaaaaaccggtttccgtaaaacccggttaaacccccgttaaacggtaaccgggtttaaacgggtttaacccggggtaaacgttacgggtaaacccggttaaaccgggtaaccccgggttaaaaacggggtaaaacggggtaaccgggttttctaaaacgggtttttccggtttaacgtttttaaacggtaaacgttccgggttaacccggggtaccgggggaaacccggttacgggaaaacggtttacccggtttccgggg

SEQ ID NO: 113221 - DNA, 646 bp, Homo sapiens
  misc_feature: GYAE6OF01E3ZNB.15.86.H09.1.454.CMB.1.raw
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (568)..(568): a, c, t, g, unknown or other
  misc_feature (568)..(568): n is a, c, g, or t
  modified_base (602)..(602): a, c, t, g, unknown or other
  misc_feature (602)..(602): n is a, c, g, or t
tcagtctacgtagccacgaccggtgctcgatttagtgctatagacttgggtttgggggggagaggacgccccagccttgggactccccaagtgttttcattcagtgatcaggactgaacacagaggactcaccatggagttcgggctgagcttgggttttccttgctgctatcttaaaaggtgtccagtgtgaagtgcaggtggtggagtcgtgggggagccttaggtaaagccgtgggggtcccttagagtctcctgtgtggcctcgtggattcactttcagtaatggctggatgagttcgggtccgcgngcacggaggggaggngnggtaggtgggtagttacgtaaataaaagtaatgtagtgagaaagaaagtagtacgtacggtcgaccgtaacgtaaggaaaggaagtactaccaactactactaacgaagaagtaattaacgtaaaacgaaaccggtagttatttagttacgaaataaagtacgaacgaccgtacgaaaacggaaacggacgaacacgaccgtaccttataacttcgactaaccagtaatacggtagagtnactacggacgtaaaggaggagtcttagtcgtttntagtatcggttccgggtaccgggaacgaggtaaatgggttaccg

SEQ ID NO: 113222 - DNA, 612 bp, Homo sapiens
  misc_feature: GYAE6OF01DIXJK.15.86.H09.1.454.CMB.1.raw
  modified_base (547)..(547): a, c, t, g, unknown or other
  misc_feature (547)..(547): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttgggtccgccaggctccgaggggaaggggctgggagtgggttggacgtttacgaaaaagtaaaagtgataggtagaagaaaatagaacgtacggtgaccgaacccgtaggaaaaggaagattcaaccatctacaagagaattaataacaaaaagtcggttagtagtttagactaaatagaacacgacctaaggaaaaccgaggaacacgacgccgtacttatactagtaacccagacgtagttcggaagtnactagtacgaacggtaaggaggctatgtctttagattagtcgtacgggacccaagggctagtcgg

SEQ ID NO: 113223 - DNA, 724 bp, Homo sapiens
  misc_feature: GYAE6OF01AJ95A.15.86.H09.1.454.CMB.1.raw
tcagtctacgtagccacgaccggtgctcgatttagtgctatagacttgggtttggggggagaggagccccagccttgggatctccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgaggggaaggggctggagtgggttggtacgttacaaaagtaaaatgagtggtagaagaaaatagacgtacggtgacacccggtaggaaaggaagtacttacacctatcctacgaaagagtaataaacttacgaaaaaacggtacggttagttaattttacgaactaaagttacggaaaccacggtaaccccgtaacggaaaaacccggtaggaacccaaccgacggtaccccgttacttaactttaaccgtacggttaacccaacgacggtaacgtttaccgggtaacgtagaccgtaacgtaccggtaaacgggttaaaagggcggtaccgttaagtcggtttactttttaggtaacgtttacggttcccgggtaccgggggtaccccgtaaagggggtaccgttaaacggg

SEQ ID NO: 113224 - DNA, 772 bp, Homo sapiens
  misc_feature: GYAE6OF01C8IU3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcgaggtggtggagtcgtggggagccgttggtaaagccgtgggggtcctagagtctctgtgtgcctctggtattctactttcagtatggctggatgtaggttcgggtccgccgaggcgtccggaaggggaggggtctgggtaggttgggttaggtaacgtttaacgaaaaaggttaaaaagtggtaagtagggtagaaagtaaaagtagtacgtaacggtcgaccgtaacccggtaggaaaaggaacgtaacttaccgacaacgtcgtaacgaaagtaagtaacgttaaattaaccgaaaaacggttggttaagttaacgtttagaaactaaaagtacggaaactaacggtaacccgtaaacgggaaaaaccggacggaaccgaaccgtaacggtacccgttaccttaaacgttaccgtaccgtaacccgaacgtaagtaacgtttacgggaaagttcgaacgtaacgtaccggaaacgggttaaaggacggtacgttaattcggtttacgttttacggaacttacgggtttccggtacggggggtaccccaaaggggtacccgtaaagggtttcccggg

SEQ ID NO: 113225 - DNA, 594 bp, Homo sapiens
  misc_feature: GYAE6OF01DBHFD.15.86.H09.1.454.CMB.1.raw
  modified_base (280)..(280): a, c, t, g, unknown or other
  misc_feature (280)..(280): n is a, c, g, or t
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
  modified_base (441)..(441): a, c, t, g, unknown or other
  misc_feature (441)..(441): n is a, c, g, or t
  modified_base (493)..(493): a, c, t, g, unknown or other
  misc_feature (493)..(493): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgttaggtaaagccgtggggggtcccttagagtctcctgtgtggcctctggattcactttnagtaatggctggatgagttgggtccgccaggctccgagggaaggggctgggagtgggtggacgtttacaaaaggtaaaangatggtagaagaaaatgactacggtgcaccgtagaaagganatcacatctacaagagaataatacaaaacgcgtagtattnacaaatgaaacagcctagaaaccgagacacagcctatattactcgtaaccanagtattacgggaagtgactaagtacgaaacggtaaaggaggtactattcggtacttttaggattagttcggtacggggacccctaaggggactagttcggg

SEQ ID NO: 113226 - DNA, 612 bp, Homo sapiens
  misc_feature: GYAE6OF01DM0KU.15.86.H09.1.454.CMB.1.raw
  modified_base (490)..(490): a, c, t, g, unknown or other
  misc_feature (490)..(490): n is a, c, g, or t
  modified_base (557)..(557): a, c, t, g, unknown or other
  misc_feature (557)..(557): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtgggggtccttagagtctctgtgtggcctctggattcactttcagtaagtggctggatggaggttcgggtccgccgaggctaccggaggggaaggggctgggagtgggttggtacgtttacaaaagtaaatgagtggtagaagaaaatagacgtacggtgacgaaccgtagaaaggacgattacactatctacaagagtataatacaaaacggtcgttagtaatttagaactaaagtgaaacagaccgtaagaaacgngacacgagacctatacttactacgtacccagtagacttacgaagtcgacaagtcggaacgtaaaggngtactagtcgtcttttagattacgtcggtacgggacccaagggtactagttcggg

SEQ ID NO: 113227 - DNA, 705 bp, Homo sapiens
  misc_feature: GYAE6OF01BF0PY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaagccgtggggggtcccttagagtctcctgtgtggcctctggattcactttcagtaatggctggatgagttgggtccgccgaggctccgaggggaaggggctgggaggtgggttggagtttacgaaaagtaaaatgagtggtagaagtaaaatagactacggtgaccgaacccgtaggaaaacggaagattacaccgtatcctacgaaagagaattaaacttaacgaaaaacggtacggttagttacgtttaggaactaaagtacgaaactaacggaccctaaggaaaaacccggagggaacccgaactacggtacccgttacttaacgtttacgtacgttaacccaacgtacgtaacgtttacgggaagtcgaacgtacgtaccggaaacggttaaaggggacgtacttagttcggttacttttaggaacttaagttcggtacgggggaaccccaaggggtaaccgtaaggttccggg

SEQ ID NO: 113228 - DNA, 799 bp, Homo sapiens
  misc_feature: GYAE6OF01DXM9F.15.86.H09.1.454.CMB.1.raw
  modified_base (568)..(568): a, c, t, g, unknown or other
  misc_feature (568)..(568): n is a, c, g, or t
  modified_base (719)..(719): a, c, t, g, unknown or other
  misc_feature (719)..(719): n is a, c, g, or t
tcagtctacgtagccacgaccggtgctcgatttagtgctatagacttgggtttgggggggagaggagccccagccttgggatcccccaagtgttttcattcagtgatcaggactgaacacagaggactcaccatggagttcgggctgagtctgggttttccttgctgctatacttaaaaggtgtccagtgtgaagtgcgaggtggtggagtcgtgggggacgtccgttagggtaaacgtccggtcggggggttcccttaggtacgtccttccgtgtggtcggtccctgtgtacttctacttacgtaagtagtcggtcgtagtagtaggtcggttcggaccgtccgacggtaccgtaccggggaggggacgggtcggtggggtaggttcggggttacggttaaccgtttaaaagtaaaaagtaaagtaggtagtaggtaaagtaaaagtaaagtaagtaacggtacggtacgaacccgtaacggaaaggtaaaggtaacgtaactaccgtactacgtacctaagaagtaaagtaacttaacgtaaacgaaacggtgttaacttagttanaaacgtaagtacgaactaccgtaacgtaaacggaaaccgtacgactaaccggacttacgttacttaacgttaccgtaacgtaacccgaagttagtaacgttaaccggagtaccgaaccgtaggtaacgggtaaaaggtaaacggtccggtntttagttacgtttacgttacgtaagttaccgggtcccggggtaacggaaccggttaacggtaagttaccggtttcccggg

SEQ ID NO: 113229 - DNA, 635 bp, Homo sapiens
  misc_feature: GYAE6OF01D2H72.15.86.H09.1.454.CMB.1.raw
  modified_base (264)..(264): a, c, t, g, unknown or other
  misc_feature (264)..(264): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctntggattcactttcagtaatggctggatgagttgggtccgccgaggctccgaggggaaggggcgtgggaggtggggttggacgtttacgaaaagtaaaatgatggtagaagaaaatagacgtacggtgcaacccgtagaaaggaagattacaaccatctacaaagagaataattaacaaaacgtacggttagtatttagacaaatagaaacagacctagaaaaccgagacacgagaccgtactattactacgtaccaacgagtaagttacggaagtcgacacgtacggaacggtaaaggacggacttagtagttcttttaggaattacgttcgtacgggggaccccgtaaggggtaacctaaggttaccggg

SEQ ID NO: 113230 - DNA, 600 bp, Homo sapiens
  misc_feature: GYAE6OF01AVXGW.15.86.H09.1.454.CMB.1.raw
  modified_base (510)..(510): a, c, t, g, unknown or other
  misc_feature (510)..(510): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctcgagggaaggggctggagtgggttggacgtttcaaaagtaaaatgatggtagaagaaaatagactacggtgacgacccgtagaaaggaagacttacaccatactcaaagagaataagttacgaaaacgtacggtagtaatttgactaaatgaaacagacctaggaaaaccgaggacacgagccgtactaattactacgtaccanagtacttacggaagtgactatacggaaccgtaaagggaggtactagtggtctttagattagtcgtacggggacccagggactaagtcggg

SEQ ID NO: 113231 - DNA, 723 bp, Homo sapiens
  misc_feature: GYAE6OF01C5VWI.15.86.H09.1.454.CMB.1.raw
  modified_base (347)..(347): a, c, t, g, unknown or other
  misc_feature (347)..(347): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtcccttagagtctcctgtgtgcctctggattcactttcagtaatggctggtatgaggttggtccgccgaggctccggaggggaagggctgggagtgggttagacgtttanaaaagtaaaatgagtaggtagaagaaaagtacgacgttaacggtgaccgtaaccggtaggaaaggaagtactaccgaacctatccgtaagaaacgtaagtaattaaaacgttaaccgaaaaacggtacgggttagtttaacgtttagaaacctaaaagtcggtaaaacaacggacccgtaaaggaaaaacccgaggaaccaacgacggtacccttacgttaacttaacgtacggtaaccctaacgtaaggtaacgtttaccgggaaagtcgaacctaaacggtacggtaaaccggtaaagggaggtaccgttaagtcgtttgttttacgattacggtccggtaccgggggaccctaaggggacctaaggttccggg

SEQ ID NO: 113232 - DNA, 600 bp, Homo sapiens
  misc_feature: GYAE6OF01A3Z6N.15.86.H09.1.454.CMB.1.raw
  modified_base (541)..(541): a, c, t, g, unknown or other
  misc_feature (541)..(541): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttggtccgccaggctccgagggaggggctgggaggtgggttggacgtttacgaaaagtaaaatgatggtagagaaaatagactacggtgacaccggtagaaaggagattcactatctacaagagaataattacgaaaacgacggttagtatttgacaaatgaacagaccctaagaaaccgagacacgagccgtactatactagtaccacgtagtagttccggaagtcgacagtacggaacgtaaaggnggtcttagtggttcttttgattacgtacgtacggggacccagggtaactaggttccggg

SEQ ID NO: 113233 - DNA, 659 bp, Homo sapiens
  misc_feature: GYAE6OF01BQVOK.15.86.H09.1.454.CMB.1.raw
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (313)..(313): a, c, t, g, unknown or other
  misc_feature (313)..(313): n is a, c, g, or t
tcagtctacgtagccacgaccggtgctcgatttagtgctatagacttgggtttgggggagaggagccccagccttggatccccaagtgtttcattcagtgatcagactgaacacagagactcaccatggagttcgggctgagcggtcgttcgtcgagtcgctagtacgtagtgcagtgtgagcgngngtgtgngngnggngtcgtagagcgtcggtcgtgtgtcgtcgtgtgtcgtcgtcgtagtacgtctactacgtagtagtgtcgtagtagtagtacggtcggtccgacgacgtcgtacggacggacggnggtggtaggtacggtacgtaacgtaacgtaaagtaaagtagtagtagtaagaagtaagtacgtacgtacggtacgtacgtaacgtaagaacgtacgtacgtacgtacgtactacgtaacgtaagtaacgtaacgtaacgtaacgtaacgtaacgttacgttacgtaagtaacgtaagtaacgtaacgtacgaacgtaacgtaacgtaacgacgtacgtacgtacgtacgtacgtacgtacgtacgtacgtacgtacgtacgtacgtagtacgtacgtacgtacgtagtacgtacgtagtacgtcgtacgtacgtacgtacggtaccggtacgtacgtacgtgtacg

SEQ ID NO: 113234 - DNA, 897 bp, Homo sapiens
  misc_feature: GYAE6OF01B138O.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccagtggagttcgggctgagcttgggttttcctgctgctatacttaaaggtgtccagtgtgaagtgcgaggtggtggagtcggtgggggacgtccgtttagggtaaacgtcccggttcgggggggttacccctttaagggtacgttccgttcccgttgggttcggtcgggtcccgtttccgttagggtacttttaccgttaaccgtttttacggaagtttaaaggttcgggtacgttagggtaagttgggtacgggtttccgggggtaccccggaccgtaacgggtccccgttacccggggaaaggggggtaacgggggtccggttaggggttaacgggttaggggtttaacggttaaaccggttttaaaacgtaaaaaaggtttaaaaaagtgggtaagttacggggttaagaaaagtaaaaagtacggtaaccggttaacggtaccgaaccgtaaacccgggtaaggaaaaggtaacgtacgttaccaaccgtagtacctaagaagaagttaataaacgtaacgaaaacgggttcgttagttaacgttagaactaaaagtacgaaaacgtcgaacccgtaaacggaaaacgtcggaacctacgaccgttcgttaacttaacgttaccaaccgtacctaagtacgttaacgtacgggaacgtcgaaccgttaaagtacggtaaaccggtaaaggcgtacttagttaccgttgtttaacggacgtttacggcccggtacgggacccaaagggtccgtaggttacccgg

SEQ ID NO: 113235 - DNA, 806 bp, Homo sapiens
  misc_feature: GYAE6OF01B6VL8.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtggggagtccgttaggtaaacgccgtggggtcccttagacgtctccgtgtgtcggcctcgtggattctacttcgagttaagtggtcgtaggatggtaggttcgggtccgccgaggtccgtaccggaggggaacggggtcgtagggtacggttggggttacggtaacgtttaacgtaaaaaggtaaaagtgtaagtaggtaagaaagtaaaagtagtaacgtacggtacgaccgtaacccggtaaggaaaaggtaacgtaacttaccaaccgtaactaccgtaacgaaacggtaaagtaaacgttaaaacgttaaaccgaaaaaacggttcgggttaagtttaacgtttaacgaaactaaaagttacggaaaaaccgtacggtaacccgtaaacgggaaaaaacccggtcggaaaccaaccggtaaccgttacccgttattaaacgtttacccgtaacgtaaacccctaagttaacggtaacgttacgggtaacgtcgaacctaacggtacggaaacggtaaaggtcgtacgttagttcggttactttagaagttcgtaccgggtcgggaaccgtaaggtacgtaaggttccggg

SEQ ID NO: 113236 - DNA, 719 bp, Homo sapiens
  misc_feature: GYAE6OF01B6I6E.15.86.H09.1.454.CMB.1.raw
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
tcagtctacgtagccacgaccggtgctcgatttagtgctatagacttgggtttggggggggagaggagccccagccttgggatcccccaagtgttttcattcagtgatcaggactgaacacagaggactcaccatggagttcgggctgagcggtcggtttcgtgacgtgctatacgttaaaggtgtcagtgtgaagtgcaggtggtggagtcgtggggagccgttggtaaagccgtgggggtcccttagngtctctgtgtggcctgtggattctacttnagtaatggctggatggtagttcgggtccncgaggtcaccggagggaagggcgtggaggtgggttaggacggtttaacgaaaaaggtaaaatggaagttaggtagaaagaaaagttagacgtaggtcgaccgaaccggtaggaaagaagtacttaccaaccgtatccgtaagaagtaagtaaattaacgttaaacaaaaacggtacggttaagttaacgtttagaacttaaaagtagaaacgtaactacccgttaaacggaaaaccggtacgaacccgaacgaacgttaccgtaccttaacgttaacctacgtaaccaacgtaggtaacgttacggaacttaggaacctacgttaggaaaccggtaaaacggtggtaacttagttacgtgtttacgtagttgtacgggtaccggtaccggaaggtaccgttaaggtccggg

SEQ ID NO: 113237 - DNA, 664 bp, Homo sapiens
  misc_feature: GYAE6OF01CH1HT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctggggggtcccttagagtctcctgtgtggcctctggattcactttcagtaatggctggatgagttggtccgccaggctccgaggggaaggggcgtgggaggtggggttggacgtttacgaaaagtaaaatgaagtggtagaagaaaaatagaactaggtgacgacccgtagaaaggaagattacacatctacaagagataattacaaaacgtacggtagttatttagactaaatagaaacagaccgtaagaaaacccgaggaactaacacggtaccgttactatttaacctacgttaaccccatacgtaacgttacgggaaacgttgaacccgtaaagtaccggtaaaggtaaagggacggtacttaggttcgttactttttacgaatttacgttaccggtacgggggacccctaaggggaactaaggttccgggg

SEQ ID NO: 113238 - DNA, 825 bp, Homo sapiens
  misc_feature: GYAE6OF01BMWRT.15.86.H09.1.454.CMB.1.raw
  modified_base (755)..(755): a, c, t, g, unknown or other
  misc_feature (755)..(755): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttaggtaaagccgtgggggtcccttagacgtctcctgtgtggcctctgattctactttcagtaatggcgtggatggtaggttcggggtcccgccgacggccgtaccggaagggggaacgggggtcgtaggggtaggttggggtttagggtaaccggtttaacgtaaaaaacggttaaaaagtaggtaagttaggggtaagtaaaaggtaaaaagttaacggtaaccggttaacgggtacgtacccgaaacccgggtaaggtaaaaacgggaagtaaccgttaccaacccgtaattacccgtaaacgaaaaggtaacgtaattaaacgttaaacccgaaaaaacggttacgggttaagttaagttttaacgaaccgtaaaagtacggtaaaccgtaacggtacccgtaaacgggaaaaacccggaggtaaccaaccgtacggtaaccccgttacttaagtttaaccctacgtaacccgaacgttaagtacgttacgggaagtcgaacgtacggtaacggtaacggtaaaacgggngtccgtagtttggtttcgttttagaacttacggttcggaccggggacccttaaggggactaggttcgggg

SEQ ID NO: 113239 - DNA, 816 bp, Homo sapiens
  misc_feature: GYAE6OF01DW7Z9.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtcgtggggagtccgttaggtaaacgccggtggggggttccccttaggacgttcctccgtgtggtcggccttcgtggtattctactttcagtaatggcgtggatggtaggttcgggtccgtcgacggcctaccggagggggaacggggtcgtgggtagggttggggttaggtaacgtttaacgaaaaagttaaaagtgtaagtaggtagaaagtaaaagtagacgtacggtacgaccgtaacccggtaaggaaaacggtaacgtaacgttacccaacctaacttacctaacgtaaagtaagtaaacttaaacgttaaacgaaaaaaccgggttcggttaagtttaagtttacgaaacgtaaacgtacgaaacgacgtaacccgtaaacggaaaaaccgtaacggaacctaacgaccgtaccgtacttaacttaaccgtaacgtaccaacgtagtaacgttaccgggaagtcgaacgtacggtaacggtaaaaccgggtaaagggtacggtacgtttaagtttacggtttacgttttaaggtaacgttacggttacccggggtaaccggggtaccccggttaaaggggaaacccgttagggtttaccccgggg

SEQ ID NO: 113240 - DNA, 583 bp, Homo sapiens
  misc_feature: GYAE6OF01A33DN.15.86.H09.1.454.CMB.1.raw
  modified_base (414)..(414): a, c, t, g, unknown or other
  misc_feature (414)..(414): n is a, c, g, or t
  modified_base (439)..(439): a, c, t, g, unknown or other
  misc_feature (439)..(439): n is a, c, g, or t
  modified_base (512)..(512): a, c, t, g, unknown or other
  misc_feature (512)..(512): n is a, c, g, or t
  modified_base (538)..(538): a, c, t, g, unknown or other
  misc_feature (538)..(538): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaagggcgtggagtgggttggacgtttacaaaagtaaaatgaatggtagaagaaatagactacggtgacaccgtagaaaggaagattcacatcacaaganataatacaaaacgcggtatattganaaatgaacagacctagaaaaccgaggaaccacgagcctataattactagtaccatagtattacggaagtcganagtacgaacggtaaaggacggcttanggttctttagattagtcgtacgggacccgaagggacaagttcggg

SEQ ID NO: 113241 - DNA, 658 bp, Homo sapiens
  misc_feature: GYAE6OF01AXCX4.15.86.H09.1.454.CMB.1.raw
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (608)..(608): a, c, t, g, unknown or other
  misc_feature (608)..(608): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatggaggttgggtccgcgaggctccgaggggaggggctggaggtgggttggtacgtttacaaaagtaaaatgagtaggtagaagtaaaatagacgtacggtgacgacccgtagaaaaggaagtattacaaccatactanaaganattaactaacaaaacggtacggtgttaattcgaataaagtagaaacagtaccaacggtaaaaccgagaaccaagacgtccgttactaattacctacgtaaccacgtagtacgttacggaagtcgactagtaccgggtaaacgtaaacgggagtacgttagtacgttacgttttanaagtttacgtacggtacggggaacccgtaagggacttaacggttccgggg

SEQ ID NO: 113242 - DNA, 834 bp, Homo sapiens
  misc_feature: GYAE6OF01D6GYC.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtggggggtcccttagagtctcctgtgtggcctcgtggattcactttcaagtaatggctggatggtagttgggtccgccgaggcctccggaggggaagggcgtgggaggttggggttggtaacgtttacgaaaaagtaaaagtgaagtggtagaaagaaaagtagaacgtacggtcgaccgacccggtaaggaaaagggaagtaactttaccgaaccctaattacccgtaacgtaaaacggtaagtaaacttaaacgtttaaacccgaaaaaaaccgggttaccgggttaagtttaagttttacgaaacgtaaaattaggaaaacctaacggacccgttaaaccgggaaaaacccggacggtaacccgaaccgaacggtaccccgtttaaccgttaacggtttaaccctacggttaaccccaacgtaaggttaaccggtttaacgggtaacgttcggaacccgttaaacggttaaccgggaaaaccgggttaaaaggggaccggttaacgttagtttacggtttaccgttttttaaggaatttaacggttcccgggtacccggggggaacccggtaaaggggtacccgttaaggttcccggggg

SEQ ID NO: 113243 - DNA, 918 bp, Homo sapiens
  misc_feature: GYAE6OF01BQJCR.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggttttccttgctgctatacgttaaaggtgtcagtgtagaagtgcgaggtggtggagtcggtgggggacgtccgttagggtaaacgtccggttcggggggttacccttaggtacggttccttccgttggttcggtcggtcctcgttgggtactttcctacttttacgaaggttaagtggacggttggaagttgggtacgggtttcgggtcccggtaccgagggtccgtaccggggaagggggaacgggggtcggttaggggtaggggtttacgggggtttacggttaaaccggttttaaagtaaaaaagggtttaaaaagtggtaagttaaggggtaagaaaaacgggtaaaaagtaacggtaacggttaaccgggtacgaacccggtaaacccgggtaaggaaaaagggtaacgtaaaccgttacccaaaccgtaacgttaccgtaacggtaaaacggtaaattaaaacgtttaaacttaaaacggaaaaacgggtttacgggttaagtttaacgttaacgaaaacgttaaacggtaagaaaacccgtaacgaacccgggttaaaaccggaaaacgggtaaacgaccctacggtaacgtcccgtttaattaccgttaaccttaccgaaacccgtaagtaccggttaacgttaacgggaacgttacgaaccgtaaagtacccgggtaaaaagggtaagggtccgttaacttaggttaccgtttagttagtaagtcgtcgggtacggaccgtaggtaaggtcgtcggg

SEQ ID NO: 113244 - DNA, 752 bp, Homo sapiens
  misc_feature: GYAE6OF01BG5G2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttagggtaaacgccgtggggggtcccttaggtacgtctccgtggtgtcggccttcgtggtattcctacgttttcagttaatgggtcttagggacgtaggttcgggtccggccacgggcgttccgacggggaaggggcggtcgggagggtgggttggtacggtttacgtaaaaggtaaaaagtagacgtggtagaagaaaagtaagtacgtacggtagcgacccgtaggaaaggaagatacaccaatctacgaagaataataacttaacaaaacgaacggttgtaagttagtaacaaagtagtaacgaacgaccgtacgaaaaccggtacggaacaccgaagtaccggtacctaagtttactaccgttaacaaccgtacgtaaacgttttacgggaacgttacgacgtataaccggtaacggttaaaaacgggagggtacccttaaaggttaccgtactttttggaactttaacggcgggttaccgggggtaccccggaagggtaacccgtaaggttcggggttaccccgg

SEQ ID NO: 113245 - DNA, 625 bp, Homo sapiens
  misc_feature: GYAE6OF01ECSN6.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgaggggaagggctggaggtgggttggacgtttacaaaagtaaaatgatggtagaagaaatagacgtacggtgcgacccgtagaaaggaagagtacaccatctacaagagtaataattaacaaaacggtacgtagttagtttacgactaaatagaaacacgtaccgtaacgaaaacccgaggaacacgagtcccgtacttacttactacgtaaccacgtagtagttacggaagtcgactacgtacgaacggtaaaggcggtacttagttgtcgtttagattacgtcgtacggggacccgtaagggacgtaggtcgg

SEQ ID NO: 113246 - DNA, 794 bp, Homo sapiens
  misc_feature: GYAE6OF01BOY58.15.86.H09.1.454.CMB.1.raw
  modified_base (737)..(737): a, c, t, g, unknown or other
  misc_feature (737)..(737): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacgttaaaaggtgtccagtgtgaagtgcaggtggtggagtcgtgggggagtccgttagggtaaacgtccggttcggggggttaccccttaaggtacgttccttcccgtggtcgtcggtcctcgttggactttcctacgttttcaagttaagtggtcgttggagttggtaggttcgggtccgccgacggtccgtaccggacgggggaaggggtcgttagggacgggttggggtttacggtaaccggtttaacgtaaaaagtaaaaagtgtaagtacgggttagaaaagtaaagtacgaacgtacggtagaccgtaaacccggtaggaaaacggaacgtaacttaccgaactacgttacctaacgaaagtaaacgtaattaaaacgttaacgaaaaaacggttcggttaagtttaactttaaggaaactaaaatacggaaacgtaacgtaccgtaaaaggaaaacccggaagtaccaacgtacgtacccgttaattaacgttaacggtactaaaccacgtacggtaacgttacggaacgttcaacgtaacgtaacgggaacggttaaaggnggtaccttaggtacgtttattagtatacggtcgtcgggaaccgaggtactggtacgg

SEQ ID NO: 113247 - DNA, 665 bp, Homo sapiens
  misc_feature: GYAE6OF01CBXIY.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtggggggtcccttagagtctctgtgtggcctctggattcactttcagtaatggctggatgagttgggtccgcaggctccgagggaagggctggagtggtaggacgtttagaaaagtaaaatgagtggtagaagaaaagtgacgtacggtagaccaaccgtagaaagagacttacacctatctacaaagagtaattaagtaacaaaaacggtacggttagttaatttagaactaaaagtcggaaacacgacccgtaaggaaaaccggacgaaccaacgacgaccgttactaacttaccgtacggttaacccacgtaacgtacgttacggaaggttacacgtaacgtacgaaaccgtaaggtaaaaggcggtacttaagttggttacctttagtaacttacggtcggtaccggggacccgtagggtaactacggg

SEQ ID NO: 113248 - DNA, 694 bp, Homo sapiens
  misc_feature: GYAE6OF01CPLPJ.15.86.H09.1.454.CMB.1.raw
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattctactttcagtaatggctggatgtagttggtccgcaggctccgagggaggggctgggaggtgggttggacgtttacgaaaagtaaaatgagtggtagaagaaaatagacgtacggtagaccgacccgtagaaaacggaanacttcaccatactanaaagagaataacgtaacgaaaaacgtacgggttacgttaatttagaactaaagtacgaaactacggaccctaagggaaaaacccggaggaaccaaccgtaacgtacccgttaacttaacgttacctacggttaacccaacgtagttaagttacgggaagtcgaacgaagttcggaaaccggttaaaggacggtacttaagtggtttaccgttttagtaagttacgttccgggtaccggggcccgtaaacggggtaccgtaaggttacccgggg

SEQ ID NO: 113249 - DNA, 785 bp, Homo sapiens
  misc_feature: GYAE6OF01B9JSM.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaagccgtgggggtcccttagagtctcctgtgtcggcctctggtattctactttcagtaagtggcgtggatggtaggttcgggtcccgccgaggtcctaccggaggggaacgggggtcgtggggtaggttggggttagggtaaccgttttaacgaaaaaaggttaaaaagtgtagtagggtagaaagtaaaaagtaggtaaccgtacggtacgacccgtaacccggtaaggaaaagggtaagtacgttaccaacctatacctaacgaaagaagtaaacttaaagtttaaccgaaaaaacggtcgggttagtttaactttacggaaactaaaagttacgaaaacgtacggtaacccgtaaacggaaaaacccggaggaaccaacgaacggtacccgttaacttaacgtttaccgtaaccgtaacccaacgtagtaacgtttacgggaagttcgacgtaacggtaaccggtaaacgggtaaaaggtacggtacttaagttcggttcgtttagattacgttccggtacggggaccccgaaagggtaccgtaaggttcccgggg

SEQ ID NO: 113250 - DNA, 788 bp, Homo sapiens
  misc_feature: GYAE6OF01CA4XU.15.86.H09.1.454.CMB.1.raw
  modified_base (215)..(215): a, c, t, g, unknown or other
  misc_feature (215)..(215): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggngccttggtaaagccgtgggggtcccttagagtctctgtgtgcctctggattcactttcagttaatggctggatggtaggttgggtcccgcgaggcctcccggaggggaacgggggcgtggggtaggttggggtttacgggtaacggttttaacgaaaaaaggttaaaaagtgaagttgggtagaaagtaaaagtaagtaaccgtacggtagaccgtaacccggtaggaaaaggtaacgtaactttacgaacctagtacctaacgaaaggtaaggtaaattaaattaacccgaaaaaacggtaccggttagtttaagtttacgaaacgtaaaagtacggaaaacctaacggtaacccttaaacggaaaaaccggacggaaaccaaccgaacggtacccgtttacttaacgttacgttaccgtaacccaacgtaacggtagttaaccgggaagttacgacgtaaggtaaccggaaacgggtaaaaggtacggtacgtttaatcggtttatttacggtaatttacggttacgggtaccgggggtaacccaacggggtaacgtacggtttaccgggg

SEQ ID NO: 113251 - DNA, 627 bp, Homo sapiens
  misc_feature: GYAE6OF01AMW5M.15.86.H09.1.454.CMB.1.raw
  modified_base (579)..(579): a, c, t, g, unknown or other
  misc_feature (579)..(579): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatggaggttggggtcccgccaggcctccgaggggaaggggctggaggtgggttggacgtttacaaaagtaaaatgatggtagaagaaaatagactacggtgacaacccggtagaaaggaagtacttacaacctatcctacgaagagtaattaaacgttaacgaaaaacgtcggttagttaatttgaactaaagtcgaaacacgaccgtaagaaaccggaggacacgagcccgtatacttactacgtaccacgtagtacgttcggaagtcgactagtacgaacggtaaaggngtactagtgttctttagatcgtcggtcgggacccgaggactagtcggg

SEQ ID NO: 113252 - DNA, 704 bp, Homo sapiens
  misc_feature: GYAE6OF01DTBRG.15.86.H09.1.454.CMB.1.raw
  modified_base (426)..(426): a, c, t, g, unknown or other
  misc_feature (426)..(426): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatggagttgggtccgccgaggcctccggaggggaaggggctgggaggtgggtggtacgttacgaaaagtaaaatgagtggtagaagaaatagacgtacggtgacgacccgtagaaaggagaatcgaacctatacctanaacgaagtaattaactaacgaaaaacggtacggttagtaagtttagaactaaagttacgaaactacgacccgtaaggaaaaaccggaggaacccaacgacgtacccgtactaacgttaaccgtacttaacccgaacgtaaggtaacgtttacgggaagtacgaacgtaacgtaccggaaaacgggtaaagggacgtaacgttattacggttacctttttagaacttacggttccggtacgggggaaccccgtaaggggtaacctaaagggttcccggg

SEQ ID NO: 113253 - DNA, 854 bp, Homo sapiens
  misc_feature: GYAE6OF01EPDB0.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatgggagttcgggctgagctgggttttccttgctgctatacttaaaaggtgtccagtgtgaagtgcgagggtggtggaggtcgtgggggagtccgttagggtaaacggccggtcggggggtacccttaggtacggttccgttcccgttggtcggttcgggtcccttcgtacgggtacttttacctaccttttcgtaaaggttaagtcggggtaccgttagggaagttggtaacgggtttccgggggtccccgacccggtaacgggtcccgtaaccgggaagggggaaacggggggtcgtagggggtaggggtttaggggttacgggttaaccggtttaaacggtaaaaaaggttaaaaagtggtaaggttagggtaagtaaaaggtaaaaagtaaggtacggtaacggtcgtacccgaacccggtaaggaaaacggtaaacgtactaccaactacgtcctaaacgaaagtaacaagttaactaaacgaaaaacggttcgtaagttacgtttagaactaaacgtagaaacgacgtaacccgtaaggaaaaccggtccgaacaccgtacgtaccttactactaaccgtaacgaacctagtaacgtacgttacggaatacggtactaacggtaacgtaaacgggtaaaggtcggttaacttagttgttaccgtttagaacgttaccgtcgggtaccccggacgggaaggtaaccggtagttccggg

SEQ ID NO: 113254 - DNA, 753 bp, Homo sapiens
  misc_feature: GYAE6OF01C87XX.15.86.H09.1.454.CMB.1.raw
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
  modified_base (458)..(458): a, c, t, g, unknown or other
  misc_feature (458)..(458): n is a, c, g, or t
  modified_base (671)..(671): a, c, t, g, unknown or other
  misc_feature (671)..(671): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttcctgacgtgctatacttaaaggtgtccagtgtgaagtgcaggtggtggagtggtgggagtcgtaggacgtcgggtcgggtacctagngtcctcgtgtgcgtccgtgtgtactacttacttatagtagtgngtagtagtgtacggtcgaccgcgacgtcgacggagggaggtggnggtaggtggtacgtagttaaacgtaaaaagtaagagtaggtagaagaaacgtaaagacgtaacgtacggacgtaaccggaacggtaaaggaaaacggtaactacgtacaaccgtatacgaaaggtaanaagttaaactaacgtaaaacgtaaaccggtagtttacgttaataagaaattaagaacggtaacccaagggaaacctaaaacgggaaaacccggacgaaacgccgtaaacccgttcgtttaaacgttaaccgtaaccggtaataacccgaagttaacccgtaggttaaacggttagtaccggattaacggaaccggtaaaggggtaaacccggngtttaacgtacgtttacggtttgttaagtaccggtaccggtacccggggtacggtaaccgaaaggttacgttcgggtttccg

SEQ ID NO: 113255 - DNA, 629 bp, Homo sapiens
  misc_feature: GYAE6OF01EH4N3.15.86.H09.1.454.CMB.1.raw
  modified_base (407)..(407): a, c, t, g, unknown or other
  misc_feature (407)..(407): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagtccgttagggtaaaggccgtgggggggttcccctttaggaggttcctccgttggtggtgggtcctcgtggtattcacttttcagtaatggctggatgagttgggtccgccaggctccgagggaagggggctgggaggtggggttggacgtttacaaaagtaaaatgatggtagaagaaatagactaggngcaccgtagaaaggagattcacatctcaagagataattacaaaacgtacggtagtaatttgacaaatagaacaagcctaagaaaaccggagaacacagcctactattactagtaccacagtattacggaagtgactaacgtacgaacgtaaagggaggtacttagtcggttcttttagaattacgttcggtacggggtacccgaaggggtacaaggttcggg

SEQ ID NO: 113256 - DNA, 724 bp, Homo sapiens
  misc_feature: GYAE6OF01EUCOF.15.86.H09.1.454.CMB.1.raw
  modified_base (282)..(282): a, c, t, g, unknown or other
  misc_feature (282)..(282): n is a, c, g, or t
tcagtctacgtagccacgaccggtgctcgatttagtgctatagacttgggtttgggggagaggagccccagccttgggatccccaagtgtttcattcagtgatcaggactgaacacagaggactcaccatggagttcgggctgagctgggtttccttgctgctatcttaaaggtgtccagtgtgaagtgcaggtggtggagtcgtgggggagccttggtaaagccgtgggggtcccttagagtctcctgtgtggcctctggattcatttcagtatggctggntgagtggccgcaggctcgagggagggctggagtggggtgtacgttacaaaagtaaatgagtgtagaagaaatgaacgtaggtgactacccgtagaaaggtagacttacaacctatacctacgaaagtacgtaacttaaactacccgtaaaaacgtaccgggttagttaaagtttacggaacctaaaaagttacggaaaaccgtaacggtacccgtaaacggtaaaaaccccggtaggaaccaaccggaacgtaccccgttaacttaaacgttaaccgtaccgtaaacccacgtaacggtaacgttacggggtaaagtccggtactaaccggttaaccggaaaccgggttaaaagggccggtaacttaacgttcggtaccgtttttaggacttaacggtccgtacgggggaacccctaagggggtaacctaacgggttacggg

SEQ ID NO: 113257 - DNA, 654 bp, Homo sapiens
  misc_feature: GYAE6OF01BCRBF.15.86.H09.1.454.CMB.1.raw
  modified_base (450)..(450): a, c, t, g, unknown or other
  misc_feature (450)..(450): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatgggagttcgggctgagctgggttttccttgctgctatacttaaaggtgtccagtgtgaagtgcaggtggtggagtcgtggggagtccgttggtaaagccgtggggggtcccttaaggacgtcgtcctgtgtggcctctggattcactttcagtaatggctggatgtagttggtccgcgaggctccggaggggaaggggcgtgggtaggtggggttacggaacgttttaacgaaaaaaggttaaaatggtaagtaggtagaaaggaaaataggaacgtacggtcgacaccggtagaaaaggaagattcaaccagtctanaaagataactaatacgaaaacgtggttagtattaggaacaaagtgaaactagtacctaagaaaaccgagaacacgacgtaccgtacttatacgtacgtaccaactaggtaactaggaacgtgactacgtagaaacggttaaaggcgtacttagtcgtactttagattacgtacggtccggggaaccaacgggtaactaggtcgg

SEQ ID NO: 113258 - DNA, 742 bp, Homo sapiens
  misc_feature: GYAE6OF01AGDVC.15.86.H09.1.454.CMB.1.raw
  modified_base (265)..(265): a, c, t, g, unknown or other
  misc_feature (265)..(265): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttgggtaaagccgtggggggtcccttagagtctcctgtgtggcctntggattcactttcagtaatggctggatgaggttcggggtccgccgaggctccgaggggaggggcgtgggagtgggttggtacgtttacgaaaagtaaatgatggtagaagaaaatagacgtacggtgaccgacccggtaggaaaaggaagtacttaccacctatactacgaaagtagtaattaaacttaacgaaaaacggtcgggttagttaagttttacggaactaaaagttacggaaaccgtaacggtacccgtaaacgggaaaaacccggtaggaacccaaccggtaacggtacccgttaaccttaactttaaccgtacgtaaccccaagtaacggttaacgttacgggaacgttcgaaccgtaagtaccgggtaaaccggtaaaagggacggtacttaggttacgttcgttttaggaactttacggtcccgggtacgggggaccccgtaagggtaaaccgttagggttccggg

SEQ ID NO: 113259 - DNA, 700 bp, Homo sapiens
  misc_feature: GYAE6OF01EX9OV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaacggccgtgggggtcccttaggacgtctcctgtgtggcctctggattccactttcagtaatggctggatgtagttcgggtcccgcaggcctaccgaggggagggtcgtgggaggtgggttggtacgtttacgaaaaagtaaaatgagtaggtagaaagtaaaagtagaaccgtacggtagaccgtacccggtaaggaaagggaagtacttaccgaacctactacctacgaaagaacgtaattaaacgttaaccgaaaaacgggtacggttagttaagtttcgaaactaaaagtggaaacacggacctaaacggaaaccgacggaacaccgaggtcccttataactttactacgaacctagagttacgttacggaatacggactaggtacgaacggtaaaggacgtcttagttcgttacgtttagaacttaggttccgggtaacggggaccctaacgggtaacgtaggtccggg

SEQ ID NO: 113260 - DNA, 718 bp, Homo sapiens
  misc_feature: GYAE6OF01CT21A.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttgggtaaagccgtggggggtcccttagagtctcctgtgtggcctctggattctactttcagttaagtggcttggatggtaggttcggggtccgccgaggcctccggaggggaagggggcgtgggaggttggggttaggaacgttttacgaaaaaggtaaaatggtaagtgggtaagaaagtaaaagtagaacgtacggtacgaccgaacccggtaggaaaaggaacgtattaccaacctattacgtacgaaagtagtaacttaagttaaccgaaaaacggtcggttagttaatttaggaactaaataggaaacacggtacctaaaggaaaacccggtaggaaccaaccgtaacggtcccgttactaacgtttaccgtacgtaacccaacgtagtacgttacggaagttgactaagtacggaaacggtaagggacgtcgttaagttgttcgttttagaattacgtacggtccggggaccctaagggactggttacggg

SEQ ID NO: 113261 - DNA, 698 bp, Homo sapiens
  misc_feature: GYAE6OF01BKMF3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatacttaaaaggtgtccagtgtgaagtgcaggtggtggagtcgtggggagccgttggtaaagccgtgggggtcccttagagtctcctgtgtggcctctggatttctacttttcagtaagtggcgtggatggtaggttcgggtcccgccgaggcctaccggaggggaggggcgtgggaggtgggttaggtacgtttaacgaaaagtaaaatgtagtggtagaagaaaatagacgtaggtcgaccgaacccggtaggaaaaggaagtaacttccaaccgtatccgtaacaaagaagtaattaaacttaacgaaaaacggtggttagttatttagaacaaagtagaaacacggacctaacggaaaaccgagaacaccgacggtacccgttacctaattaccgtacgtaacccgaactaggtacgttacgggaagtcgactaacgtaccgggaaacgtaaagggcggtactttagttaggttcttttagatttacgtccgggtacggggacccgaagggtacctaagggttccggg

SEQ ID NO: 113262 - DNA, 718 bp, Homo sapiens
  misc_feature: GYAE6OF01CVKPQ.15.86.H09.1.454.CMB.1.raw
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
  modified_base (363)..(363): a, c, t, g, unknown or other
  misc_feature (363)..(363): n is a, c, g, or t
  modified_base (422)..(422): a, c, t, g, unknown or other
  misc_feature (422)..(422): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtcgtcagtgtgaagtgcaggtggtggagtcgtgggggatccttaggtaagccgtgggggtcctagagtcgtcctgtgngtcctctgatctacttnagtaatggtctggatgtagttggtcccgcgaggctacgaggggaagggctgggagtgggttgaacgtttacgaaaagtaaatgaatgganaagaaataggactacggtacgaccgtaccgtagaaaggatactacgaacctatacgtanaaacgtagaacttaacgtaaaccaaaacggttcgggttagttaaagtttaggaaacctaaacgttaagggaaaccaccgggtacccttaaacggaaaaacccggacgggtacccaaaccgacggtacccgttaacttaaactttacccgtaaccgtaaccccaagtaaccgtagttacccgggaattcgaacgtaacgtccggtaaaacgtaaggacggttactaattacggttagttttagaacgttacgtcggggttacccgggacccctaagggtaacctaagggtttccggg

SEQ ID NO: 113263 - DNA, 637 bp, Homo sapiens
  misc_feature: GYAE6OF01D3WOK.15.86.H09.1.454.CMB.1.raw
  modified_base (422)..(422): a, c, t, g, unknown or other
  misc_feature (422)..(422): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaacgccgtggggggtcccttagagtctcctgtgtggcctctggattcactttcagtaatggctggatggagttcgggtccgccaggctccgaggggaaggggcgtgggaggtggggttggtaacgtttaacaaaaaggtaaaaatgaagtggtagaaagaaaatagactacggtcgaccaaccggtagaaaggaanattaccacatcacaagagaataataacaaaacgtcggtattaatttgaactaaatagaaacagacctaaaggaaaaccgaggaacacgacgtccgtattaattactacgtaaccaatagtagttacggaatcgacagtacgaaacggtaaaggcgacttatcggttcttttagattacgttccggacggggacccgaagggtacctaggttcggg

SEQ ID NO: 113264 - DNA, 650 bp, Homo sapiens
  misc_feature: GYAE6OF01CQ4P7.15.86.H09.1.454.CMB.1.raw
  modified_base (217)..(217): a, c, t, g, unknown or other
  misc_feature (217)..(217): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtggtttcgtgacgtgctaatagtaaagtgtccagtgtgaagtgcaggtggtggagtcgtggggganccttaggtaaaagccgtggggggtcccttaggagtctacctgtgnggcctgtaggcttcattcagtaactggctggaatgngttcggcncaggcncgaggaaggcggngngtggtgtagtataaagtaaagtagagngtagagaaagaagacgtacgagacgacgaagaagaagtactacactactactagaagaagaagtaactaacgtaaacgtaacgtagttagttacgtaactaacgtaacgaacgaacgaacgtaacgaaacgaacgtaacgaacgaacgacgtacgtaactaacgtacgtaccgtacgtacgtaacgtacggtacgtacgacgtaacgtaacgtaaacggtaaaggtaacggtacgtagtacgttacgttagttagtacgtacggtacgggtaccggtaacggtaacggtagtacgg

SEQ ID NO: 113265 - DNA, 641 bp, Homo sapiens
  misc_feature: GYAE6OF01BG563.15.86.H09.1.454.CMB.1.raw
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (494)..(494): a, c, t, g, unknown or other
  misc_feature (494)..(494): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggaggtcgtgggggagccttggtaaagccgtggggggtcccttagagtctccgtgtgtggcctctggattcactttcagtaatggctggatggagtgggtccgcaggctccgagggagggctggagtgggtgacgtttanaaaagtaaaatgagtggagaagtaaatagactaggngacgaccgtagaaagganattacacctatctacgaagagaataacgttacgaaaaacggtacggttagttaacgtttagactaaagtagaaaccgacgaccgtaagaaaacccggngaaccgacgacgccgttaccttaattacctacgtaacccacgtaagtacgttacggaagtacgacaagtaccgaaaggtaaaggagtacgttagtggttctttagattacgttacgggacgggaccctaaggggaactaggttcggg

SEQ ID NO: 113266 - DNA, 575 bp, Homo sapiens
  misc_feature: GYAE6OF01CQNF7.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaactacaccatcaatggtatcaacagagaccagggaacgtcccccagtatataatagaaagttaagagtgatggcagccaacgaccgaagggggacggactcccgagtcgcttcagtcgggctcgagttcgtggggctggacccgctacctccaccactcctacccaaccgtccaagtctagaccgtagtgaggctgtacgtatcacgtgtgggagagagccaacacgaatgagtacggaccgtaagggacgggtttggggtaggttacgggcgggtaacgggaacccgaacgtcgtacggacccggttaccgtagggtccaaacccggg

SEQ ID NO: 113267 - DNA, 724 bp, Homo sapiens
  misc_feature: GYAE6OF01D3XDE.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtgggggagccttgggtaaacgccgtggggggtcccttaggacgttcctccgtggtgtcggtcctcgtggtattcctacttttcaagttaatggctggagtgaggttgggtcccgccaggcctccgaggggaaggggctgggagtggggttggtacgtttacgaaaagtaaaatgataggtagaaagtaaatagaacgtacggtgacctaacccggtagaaaacggaagtactttaccaaccgtataccgtacgaaaacggtagaaattaaacttaacgaaaaaaccggtaccgggttaagttaagttttacgaacgtaaaatacggaaaaccacggtacctaaaggaaaacccgtaggaaaccacggaacgtacccgttattaacgttaactacgttaaccaccgtaagaacgttaccggaagtcgacacgtacggaaacggtaaaggacggtctaagttggttcgtttagagttagtcccggtacgggacccgtaagggactaggttaccggg

SEQ ID NO: 113268 - DNA, 612 bp, Homo sapiens
  misc_feature: GYAE6OF01BBZAC.15.86.H09.1.454.CMB.1.raw
  modified_base (409)..(409): a, c, t, g, unknown or other
  misc_feature (409)..(409): n is a, c, g, or t
  modified_base (551)..(551): a, c, t, g, unknown or other
  misc_feature (551)..(551): n is a, c, g, or t
  modified_base (576)..(576): a, c, t, g, unknown or other
  misc_feature (576)..(576): n is a, c, g, or t
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacccgcttaaaccgggacaaccgtcgcccggccaacatacgccttcctcccgtccccccttcgcagtaacaccaagtacaggaatattaacctgtttcccatcgactacgcctttcggcctcgccgttaggggtcactcacctgccccgtattaacgtggacacggtaacccttggtcttccggcgaggccgggtcttttccgacccgtctttatcgttacttntgtcagctattcgctacttctcgactaccctccagctatcgccctcacacgcacctacccttcaactaggtaccttaacacgaacccgccctacccctaacccaacaacgcaataacgcgtcgcgtcgccgcagtcttcggngctagttcggttaccgtcccgtttnacttccgttcccgcacttcncgancttacgtgtacg

SEQ ID NO: 113269 - DNA, 922 bp, Homo sapiens
  misc_feature: GYAE6OF01DFY10.15.86.H09.1.454.CMB.1.raw
tcagtctacgtagccacgaccggtgctcgatttagtgctatagacttgggtttgggggagaggagcccccagccttgggatcccccaagttgttttcattcagtgatcaggactgaacacagaggacctcaccatggagttcgggctgagtcgttggttttcctgctgctattacgttaaaggtcgtacgagtgtagagtgcgtaggtggtgtacgtggtcgggtacgtaccgtttaggtaacgtccgggttccgggttaccttagtacgttccttccgttgtcggtccggtcctgtagttacttaccttacttacgtagttacgtcgtacgtaggtagtggtacgggttccggacccacggtaccggtacccggtaaccggggtaagggggtacgggtttcggttaggggttaacggggttttacgggggttaacgttttaaacccggtttaaaaacgtaaaaaagggtttaaatggttaaggttaagggtaaacgtaaaaaggtaaacggtaacccggtaaccgggttacggaaccggtaacccggtaacggtaaaaggaaacgtaactaccgtaacccaagtaactacgtaaagtaaagtaaacgttacgtaaaaacgtaacggtaaacggttacgtttaagtacttaaagtaacgtaaaagtacgaaccgtaaccggaaacccgtaagggaaacccgtaaccgtaactaccgtacttaaccgttacttacggttaaccacgttaacgaacgtacggtaacgtaggaaccgtacgttaaccggaacgttaaacgggtaacggttaaacggtacgtttacgttaacgtttttaggtaccgtttaaaggtccccggttaacggggtaacccccgtaagggggtaacccccttaagggttacccggttccggttaacccggg

SEQ ID NO: 113270 - DNA, 648 bp, Homo sapiens
  misc_feature: GYAE6OF01B53NU.15.86.H09.1.454.CMB.1.raw
  modified_base (404)..(404): a, c, t, g, unknown or other
  misc_feature (404)..(404): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttggtaaagccgtgggggtcccttagagtctcctgtgtcggcctctggtattctactttcagtaatggctggatgagttggtccgccaggctccgaggggagggcgtggagtgggttggtacgtttacaaaagtaaatgagtggtagaagaaaatagacgtacggtgacgaccgagaaagganatacacatacacaagagtataattaacgaaaacgtcggttattatttagactaaaagtgaaactacgaccgtaaggaaaacccgagaaccaacgacgtacccgttactattacctacgtaacccagtagtacgttacggaagtcgactaacgtacgaaacgggttaaaggacggtcttaaggtcgtttacgttttagaacgttacgtccggtacggggaccctaagggtaacgtaggttccggg

SEQ ID NO: 113271 - DNA, 624 bp, Homo sapiens
  misc_feature: GYAE6OF01BEAJ8.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttggtccgcaggctccgagggagggctggagtgggtggacgtttacaaaagtaaaatgatggtagaagaaatagactacggtgcaccgtagaaaggagactcacatctacaagagaataattaacgaaaacgtacggttagtaatttagactaaagtacgaaacacgaccctaaggaaaacccgtaggaaccaccgtaagcccgttactaacgttactcgtaacccaagtacgagtttacggaagtcgactacgtacgtaaacgtaaagggagtacgtagtaggttctttaggacttagtccggtcgggaccccgagggacctaaggtcggg

SEQ ID NO: 113272 - DNA, 645 bp, Homo sapiens
  misc_feature: GYAE6OF01AKYN6.15.86.H09.1.454.CMB.1.raw
  modified_base (487)..(487): a, c, t, g, unknown or other
  misc_feature (487)..(487): n is a, c, g, or t
  modified_base (554)..(554): a, c, t, g, unknown or other
  misc_feature (554)..(554): n is a, c, g, or t
  modified_base (559)..(559): a, c, t, g, unknown or other
  misc_feature (559)..(559): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagttaatggctggatgagttgggtccgcaggctccagggaagggctggagtgggttggacgtttacaaagtaaaatgatggtagagaaatagactacggtagcgacccgtaggaaaggaagagttacaaccatactcgaaagagtaattaaattacgaaaaacgtcggtagttaatttaggactaaagtgaaacaagaccctaagaaaaccgnggaaaccacgaacgtccgttaccttaagttactacgtacccaacgtagtaagtttaccggaagtcgntaacncggtaaacggttaaagggacgtcgttaatggttcttttagaattagttaccgtacgggggacccctagggaccgtaaggttccggg

SEQ ID NO: 113273 - DNA, 764 bp, Homo sapiens
  misc_feature: GYAE6OF01AF7R1.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcgactttcagttaatggctggatgacgttgggtccgcgaggctccgagggagggcgtggagtggttggtacgttttacgaaaagtaaaatgagttaggtagaagtaaaagtaggaactacgggtacgaccgtaaacccggttaggaaaaacgggaagtactttaccgaacccgtaattacctaaccgaaaaggtaacgtaaagtttaaaacttaaccgtaaaaaaaccgggtacgggttaagttaagttttaggaaacctaaaagttcggaaaacctacggaacccttaaacgggaaaaacccgagggaaaccaacgacggtcccgtaacttaacgttacgtaccgtaacccaagtaacgttacgttacgggaaagtcggtacaacggtaccggaaaccgtaaagggtaggtaccgttaacgttggttcgttttaacgttaaggtacgttaccccgggtagggggaccccgaggggtaaacccgttagttacgggg

SEQ ID NO: 113274 - DNA, 1066 bp, Homo sapiens
  misc_feature: GYAE6OF01CA3S1.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagtccgttaggtaaacggccgtggggggttcccctttaaggagttccgttccgttggttcggtcgggtcccttcgtgggtaactttcctaaccgtttttacgaaggtttaaacgtggggtaccgttagggtaaagttgggttaacgggttttccggggggttcccccgtacccggtaacggggtacccgttaccccggggaaagggggggtaaaacgggggggtccgttaggggggtaaggggtttcggggggtttacggggtaaccggtttttaaaccgaaaaaaaagggtttaaaaaaacgtgggttaacggttaggggttaaggtaaaaggtaaaaaaagttacgggaaaccgttaacggggtacggtaacccgtaaaccccggggttaagggaaaaaacggggtaaagtaaaccgtttacccgaaaacccgtaacgttacctaaacggaaaaaggtaacggttaaaacttaaaacgtttaaaacccggaaaaaaacgggttccgggtttaaggtttaaactttttacggaaaacgttaaaaacgtttaacggaaaacctaaccggtaaccccgttaaaagggaaaaaacccccggagggaaaaccctaacgtaacccggttaacccggtttaaacctttaaacgttttacccgtaaaccggttaaccccaaggttaacggttaacgttaacgggttaaacggtcgtaacccgtaaacgttaaccggaaaccgggttaaaaagggaccgttaacgtttagttacggttttccgttttaaggaactttaaccggtccgggtaacccgggggtaacccgtaaacgggtaaacgtaaacgggttttaccgggg

SEQ ID NO: 113275 - DNA, 769 bp, Homo sapiens
  misc_feature: GYAE6OF01DT8F6.15.86.H09.1.454.CMB.1.raw
tcagtctacgtagccacgaccggtgctcgatttagtgctatagacttgggtttggggtacgatttgatgttacctgatgcttagaggtcttttcctggaagcagggctatttgttgcttcagcaccgtagtgcctcgtcatcacgcctcacgtcctttgtatttttccggattttcgcctaggaaaaccacgccctacccgacgttaaaacccgggacaacccggtccgccccggaccaaacatacgccctttcctccccgtccccccttcgcaacgtaacaccaagtacaaggtaattacttaacctcgtttacccatcgactaccgtcctttcggcctcgccgttagggtccactccaccctcgccccgtagtttaacggttggaaccgacggtaccctttggtccgttccgggcggtacggtccgggttcctttttccgaccccgttcttttacgttccgtttacttacgtcgttacacgtctacgttccgacttactttcctagtaccttaccctccacgtctactccgtaccctaccaaccacgacctaacctacccttacacgtacgtaccttacgaccgaacccgtccctaccccctaacccaaccgaaccgacctaacgtaaccgccgtccgccgtaccgcccacgtacgtccgttcggtcgtaccgttacggtttacggttttacccgttccccgttttactacccttccccgttaccccgtacctacttccgtacgtacgtaccgtaacggtcgtacgg

SEQ ID NO: 113276 - DNA, 698 bp, Homo sapiens
  misc_feature: GYAE6OF01EO72E.15.86.H09.1.454.CMB.1.raw
  modified_base (382)..(382): a, c, t, g, unknown or other
  misc_feature (382)..(382): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatggagttgggtccgccgaggcctccgaggggaaggggcgtgggaggtgggttggtacgtttacgaaaagtaaatgagtggtagaagtaaanagacgtacggtagacaccgtagaaaggaagactacacactctacaagagtaataattacgaaaaacgtcggttattaagtttagactaaagtacgaaacgacgtaccgtaacggaaaaacccggacggaacctaaccgaacggtacccgttaacttaacgttaaccgttacggtaaacccaacgtaaggtacgtttacgggaaggttcgactaagtaaccggaaacggtaaagggtacgggactttaggtagttccgtttttaggacttacggtccggtacggggaccccgtaaggggtaactaacggttacgggg

SEQ ID NO: 113277 - DNA, 803 bp, Homo sapiens
  misc_feature: GYAE6OF01AZAMI.15.86.H09.1.454.CMB.1.raw
  modified_base (248)..(248): a, c, t, g, unknown or other
  misc_feature (248)..(248): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaacgccgtgggggtcccttagngtctcctgtgtggcctctggattcactttcagtaatggctggatggagtttggggtccccgcgaggccgtaccgaagggggaagggggtcgtgggaggtggggttggacgttttaacgaaaaaggttaaaatggaagtgggtagaagtaaaaagtgaccgtacggtgaccgaaacccggtagaaaagggaacgtacgtttaccaaccctagttcctaacgaaaggtaacgtaacttaaaacgtttaaccgaaaaaccggtacgggttaagttagttttacgaacgtaaaagtacgaaaacgaccggtacccgtaaacgggaaaaacccggaggaaccaacccgaaggtccccgttaacgttaacgtttaaccgtaacgttaaccccgaacgttaagggtaacgtttaacccgggaaagttacggaccgttaacgtaccgggtaaaacggttaaaaggggacggtagttaacgttacggtttccgtttagggaactttacggttacccggttaccggggggacccccgtaaggggtaacccgtaagggttacgggg

SEQ ID NO: 113278 - DNA, 803 bp, Homo sapiens
  misc_feature: GYAE6OF01B7HNL.15.86.H09.1.454.CMB.1.raw
tcagtctacgtagccacgaccggtgctcgatttagtgctatagacttgggtttgggggggagaggagccccagccttgggatccccaagtgttttcaaattcagtgatcaggactgaacacagaggactcaccatggagttcgggctgagcgtggtttcctgacgtcgctatacgttaaaggtgtccagtgtgagtgcgaggtggtggagtcgtgggggacgtccgttagggtaaacggtccggtggggggttacccctttaggacgttccgttccgttggtggttcgggccccttcgttgggtacttcctaacgtttctaaggttaagtggtaccttggtagttggtaaggtttcggggtacccgccgacggtaccgtaccgggaagggggaacggggtccgtagggtgggttaggggttacggtaaccggttttaacgaaaaaaggttaaaaagtgtaagttagggtaacggaaaagtaaaaagtacggtaacgtacggtacgaccgtaacccggtaaggaaaggtaacgtaacgttccgaaccgtagttctaacgaagtaagaacttaacgttaaacgaaaaacggtcggttaataacgtttacgaactaaagtcgaaacaacggaaccccgaaacgaggaacctacgaccggtcgtaattaccgtactacggtaaccaacggtagtaacgttacggaatcgaactaacggtaccggtaaagtacggagttaccgtagttactgttttacgacgttacggttccggaccggggtaccaagggtactaagggtccgtacgg

SEQ ID NO: 113279 - DNA, 767 bp, Homo sapiens
  misc_feature: GYAE6OF01ASRRO.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttaggtaagccggtgggggtcccttagacgtctccgtgtgtcggcctgtggattctactttcagtaagtggctaggatggtaggttcgggtcccgaccgaggccgtaccggaagggggacggggtcgtgggtaggtggggttaggtacgtttaacgaaaaaggttaaaatggagttaggtagaaagtaaaagtacgacgtacggtacgaccgtaccggtaaggaaaacggaagtacttaccaactatactaacgaaagaagtaattaaacgttaaccgaaaaacgttacggttagttaacgtttagaaactaaaacgtacgaaacctacgtaacccgtaaacggaaaaccggacgaaccctaacgaaccggtaccccgttaattaacgttaaccgtacgtaaccctaacgtaagttacgttaaccggaagttccgaactaacggtaaccggaaaacggtaaacgggtcgtacctttaagtcggttacgttttagactttacggtaccgggtacggggaccccaaaggggtaccgtaggttaccggg

SEQ ID NO: 113280 - DNA, 783 bp, Homo sapiens
  misc_feature: GYAE6OF01DAS7S.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttcctgctgctatacgttaaaaggtgtccagtgtgaagtgcgaggtggtggagtcgtgggggacgtccgttaggtaaacgccggtgggggtcctagacgtctccgtgtgtcggccttcgtggtactttctactttcgaagtaagtggcgtggtagtggtaggttcggtcccgcgaggtcctaccggaaggggaaggggtctgggtacggttggggttaggtaacgtttaaacgaaaaaagttaaaagtgtaagtgggtaagaaaggtaaaactaggtaacgttacggtcgaaccgtaaccggtaaggaaaaggtaactacgttaccaacgataccgtaagaaagtaacgtaattaaaactaaccgaaaaacggtcgtagttaagtttacgaaactaaagtaacgaaactaacggtaacccgtaaaggaaaaccccggaagaaccgaacgtaacgggtacccttaacgtttaacgttaaccgtaccggtaacccaaacggtagttaacgttacggtaagtacgtaacgaagttaccggaaaacggttaaggacggtcttagtacgttattttacggaacttacggtcccgggtaacgggaccccgttaaaggaacgtacgggttcgg

SEQ ID NO: 113281 - DNA, 669 bp, Homo sapiens
  misc_feature: GYAE6OF01DJ4H9.15.86.H09.1.454.CMB.1.raw
  modified_base (261)..(261): a, c, t, g, unknown or other
  misc_feature (261)..(261): n is a, c, g, or t
  modified_base (654)..(654): a, c, t, g, unknown or other
  misc_feature (654)..(654): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacgttaaaaggtgtccagtgtgaagtgcaggtggtggagtcgtggggagcgttggtaagccgtgggggtcctagagtctcgtgtgtcgcctgngtattctacttcagtatggcgtggtactgtaggttcggtccgccgaggtcctaccggaggggaaggggtcgtgggtaggttgggttgtacgtttaacgaaaaagtaaagtgtaagtggagtaagaaaagtacgaacgtacggtagaccgtaacggtaaggaaaggtaagtactacgactatcaacgaaagtagaattaacgtaacgaaaacggtcggtttaagtagtagaaactaaagtagaacgacgtacgtaaacgaaaacggacgaacacgtaccgtacgttactacttcgtaacgtaccacgtaagtacgtaggtacgtcgaacgtgtacgaaacggtaaagtcggtactagttcgttgttacgaattaccgtcgggtacggtaacggngggtaactggttcgg

SEQ ID NO: 113282 - DNA, 954 bp, Homo sapiens
  misc_feature: GYAE6OF01BIPU4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttcctgcgtgctatacttaaaggtgtcagtgtgaagtgcgaggtggtggagtcgtgggggacgtccgttagggtaaacgccggtacggggggtcccttaggtacggttcctccgttggtggtcggtcctcgtggtacttctactttcgaagttaagtggcgtggagtggtaggttcggggtcccgaccgaggtccgtacccggaagggggaacgggggtcgtggggtacgggttggggtttacgggtaaccggtttaaacgaaaaaaggttaaaaaatggtaagtagggtaaggtaaaagtaaaaagttacggtaaccgttaacgggtcgaaccgtaacccgggtaagtaaaacgggaacgtaaacgtttaccgaaaccctactaccgtaaacgaaagtaacggtaaacttaaacgtttaaaccggaaaaaaccggttacgggtttaactttaacggtttaacggaaaccgttaaaaagttaccgggaaaaccgtaaccgggtaacccgttaaaaccgggaaaaacccgggacgtaaacccgtaaccgtaacggttaaccccgtttaacgttaacgtttaacccctaacggtaaacccgaaaccggttaaaggttaaccgggttaccggttaaagtacccgggtaaacttaaccggttaaacccgggtaaaaacgggtaaaacggggtaacggttacttaagggttcccgtttaagttttaaggtaacgttaacccgggttaccgggtaaccccggggtaaaccgttaccggggtaaaacgttaccgggtttacccgggg

SEQ ID NO: 113283 - DNA, 765 bp, Homo sapiens
  misc_feature: GYAE6OF01BY7EK.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtcggcctctggattcactttcagtaatggctggatggtaggttgggtcccgccgaggcctaccgaggggaggggcgtgggaggtggggttggaccgttttaacgaaaaagttaaaatggaagtgggtagaaagtaaaataggtaacgttaacggtgaccgtaacccggtaggaaaacgggtaaagtacttaccgaaccctaagtaccgttaacgaaacggaagtaaattaaaacgtttaaccgaaaaaaccgggttaccgggttaagttaagttttacgaaacttaaaagtacgaaaccacggtaacccgtaaacggaaaacccggtacgggaaccaacgtacggtaccccgttacttaacgttaccgtacgtaacccaacgtaacggtacgtttacgggaagtcgacgtacgtaccggaaacggtaaagggacggtacttagttacggttacgttttagaactttagtccggtacggggtaaccccgagggtaaacgtaggttccgggg

SEQ ID NO: 113284 - DNA, 583 bp, Homo sapiens
  misc_feature: GYAE6OF01BTVR5.15.86.H09.1.454.CMB.1.raw
  modified_base (185)..(185): a, c, t, g, unknown or other
  misc_feature (185)..(185): n is a, c, g, or t
  modified_base (205)..(205): a, c, t, g, unknown or other
  misc_feature (205)..(205): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggancctcgatcaagctcacctgccaccctaagtagtgagcatcgaacctacaccatcgaatggtatcaacagagaccagggaacgtccccccagtatataatgaaagttaagagtgatgcagccacaccgaaggggacggactccccgatcgcttcagtgggctccagttcgtggggctgaccgctaccgtcaccatcctaccaaccctccacgtctgacgatgagctgagtactcacgtggtaggagagacgacccaacaactaattgaacgtggacccgaaagggtaccgggtttggggttggttcggggacgggaacggggaacccaaagggtccgtacggtaaccccggttccggtacgggttccgaaaccccgggg

SEQ ID NO: 113285 - DNA, 631 bp, Homo sapiens
  misc_feature: GYAE6OF01AR4D3.15.86.H09.1.454.CMB.1.raw
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
  modified_base (542)..(542): a, c, t, g, unknown or other
  misc_feature (542)..(542): n is a, c, g, or t
  modified_base (612)..(612): a, c, t, g, unknown or other
  misc_feature (612)..(612): n is a, c, g, or t
  modified_base (621)..(621): a, c, t, g, unknown or other
  misc_feature (621)..(621): n is a, c, g, or t
tcagtctacgtagccacgaccggtgctcgatttagtgctatagacttgggtttgggggggaggaggaggccccagcccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttaggagtctcctgtgtggcctcgtggattctactttccagttaatggcttgggatggagttgggtccgccgaggctaccgaggggaaggggctgggagtgggttggacgtttacgaaaagtaaangatggagagaaatagagtacgngacgaccgngaaaganatcacntacanaaganataatacaaaacggcggtaatnttagcaaaagtgaaacaggacctaagaaaaccgcggaaccacgacgaccgttaactataccctaagtacccactaggtaacttacggaatcgactnttaaccgggaacggttaaagggcgtacttaatcggttcttttagattacgttccgggcggggttaacccnggggtaaancgtttacggg

SEQ ID NO: 113286 - DNA, 661 bp, Homo sapiens
  misc_feature: GYAE6OF01ANR1T.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggctggagtgggttggtacgtttacaaaagtaaaatgagtggtagaagaaaatagacgtacggtgaccgacccgtagaaacggaagacttcgaaccatctacaagagaataattacgaaaacgtacggttagttaagtttacggaactaaagtcgaaacacgacctaaggaaaaccggaggaaccacgacggcccgttactaacgttactacgtacccaagtacgtacgttacggaagtacgacgaagtaccggaaaggtaaagggacggtacttaagttcggtactttttagaatttacgtccggtacggggaccccgaaggggtacgtaaggttaccggg

SEQ ID NO: 113287 - DNA, 742 bp, Homo sapiens
  misc_feature: GYAE6OF01B65GL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtggggagtccgttaggtaaacgtccggtcggggggttacccttaggtacgttccttccgttggtcggtcggtccttcgtggtatttcctacttttcaaggttaatggacctggattggtaggtttcggggtcccgccgtagggcctacccggaaggggaacggggcgtgggtaggttggggttacggtaacgtttaacgaaaaagtaaaaagtgtaagtggtagaagaaaaatgacgtacggtgaccacccggtagaaaggagtattacactatactacgaagtagtaattaacgttaaccaaaaacggtacggttagttaactttacgaactaaagtacgaaaccacgacctaaggaaaacccggtagaccaacgacgtacccgtcttaagtcgtacgtaaccacgtaagtacgttacggtaagtcacgtacgtaccggaaggttaaaaggcgtaacttagttagttacgttttagaattacgggttccggtacggggaaccccgtaagggtaaccgtagggtttccggg

SEQ ID NO: 113288 - DNA, 650 bp, Homo sapiens
  misc_feature: GYAE6OF01A1TY4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgagggaggggctggaggtgggttggacgtttacaaaagtaaaatgatggtagaagaaaatagactacggtgcaccgtagaaaggaagattacacctatactacaaagagaattaattaccgaaaaacggtacggttagtaagtttagaactaaaatcgaaacacgacctaaggaaaacccgaggaaccacgacgcccgtataacttacctacgtaacccacgtagtacgttacgggaagtcgaccaagtaccggaaacggtaaagggacggtacttagtcggttcctttttaggaatttacgtccggtacgggggaccccaaggggactaacggttcggg

SEQ ID NO: 113289 - DNA, 650 bp, Homo sapiens
  misc_feature: GYAE6OF01BACM6.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgcgtgctatcttaaaaggtgtccagtgtgaagtgcaggtggtggagtcgtgggggagccgttaggtaaagccgtggggggtcccttagagtcctcctgtgtggcctcgtggattcactttcagttaatggctggatgagttgggtccgcaggctcgaggggagggctggaggtgggtggtacgtttacaaaagtaaaatgaagtggtagaagaaaatagacgtacggtgacgacccggtagaaaggaagtattacaacctatactacgaaagagtaacttaacttaacgaaaaacggtacggttagttaatttagaactaaagtacgtaacacgtaccgtaagaaaacccggagaaccacgaacgtaccgtacttaacgtactaacgtacccacgtagtacgttacggaagtgacgcgttacgaaggtaaaggacggtcttagtcgttctttagattgtcggtacgggacccgagggacctaggtcgg

SEQ ID NO: 113290 - DNA, 704 bp, Homo sapiens
  misc_feature: GYAE6OF01B43ZR.15.86.H09.1.454.CMB.1.raw
  modified_base (693)..(693): a, c, t, g, unknown or other
  misc_feature (693)..(693): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcgtgggttttcctgctgctatacttaaaaggtgtcagtgtgaagtgcgtaggtggtggagtcggtgggggacgtccgttagggtaaacggccggttcggggggtcccttaggacgtcctcgtggtgtcggcctgtggtattctacttcgaagtaagtggtctaggatggtaggttcgggtcccgcggacggtccgtaccgggaaggggaacgggtcggtagggtaggttcgggttacggtaaccgtttaaacgaaaaagttaaaagtgtaagtaggtaagaaagtaaagtagaacgtacggcgacgacgtaagaaaggtaagacttaccgactactctagaaagtagtaactaataacgaaaaggtcgtagttaattgaactaaagtacgaacacgacccgtaaagaaaccgtagaacaccgtacgtacctaacttagttaaccacgtaaccacgtaagtacgttacggaatcgactagaaccggtaggaaacgcggtacttaggtcttcttagaacttacggccgggtaccggactaaagggntaacggttccg

SEQ ID NO: 113291 - DNA, 759 bp, Homo sapiens
  misc_feature: GYAE6OF01BT5PE.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatgggagttcgggctgagcttgggttttccttgctgctatacttaaaaggtgtccagtgtgaagtgcgagggtggtggagtcgtgggggagtccgttagggtaaacggccggtcggggggttcccttaggagttcctccgtggtcgtcggtcctcgtggtatttctactttcgaagtaagtggtctggagtggtaggttcgggtcccgaccgacggtccgtaccggagggggaacggggtcgtggggtagggttcggggttaggtaacggtttaaacgtaaaaaaggtaaaaagtggtaagtagggtaagaaagaaaaagtaggaacgtacggtagaccgtaacccggtaaggaaaaagggagtaacttaccaacctaactactaacgaaagaagtaaattaaacgtaaaccgaaaaacggtcggttaagttaagtttagaactaaaagtagaaaccgaagtacccgtaaagaaaacccggagaaccacgtacgtacccgttattaacttacgtacgtaaccaacgtagtacgttacggaagtacacgaagtacgtaaaggtaaaggcgtacttagtacgttgtttacgattacgtcgggtacgggacccgtaggtaactaggtcggg

SEQ ID NO: 113292 - DNA, 906 bp, Homo sapiens
  misc_feature: GYAE6OF01CYOR6.15.86.H09.1.454.CMB.1.raw
  modified_base (207)..(207): a, c, t, g, unknown or other
  misc_feature (207)..(207): n is a, c, g, or t
tcagtctacgtagccacgaccggtgctcgatttagtgctatagacttgggtttgggggagaggagccccagccttgggatccccaagtgtttcattcagtgatcaggactgaacacagaggactcaccatggagttcggctgagcttgggtttccttgctgctatacgttaaaggtgtccagtgtgaagtgcgaggtggtggatcgnggggatcgtggaagccgtggggtcctagagtctcgtgtgtcggctcgtggattcgtacttacagtaagtcggcgttggaatggtaggttcgggaccgcgtaggccgtaccggaaggggaacgggtctagggtaggtcggggtttagaaccggttttaacaaaaaggtaaaaatgtaaggtaggtaggtaaaacgttaaacgtacggtacgtaaccggtacgtaccggtaacccggttaaggaaaacggggaaccgtttaaacttaccgtaacccgttaaagttccccgtaaaacgtaaagggtaaacgttaaaccgtttaaaacgttaaccggtaaaaaaacccggttcggggtttaaacgtttaacggttttaacgggaaaacccctttaaaaagggttacggtaaaacccggttaaacgaaaccccccgggtttaaagggtaaaaaacccccggtaacggaaaccccgtttaaaccggtaacccgggttaaccccggtttaacccgtttaaaccgtttaacccgggtaaccgttaaaccccggtaaacgtaaccgggtttaaggtaaccggttaacggtacgtacctaacgggtaaccggttaaaccgtaagggacgttacgttacggttattacgggttttaccgaagtttacccggtggaacccgggtacggtaacgggacctaagggttcccgg

SEQ ID NO: 113293 - DNA, 1092 bp, Homo sapiens
  misc_feature: GYAE6OF01ELWW3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttagggtaaaacggcccgttgggggggttccccttaaggtacggttccttcccgttggttggttcgggtccccttccgttggggtaacttttccgtaacctttttaccgaaggttaaaacgttgggccgtttaggggtaagttgggtaagggttttcggggggttcccccggacccgaacgggggtccccgttaccccgggaaaggggggggaaaacgggggggtccgttaggggggtaagggggttttcggggggggttttacggggtaaacccgggttttttaaaccggaaaaaaaaagggttttaaaaaaaagtttagggtaaaaggtttaggggttaaagggaaaaagggttaaaaaaaacgttaacggaaaccggtttaaaccggggtacggaaccccgtaaaaccccccgggttaagggaaaaaaacggggtaaaacggtaaacgtttaacccgaaccctaaacgttacccgttaaccggaaaagtaaacggtaaaagtttaaaaaccgtttaaaccgtaaaaaaaaccgggtaccgggtttaaggtttaaacgtttttaacggaaacctaaaaaacgttaacggaaaaccgtaaacggtaaccccgttaaacgggaaaaaacccgggtaacgggaaaccaaacccgtaacggtaccccgttaactttaacgtttaaccgttaaccggttaaacccctaacgtaacgtaacgtttaaccgggaaagttacggaacctaacgtaaccgggtaaaaccgggtaaaaaggggacggttaaccgttaaggttcggttacgtttttagaactttacggttaccgggttaccgggggaccccgtaaggggtaacctaagggttacccgggg

SEQ ID NO: 113294 - DNA, 572 bp, Homo sapiens
  misc_feature: GYAE6OF01BM5WG.15.86.H09.1.454.CMB.1.raw
  modified_base (474)..(474): a, c, t, g, unknown or other
  misc_feature (474)..(474): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggctggagtgggttggacgtttcaaagtaaaatgatggtgaagaaatgactacggtgcacccgtgaaaggagattcacatctcaagagataatacaaaagcgtgtatttgacaaatgaacagacctagaaacccgaggacacgagccgtactattacngtaccactagacttcggaagtgacagtacgaacgtaaagggaggtcttaagtcgtacgttttgattagtcgtaggggaccccaaggggacaagtcggg

SEQ ID NO: 113295 - DNA, 615 bp, Homo sapiens
  misc_feature: GYAE6OF01CU2TA.15.86.H09.1.454.CMB.1.raw
  modified_base (321)..(321): a, c, t, g, unknown or other
  misc_feature (321)..(321): n is a, c, g, or t
  modified_base (425)..(425): a, c, t, g, unknown or other
  misc_feature (425)..(425): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgcaggctccgagggaggggctggngtgggtggacgtttacgaaaagtaaaatgaatggtagaagaaaatagactacggtgacacccgtagaaaggagatcaccatctacaagagataatacaaaacgnggtagttagttgacaaatgaacagacctaaggaaaccgaggaacacgagaccgttactaattactagtacccacgtagacgttacggaagtcgactagtaccgaacggtaaagggaggtacctagttcggtcctttttaggacgtttacgttacggtacggggacccgaaggggtacgaaaggtttcggg

SEQ ID NO: 113296 - DNA, 746 bp, Homo sapiens
  misc_feature: GYAE6OF01EEK7Y.15.86.H09.1.454.CMB.1.raw
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
tcagtctacgtagccacgaccggtgctcgatttagtgctatagactttggggtttgggggggagaggagccccagccttgggatccccaagtgttttcattcagtgatcaggactgaacacagaggactcaccatggagttcgggctgagcttgggttttccttgctgctatacttaaaaggtgtcagtgtagaagtgcgaggtgggtggagtcggtgggggacgtccgttagggtaaacggccggtcggggggttcccttaggacgtctccgtggtgtcggcctgtgtattcctacttnagtatggtcgtggtatggtaggttcgggtccgcgacggccgtaccggagggggaggggngtgggtagggttggggttaggtaacgttaacaaaaaggtaaaatggtaagtagggtaagaaagtaaaagtacggaacgtacggtacgaccgtaaccggtaaggaaaaggtaagtaccttaccaactacgtacctaagaaagtaagtaacttaaacgttaaaccgaaaaacggttcggttaattacgtttaacaaattaaacgtagaaaccaggtacctaaacggaaaccgaggaactacggacgtccgttaataacttacgtacgtaacccagtagtacgttacggaattcgactaacggacggtaaaacggtaaggcgtacttagtcgtttcgtttagagtaccggttcgggaccgggaccggaaggtaccgtaaggttcccgggg

SEQ ID NO: 113297 - DNA, 715 bp, Homo sapiens
  misc_feature: GYAE6OF01EN4JP.15.86.H09.1.454.CMB.1.raw
  modified_base (580)..(580): a, c, t, g, unknown or other
  misc_feature (580)..(580): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaaagccgtggggggtcccttagagtctcctgtgtggcctctggattcacttttcgagtaatggctggatgtaggttgggtcccgcgacggctccaaggggaagggggcgtgggtaggtgggttacgggtacgtttaacgaaaaaagttaaaaaagtgtaagttgggtagaagaaaaatacggaacgtacggtacgacgaaccccggtaaggaaaaggaaagtaattaccgaaccatacgtacgaaagaagtaataaactttaacgaaaaaaccgtaggtagttaatttacgaacaaaatacgaacaacggaaccccgaaaaccgacggaacaccgaacgcccgttactacttaacngtaacccaacgtaacgtattacggaaagttcgactaagtacggaacgtaaaagggtaacggacgttaattggttcctttttagacgttaatcggtacgggggtacccaaacggggactaaaggttcggttaccgg

SEQ ID NO: 113298 - DNA, 786 bp, Homo sapiens
  misc_feature: GYAE6OF01B2CGI.15.86.H09.1.454.CMB.1.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgccccccgtntgcatctcgccttgcgtgggancctcgatcaagctcacctgaccaccctaagtagtgacgcatccgaacctacaccatcgaatgtatcaacagagaccgaggaaccgtccccagtataataatagtaaagttagagtagagtggacaacgccgaacgaaccgggaaagggggaccggacctaccccggatccggaccgtttacgacgttcggggtaccttcccgtaggtttccggtacgggggtccttaccggtacccgttacccgttaaccctcccgtaaccccgtacgtacccttaccccgaaacccccgttcccgttaacggttaccgttaccggtaaccggtacggttacgggtaccgggttcgttaacggtaacgtttaaccgtaccggtaacgttacgggtaacgggaacggtaacgtaaccggtaacccctaacgtaacgttaacgttacggacggttacgggaacccggtaaaggggttccggggtttaggggttccgggttaccgggggtacggtaaccggggaaacccgtaacgggttcccgtacgggttaaccccggttccggttaagggtaccccggtaaccccggg

SEQ ID NO: 113299 - DNA, 844 bp, Homo sapiens
  misc_feature: GYAE6OF01CI87L.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggtttttccttgctgtctatacgttaaaaggtgtcagtgtgaagtgcgtaggtggtggagtcggtgggggacgtccgttagggtaaacggtccggttcggggggttacccttaggtacggttccgttccgttggttcggtcggtcccgttcgttcgggtactttccttaccgtttacgtaagttaagtgggtacgttaggtaagttggttacgggttccgggtcccggaccgaggtcccgtaccgggaagggggtaacgggggtcggttaggggtagggttcgggggtttaacgggttaaacggttttaaaacggaaaaaaggttaaaagtggtaaggttaggtaagaaaagtaaaagtacggtaacgtacggtacgaccgtaacggtaagaaaaggtaacgtactaccgaactataacgtagaaagaacgtaattaacgtaaacgtaaaacggaggtttagtaagtttaagaaactaaagtacgaaactacgtaaccgtaaaggaaacccgagaaccaacgaccgtacgttaacttaacgtaccgtaacgtaacccagttaacgtcgttaacgagtacccgaagtaacggtaacggaaaacggtaaggtagttaccgttaggtacctttaaggttttacaaggtttaccgtacggggaaccggacccgtaagggtaacgttacggttccgg

SEQ ID NO: 113300 - DNA, 636 bp, Homo sapiens
  misc_feature: GYAE6OF01AMTAW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgcgaggctccgagggaaggggctggagtgggttggacgtttacaaaagtaaaatgatggtagaagaaatagacgtacggtgacgaccgtagaaaggaagattacgacctatactacgaaacgagtaataagttaacaaaaacgtacggttagtaatttgaactaaagtacgaaacgtagacccgtaaggaaaccgaggaacacgacgaccgttatacttactacgtaccactagtacgttacggaagtcgacgtaacgtcggaaacggtaaagggtaggacttatggttctttagacttacgtcggtacgggacccagggtaactaggttccgg

SEQ ID NO: 113301 - DNA, 678 bp, Homo sapiens
  misc_feature: GYAE6OF01D4L53.15.86.H09.1.454.CMB.1.raw
  modified_base (329)..(329): a, c, t, g, unknown or other
  misc_feature (329)..(329): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcagggtggtggagtcgtggggggagccgttggtaaagccgtggggggtcccttagagtctcctgtgtggcctctggattcactttcagtaatggctggatgtagttgggtccgccaggctcgagggagggctgggngtgggttggacgtttacaaaagtaaaatgatggtagaagaaaatagactacggtgaccacccggtagaaacggaagtacttacaaccgtatctagaaagtagtaattaacttaacgaaaaacgtcgggttaagttaatttagaactaaatacgaaacgacgacccgtaaggaaaacccgaacggaaccaacgacgtaccgttacttaattaccgtacgttacccgaacgtaacgtaacgttacgggaagtgaccgacgttacggaaacggtaaagggaggtacttagtcggttcttttaggacttacgttcgggtacggggacccctaaggggtactaaggtttcgggg

SEQ ID NO: 113302 - DNA, 693 bp, Homo sapiens
  misc_feature: GYAE6OF01CV87Q.15.86.H09.1.454.CMB.1.raw
  modified_base (207)..(207): a, c, t, g, unknown or other
  misc_feature (207)..(207): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcatttttctccacaggtctctgtgctctgcctgtgctgactcacgcccccgtctgcatctgccttgctgggancctcgatcaagcctcacctgacctacctaagtgtgagcactaccgaacctacaccatacgatggtactacaacagacgaccgaagggtaacctcccccaagtactaagtaataggtaaaagttaaaggagtagaagtaggacaacggacccaaacgaaccggaaagggggtaaccgggtaaccgtacccccgaacgtccggtactttacgaacgttcgggtaccttcccgtaggttcggtcggggtcgtacggaaccccgctaaccccgtacacccgtacttccccgtacccgtaaaccctccgtaagtacctacggtaaccgatagggacgtctaggtacgtaacgtccgtagtacggttaaggacgaagacgtacccgaactaactagtacggagtaacggacccgtaaagggtacggggtttggacgggttacgggacgggtaacggacaagtccggttagacccgttgacggtccgaaccgg

SEQ ID NO: 113303 - DNA, 632 bp, Homo sapiens
  misc_feature: GYAE6OF01CL0W8.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccgaggctccgagggaaggggctggagtgggttggacgtttacaaaagtaaaatgatggtagaagaaaatagactacggtgacacccgtagaaaaggaagattcaaccatctacaagagaataattacgaaaaacggtacggttagtaatttagaactaaatagaaacagacctaagaaaaccgaggaacacgacgccgtactaatttacctacgtaaccaacgtagtaacgttcggaagtgacagtacgaaacggtaaaggaggtctaagttcggttcgttttagaattacgtcggtacggggacccctaaggggctaaaggttccggg

SEQ ID NO: 113304 - DNA, 620 bp, Homo sapiens
  misc_feature: GYAE6OF01CZ52P.15.86.H09.1.454.CMB.1.raw
  modified_base (413)..(413): a, c, t, g, unknown or other
  misc_feature (413)..(413): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaagccgtggggggtcccttagagtctcctgtgtggcctctggattcactttcagtaatggctggatgagttggtccgcaggctccgagggagggctggaggtgggtggacgtttacaaaagtaaatgatggtagaagaaaatagactacggtcgcacccgtagaaaggagtactcaccatctacgaaganaattaatacaaaacggcggtagttaatttgaactaaatacgaaacagacctaaggaaaacccgaggaaccaacgacgccgtactacttactagtacccagtaggtacttacggaagttcgacgtagtacggaaacggtaaagggcggtactagttggttccttttagattacgtcgggtacggggacccgagggacgtagttcgggg

SEQ ID NO: 113305 - DNA, 610 bp, Homo sapiens
  misc_feature: GYAE6OF01B1TGJ.15.86.H09.1.454.CMB.1.raw
  modified_base (437)..(437): a, c, t, g, unknown or other
  misc_feature (437)..(437): n is a, c, g, or t
  modified_base (457)..(457): a, c, t, g, unknown or other
  misc_feature (457)..(457): n is a, c, g, or t
  modified_base (494)..(494): a, c, t, g, unknown or other
  misc_feature (494)..(494): n is a, c, g, or t
  modified_base (564)..(564): a, c, t, g, unknown or other
  misc_feature (564)..(564): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgaggttcgggtccgccgaggctccgaggggaagggggcgtgggaggtgggttggacgtttacaaaaggtaaaatgagtgggtagaagtaaaagtagacgtacggtgacgacccgtagaaaggaagtactcaaccatctacaaganataatacgaaaacgtcggtntaatttgactaaatgaaacacgcctaagaaaacccgnggaacacgacgccgtactattactacgtaaccagtagagttacggaattgcctaagtcgaacgtaaaggngcttatgtcttttgattgtcggacgggacccagggtaccaggtcgg

SEQ ID NO: 113306 - DNA, 712 bp, Homo sapiens
  misc_feature: GYAE6OF01ACK5L.15.86.H09.1.454.CMB.1.raw
  modified_base (293)..(293): a, c, t, g, unknown or other
  misc_feature (293)..(293): n is a, c, g, or t
  modified_base (425)..(425): a, c, t, g, unknown or other
  misc_feature (425)..(425): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaagccgtgggggtccttagagtctctgtgtgctcgtgattcactttcagtaatggctggatgagttggccnccgaggctccgagggaggggctggagtgggttgacgtttacaaaagtaaatgagtggtagaagaaaagtagacgtacggtgccgtaacccgtaggaaaggaagtattacaccatcgacaagagtataactanaaaacggcggttagtatttacgaataaagtagaactacgtaccgaacggtaaaaccgacgggtaacacgtacggacccgtttctaaacgttcctaacggttaaaccccacttaagggttaccttaaccgggaagttaccgaaccgtacggttaccggaaacggttaaacgggacggttccgttaaattcgggtttaaccttttttagggaaaacttttacgggtttacccggggaaccggggtaaccccggttaaacggggtaacgttaaagggttttccccggggg

SEQ ID NO: 113307 - DNA, 881 bp, Homo sapiens
  misc_feature: GYAE6OF01AEV61.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcggctgagctgggttttccttgctgctatacttaaaaggtgtccagtgtgaagtgcgagggtggtggaggtcgtgggggacgtccgttagggtaaacgccggttcggggggtacccttaggacgttccttccgtggttcggtcggtccttcgtaggtactttcctacttttcgaagttaagtggtcgtggatggtaggttcggggtcccgaccgacggtccgtaccggagggggaacgggggtcgtagggtaggttcggggttaggtaaccggttttaacgaaaaaaggttaaaacgtgtaagtaggtagaaagtaaaagtacgaacgtacggtacgacccgtaacccgggtaaggaaaaggtaacgtaccttaccaacctataccgtaaacgaaaggaacgtaaacttaaacgttaaaccggaaaaaccggttcgggtttaagtttaaacgtttcggaaaacctaaaagttaaccggaaaccgtaaccggtaaccccggtaaaacggaaaaccccgggaacggtaaaccaacccggtaccggttacccgtttaccttaaaccgtttaccgtaacggtaaccccaagtaacggttaacgttacggggaacgttacgaacgttaaccgtaacgggtaaaccggtaaaagggtcgttaaaccgttgttacggtttaccttttagaacgttttaccgtccgggggttacccgggaacccggttaacgggtagttaacgggttccggg

SEQ ID NO: 113308 - DNA, 668 bp, Homo sapiens
  misc_feature: GYAE6OF01ES2Q8.15.86.H09.1.454.CMB.1.raw
  modified_base (380)..(380): a, c, t, g, unknown or other
  misc_feature (380)..(380): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtcagtgtgaagtgcaggtggtggagtcgtgggggagccttggtaaacgccgtggggggtcccttagagtctcctgtgtggcctctggattcactttcagtaatggctggatgagttggtccgcgaggctccgagggaggggctggagtgggtggtacgtttacgaaaagtaaaatgatggtagaagaaaatagactacggngacaccggtagaaaggaagagttccactatctacgaaagagaattaatacgaaaaacgtggtagtatttgaactaaatgaacacgaccgtaagaaaaccgaggaacacgacgtaccctactaattacctacggttaaccacgtaagtacgtttaacgggaagtacgactaacgttaccggaaacggttaaaacggggcggttaaccttagttacggttacgtttttaggactttaaacgtcccgggttacggggacccccgtaaaggggaccgtaaagggttcccggg

SEQ ID NO: 113309 - DNA, 638 bp, Homo sapiens
  misc_feature: GYAE6OF01EAHVU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctccgagggaggggctgggaggtgggttggacgtttacaaaagtaaaatgatggtagaagaaaatagactacggtgcacccgtagaaaggagattcacatctacaagagtataaattacgaaaaacgtacggtagtatttgactaaatagaacacgacctaaggaaaacccgaggaaccacgacgaccgttactaacttactacgtaaccacgtaagtacttacggaagtcgacacgtacgaaacggtaaagggacggtacttaagttcgttacttttaggaatttacgtccggtacgggggaccccgaaggggtaacctaaggttccgggg

SEQ ID NO: 113310 - DNA, 771 bp, Homo sapiens
  misc_feature: GYAE6OF01DZ7MR.15.86.H09.1.454.CMB.1.raw
  modified_base (350)..(350): a, c, t, g, unknown or other
  misc_feature (350)..(350): n is a, c, g, or t
  modified_base (411)..(411): a, c, t, g, unknown or other
  misc_feature (411)..(411): n is a, c, g, or t
  modified_base (527)..(527): a, c, t, g, unknown or other
  misc_feature (527)..(527): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcaggtggtggagtcgtgggggagtccgttggtaaagccgtgggggtcccttagagtctcctgtgtggcctctggattcactttcagtaatggctggatgaggttcgggtccgccgaggctccgaggggaaggggctgggaggtgggtggacgtttanaaaagtaaaatgatggtagaagaaaatagacgtacggtgaccgaaccggtagaaaaggaanattaccaactatctacgaaagagtaataaactaaccgaaaaaacggtacggttagtttaatttacggaaactaaagtacggaaaccaacggtaacccgtaaggaaaaaaccccggnggaacccaaccgtaacggtacccgttaacttaacgttaacccgtaacggttaaacccccaaaggtaacggtaacggtttaacgggaaacgttcgaaccgtaagttaacccgggtaaaacgggttaaaacgggacggttaccgttaagtttagggttaccgttttttaggaacgtttaacggttcccggggttaacccggggggtaaccccctaaagggggtaccctaaaagggtttcccggggg

SEQ ID NO: 113311 - DNA, 676 bp, Homo sapiens
  misc_feature: GYAE6OF01AXCUA.15.86.H09.1.454.CMB.1.raw
  modified_base (353)..(353): a, c, t, g, unknown or other
  misc_feature (353)..(353): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatcttaaaaggtgtccagtgtgaagtgcaggtggtggagtcgtgggggagtccgttggtaaaggccgtggggggtcccttagagtctcctgtgtggcctcgtggtattctactttcagtaagtggctggatggagttgggccgcaggcctccgaggggagggcgtgggaggtgggtggtacgtttanaaaagtaaaatgagtggtagaagaaaatagacgtacggtgaccacccggtagaaaagggaagtacttaccgaaccattacctacgaaagaagtaattaaacttaacgaaaaaacggtacggttagtaattttagaactaaaataggaaacacggacccgtaaggaaaacccggagaaccacaacggtcccgtattaacttacctacgtacccaagtagtacgttacggaagtcgactagtaccggtaaacgtaaagggcgtacttagtacggttcttttaggacttacgtcggtaccggggacccaagggactaagttcgggg

SEQ ID NO: 113312 - DNA, 679 bp, Homo sapiens
  misc_feature: GYAE6OF01A2LAU.15.86.H09.1.454.CMB.1.raw
  modified_base (511)..(511): a, c, t, g, unknown or other
  misc_feature (511)..(511): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttcgggccgcaggctccgaggggaggggcgtgggaggtggggttggacgttttacgaaaaagtaaaatggaagtggtagaagaaaagtagaacgtacggtgacgaacccggtagaaaagggaagtaattccaacatactacaaagagtaataacttacgaaaaacgtacggtagttaatttagaactaaagtagaaacagtacctaaggaaaaacccgnggaaccacgacgtaccgtacttaacttaccgtacgttaaccacgtaaggtacttacggaacgtcgactaagtaccggaaacggtaaagggacgtacttaagtcggttacttttaggaatttacggttacggtacgggggacccctaaggggtaactaacgggttcggg

SEQ ID NO: 113313 - DNA, 578 bp, Homo sapiens
  misc_feature: GYAE6OF01C9I71.15.86.H09.1.454.CMB.1.raw
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (316)..(316): a, c, t, g, unknown or other
  misc_feature (316)..(316): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtgtttcgtgagtcgctatacgtaagngtcagtntgagtgcaggtggtggagtcgtggggagccttggtaagccgtgggggtcccttagngtctcctgtgtggcctntggattctactttcagtaatggctggatgtagttgggtccgcaggctccgagggagggntggagtgggtggacgtttagaaaagtaaatgatggngaagtaaatcggatacggtgacaccgngaaagganatcaccntactanaagaanatagtaacaaacgtgtattatanaataanagaacncactaacgaaacgagacatacgtctacttattacgtacgaaccagtagtacgtacggatcgactacgtacggaacggtaagacgtactagttgttnttagattcgtccgggacgggacctaagggcgtaagttcggg

SEQ ID NO: 113314 - DNA, 738 bp, Homo sapiens
  misc_feature: GYAE6OF01DWFW0.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggttttcctgctgctatcttaaaaggtgtccagtgtgaagtgcaggtggtggagtcgtgggggagccgttaggaaaacggccgtggggggtcccttagacgtcctcctgtcgtcggcctcgtggacttctactttcagttaatcggctggatggtacgttcggtccgcgaggcctccgagggggaacgggtcgtgggaggtggggttacggtacggtttaacgaaaaaaggttaaaaagtcgtaacgttagggtaaggaaaggtaaaaagtacggtaaccggttaacgggtacgacccgtaacccgggtaaggaaaacggtaaacgtaacttaccgaacccgtatacctaacgaaagaagtaagttaaattaaccgaaaaacggtcgttagttagtttagaactaaagtacgtaacacgtacctaaaggaaaaccgaggtaacacgacgtccgttaattacttactacgtacccaagtacgtaacttcgggaaagttcgacgtacgtaacggaaacggtaaagggcgtaccttaagttcgttacgtttagactttagtccggacggggacccaagggctaaggtccgg

SEQ ID NO: 113315 - DNA, 670 bp, Homo sapiens
  misc_feature: GYAE6OF01A2XJH.15.86.H09.1.454.CMB.1.raw
  modified_base (508)..(508): a, c, t, g, unknown or other
  misc_feature (508)..(508): n is a, c, g, or t
  modified_base (605)..(605): a, c, t, g, unknown or other
  misc_feature (605)..(605): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaagccgtgggggtcccttagagtctcctgtgtggcctctggattcactttcagtaatggctggatggagttggggtcccgccgaggcctccggaggggggagggggccgtggggtaggttggggttcggtaacggttttacgaaaaaggttaaaaagtgaagtggtagaagtaaaagtaggaacgtacggtgaccacccggtaggaaaggaagacttacaaccatactacgaagagtaataataacgaaaacggtcggttagtatttagactaaagtgaaacngaccctaaggaaaccgagacacgacgccgtatactacgtacgaacccagtagtattcggaatgactacgtacggaacggtaaaagggcgtacgttanaggtttaccgttttgaagtttacgtccggttacgggggaccccaaaggggtacgtaaggttcggg

SEQ ID NO: 113316 - DNA, 823 bp, Homo sapiens
  misc_feature: GYAE6OF01EL298.15.86.H09.1.454.CMB.1.raw
  modified_base (769)..(769): a, c, t, g, unknown or other
  misc_feature (769)..(769): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggcctgagcgtttcggttttcctgctgtactattaacgttaaaggtcgtaccagttgtagtaagtgacgtagggttgggtggtacgttcgggtagggggacgttccggtttaagggtaaaccgtccggggttccggggggttacccgttaaggtacgttccttccgttggttcggtccggtcccttcgtaggttactttaccttaccttttacgaagttaagtcgggtacgttagggtagttagggttacgggtttcggggtccccgaccggaacgggtcccgtaccgggaaggggggaacggggtcggtaggggtaggggtttggggggttacggttaaccgtttaaaacgaaaaaaggtttaaaaagtggtaagttgggtaagaaaagtaaaagtacgtaacgttacggtcgaccgtaaccggtaaggaaaaggagtacttaccgaactatcctaagaaagagtaattaaactaaacgaaaacggtcggttaagttagttagaactaaagtacgaacgacgtaccgtaaacggaaaaccggacgaaccaccgtacgtacccgttataacttaccgtacgaccaacgtagtacgttacggaagtcgatacgtacggaaaggtaaaggngtacttagtcgttctttagattgtccggtacgggacctaaggactaaggttcgg

SEQ ID NO: 113317 - DNA, 827 bp, Homo sapiens
  misc_feature: GYAE6OF01DIRWF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctggttttccttgctgctatacgttaaaggtgtccagtgtgaagtgcgaggtggtggaggtcgtggggggacgtcccgttagggtaaacggcccggttcgggggggttacccctttaggtacgttccgtcccgttggttcggtcgggtcccttcgtggtatttcctacttttcgaagttaagtcggcgtaggtagtggtaggttcgggtcccgccgaggccgtccggagggggaagggtcgtgggagggttggggttacggtacggtttaaacgtaaaaaggttaaaagtggtaagtagggtagaaagtaaaagttagacggtacggtacgaccgtaacccggtaaggaaaaggtaagtaacgttaccaacctactaccgtaacgaaaggtaataacgttaaaacgttaaacgaaaaaaccggtcgggttaagtttaacgtttagaacgtaaagtaacgaaacgaacgtacccggtaaacgaaaacccggaacggaccaaccgtacgtacccgtttaatacgttaaccgtacgtaaccctagtaacgtacgttaaccgggaagttccggacgtaacgtacggtaaaccggtaaaaggccggttaagtacgtttccggttagttttagacgtttaccgtacgggtcccggggaacccgtaacgggtcttaacgggtccggg

SEQ ID NO: 113318 - DNA, 736 bp, Homo sapiens
  misc_feature: GYAE6OF01A9R85.15.86.H09.1.454.CMB.1.raw
  modified_base (556)..(556): a, c, t, g, unknown or other
  misc_feature (556)..(556): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacttaaaggtgtccagtgtgaagtgcgaggtggtggagtcgtgggggagtccgttaggaaagccggtgggggtcccttagagtctcctgtgtcggcctcgtggtattctactttcagtaagtggctggatggtagttcggtccgcaggcctccggaggggaaggggcgtgggaggttggggttaggtaacgtttaacgaaaaagtaaaaagtgtaagttgggtagaaagaaaactaggaccgtaggtcgaccgaaccggtaagaaaggaagtattaccgaaccatactaacgaaagaagtaattaaacgtaacgaaaaaccggtggttaagttaattacggaaataaacgtagaaaccgtacgaaccgtaaacggaaaaacccggnggtaaaccaaccgtaacggtacccgttaacttaacgtttaacctaccgtaaacccgaagtaacgttagttaacgggaagtcgaacgaagttacggaaacggtaaagggtcgtaacgttattggttctttaaggacttaacggtcggtacgggggaccctaagggtaacgtaaggttcggg

SEQ ID NO: 113319 - DNA, 733 bp, Homo sapiens
  misc_feature: GYAE6OF01DF82F.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatcttaaaaggtgtccagtgtgaagtgcgaggtggtggagtcgtgggggagtccgttggtaaagccgtgggggtcccttagacgtctccgtggtgtggcctcgtggtattctactttcagtaagtggtcgtggagtggtaggttcgggtccgccgaggccgtaccggaggggacggggcgtgggtggtgggttaggtacggtttaacgaaaaagtaaaagtaggtaagtggtagaaacggaaaatagtaacgtaacggtcgaaccgtaaccggtaaggaaaagggaacgtacgttaccaaccgtacgtactaacgaaacgtaagtaaacgttaaagttaaccggtaaaaacggtacggttaagtttacgttagtaactaaagtacgaaacgtacgaacccgtaaggaaaaccgacggaacacgacgtaccgtactacttactacgtaccagtagtactacggtaagtgaacgtacgtacggtaaaccggaaaggtcgtaacgttgtacgttagtttacgtacgtagttccgggacggtacccggacggtaccgtaaggttccggg

SEQ ID NO: 113320 - DNA, 851 bp, Homo sapiens
  misc_feature: GYAE6OF01CLUDS.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagccgttagggtaaaggccgtgggggggtaccccttaggacgttctccgtggtgtcggccttcgtggtactttctaccttttacgagttaagtggcgtggatggtaggttcgggtcccgccgaggtccgtaccggaagggggaacgggggcgttagggacggttgggggtttaggtaacgttttaacgaaaaaaggttaaaatggtaagtagggtaagaagtaaaagtagacgttacggtagaccgaacccggtaaggaaaacggaagtacttacaccgtattacgtaacgaaaggtaacgaattaaacgtaaaccgaaaaacgggttacggttaagtttaacgtttacgaaacgttaaaacgaggtaaaacctaaggtaacccgtaaacggaaaaaaccccggtacgggaaacccaaccgtaaccggtacccgttaaccgttaaactttaacccgtaacgtaaaccccaacgttaaggtaaccggtttacgggaagttacgaacgttaacggtaaccggaaacgggtaaaaggtacgggtaccttacggtttacggtttaccgttttaggaacgtttacggtacccggggtacggggtaacccccgaagggtaacccggtaaaggtttccgggg

SEQ ID NO: 113321 - DNA, 932 bp, Homo sapiens
  misc_feature: GYAE6OF01DVSCZ.15.86.H09.1.454.CMB.1.raw
  modified_base (177)..(177): a, c, t, g, unknown or other
  misc_feature (177)..(177): n is a, c, g, or t
tcagtctacgtagccacgaccggtgctcgatttagtgctatagacttgggttggggggagaggagccccagccttgggatccccaagtgttttcattcagtgatcaggactgaacacagaggactcaccatggagttcgggctgagctgggttttcctgctgctatacttaaaggtntcagtgtagaagtgcgaggtggtggagtcgtggggactccgttaggtaacgccggtcgggggtacccttaggacgtctcgtgtgtcggcctgtggtacttctactttcgagttaagtggctggattggtaggttcggtcccgcgacggtccgtaccggaaggggtaacggggtcttaggggtacgggtttaggggttacgttaaccggttttaaacgaaaaaaggttaaaagttcgggtaaagttagggtaaagtaaaaggtaaaaacgttacgggtaaccggttaaccggggtaccgtaaccgggtaaccccggttaaagggaaaaacggtaacgtaaccgtttaaccgaaccgttagttacccggtaaacgtaaaggtaaacgtaaacgttttaaaaccgtaaaccggtaaaaaacgggttcgtttaacggtttaaacgtttacggaaacgttaaaaacgttacggaaaccgtaacgttacccggtaaaacggaaaaccggaccggtaaaccgtacccgtaaccgggttacctttaaaccggttaacgttaaccggtacccgtaaacccgaacgttaaccggttaacggtttaacccgggaacttcggaacccgttaagggttaaccccgggtaaaaccgggttaaagggttcccgtacgtttaacggttaccggtttacgttttaacgacgtttaacccgggttccgggaacccgggtaacccgtaaagggtcccttagggttaccccgggg

SEQ ID NO: 113322 - DNA, 761 bp, Homo sapiens
  misc_feature: GYAE6OF01BNGN8.15.86.H09.1.454.CMB.1.raw
  modified_base (242)..(242): a, c, t, g, unknown or other
  misc_feature (242)..(242): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgagtgcaggtggtggagtctgggggagccttaggtaagccgtgggggtccttagngtctcctgtgtggcctcgtggattctactttcagtaatggcttggatggtaggttcgggtcccgcgtaggccgtaccggaaggggaacggggcgtgggtaggttggggttacggtaacgttttagaaaaagttaaaagtgaagttagggtagaaagaaaagtaggaacctacgggtacgaaccgaacccggtaaggaaaaggaagtaacgttaccaacctataccgtaacgaaaggaactaattaaacgtttaaccgaaaaaaccggttggttagttaagttttacgaaactaaaagtaggaaaacctacgaacccgttaaaggaaaacccggagaactaccgagtcccgtaagttaacttaccgtacgtacccgaacgtacgtaaagttcggaaagttcgactaacgttacgggaaaccgttaaagggcggtacttaagttcgggttaacctttagggtaaacttcgggttaacccggtcggggtaaaccccggtagggaacgttaacggttccgggg

SEQ ID NO: 113323 - DNA, 633 bp, Homo sapiens
  misc_feature: GYAE6OF01D7OO9.15.86.H09.1.454.CMB.1.raw
tcagtctacgtagccacgaccggtgctcgatttagtgctatagacttgggtttgggggggagaggagccccagccttgggatccccaagtgtttcattcagtgatcaggactgaacacagaggactcaccatggagttcgggctgagctgggttttccttgctgctatcttaaaaggtgtccagtgtgaagtgcaggtggtggagtctgggggagccttggaaagcctggggggtcccttagagtctcctgtgtggcctctggattcactttcagtaatggctggatgagttgggtccgccaggctccgagggaaggggctgggagtgggttggacgtttacaaaagtaaaatgatgggtgaagaaaatagactacggtgacacccgtgaaaggaagattcaccatctacaaagagtaattaagttacaaaaacggtacggttagtattttaggactaaagtgaaactagacctaggaaacccgaggacacgagccgtctaattactcgtaaccacgagtacgttacggaagttcgacgagtacggaaccggtaaaagggcggacttattgggtcctttttaggaattacgtccggtacgggggaccccgaaggggtacctaaagttccgggg

SEQ ID NO: 113324 - DNA, 596 bp, Homo sapiens
  misc_feature: GYAE6OF01AEDRB.15.86.H09.1.454.CMB.1.raw
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtcgtgggggagccttggtaaagccgtgggggtcccttagagtctcctgtgtggcctcgtggattcactttcagtaatggctggatgagttgggtccgccaggctccgagggaaggggcgtggaggtgggttggacgtttacaaaagtaaaatgatggtagaagaaaatagacgtacggtgacgaccgtagaaaggaagattcaacntcanagagataatacaaacgngtagtattgactaaatgaacagacctagaaacgagacacagccgtactattactacgtaccagagtacttacggaagtcgactacgtacggtaacgaaagggtacggtagttagtgttactttgagttactcgggtacgggaccgaagggactaggtacggg

SEQ ID NO: 113325 - DNA, 1116 bp, Homo sapiens
  misc_feature: GYAE6OF01DDFEG.15.86.H09.1.454.CMB.1.raw
tcagtctacgtagccacgaccggtgctcgatttagtgctatagacttggggtttgggggggagaggagccccagccttgggatccccaagttgttttcattcagtgatcaggactgaacacagaggacctcaccatggaggttcgggctgagtcgtttgggttttccttgtctgtcttaacgttaacgtttaaaagggtcgtaccgtaggttgtaggtaaggtggacggtaggggttgggtggtacggttcgggtgggggtacggtaccggttaagggtaaacgggtcccggggttcggggggttacccttaaggtccgttccgttccggttggttcggttccgggtcccttcggttacggttactttaccttaaccgttttaccgtaaggttaacggtcgggtacggttaggggtaacggttcgggttacggggtttccggggccccggtaccggtaccggggtacccgttaccggggggaaacggggggggtaacgggggtcggtttaggggggttaagggggttttaccggggggtttaaacgggttaaaccggttttaaaaacggaaaaaagggttttaaaaagttagggtaaagggttaaggggtaaaggtaaaaaacgggttaaaacggtaaccgggttaaaccggttaaccggggtaaccggtaacccgggtaaaccggtaaaggggaaaaacggttaacgtaaccttaacccaaaccgttactaaccgtaaggaaaaggtaacgtttaaaacttaaaacgtaaacccgggttaaacggttaccgggttttaagttacgtttaaaccggaaattaaaaccggtaacggtaaaaccgtaaaccggtaaacccgggtaaaacgggaaaacccgggtacgaaaccgtaaccggtaaccggttaccctttaacgtaaccgttaaacgaccttaaaccgaagttaagttaccggttaaaggaccgtacgtaaaccggtacggtaaacccggtaaaaggggttaacgggtaccgttagttaaccggttttagttccggttttaaacggacgttttacccgggggtacccggttaaaccgggggacccgttaagggtaaccgttcggggtaacccg

SEQ ID NO: 113326 - DNA, 822 bp, Homo sapiens
  misc_feature: GYAE6OF01EGYQ0.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttcctgctgctatacttaaaaggtgtccagtgtgaagtgcaggtggtggagtcgtgggggagtccgttggtaaacgccgtggggggttcccttaggtacggttctccgtggttgtcggtcctcgtggtattctacttttcgaagtaagtggcgtggatggtaggttcgggtcccgccgacggcctaccggaggggaacggggcgtgggaggttgggttacggtaccgtttaagaaaaaggttaaaaatgaagttgggtaagaaagtaaaaagtacggaacgttaacggtcgaccgtaacccggtaaggaaaagggaagtaacttaccgaaccctaagtacctaagaaacgtaagtaaacttaaaagttaaacccgaaaaaacgggtcgggttaagtttaacgtttacggaaacctaaaaagttaccggaaaacctaccggttaacccgtaaacggaaaaaacccggtacgggaaaccaacggtaaccggtacccggttactttaaacgttaaccgttaaccgaaccgtaacgtaggtaactttaccgggaaagttcgaacctaacgtaacggaaacggtaaagggtcggtacttaggtacgtttcgtttaagaacgtttaccgtcggggtaaccggggaccctaagggtaaaccgtgggttcccggg

SEQ ID NO: 113327 - DNA, 807 bp, Homo sapiens
  misc_feature: GYAE6OF01D2MUF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaggtgtccagtgtgaagtgcgaggtggtggagtcgtggggagccgttaggtaaagccgtggggtcccttagacgtctcctgtgtggcctctggtattctactttcgaagtaatggcgtggagtggtaggttcgggtcccgccgtaggcctaccggaaggggaaggggtcgtagggaggttggggttacggtaacggtttaacgaaaaaagttaaaaatgaagttaggtaagtaaagtaaaaagtacggaacgtaacggtacgaccgtaacccggtaaggaaaacgggtaagtaacgtttaaccaacccgtaagtaccgtaacgaaaagtaagtaaacttaaacgttaaaccgaaaaaacggtacggtttaagtttaagtttaacgaactaaaagttacggaaaaccgtaacggtaacccgttaaaacggaaaaacccggaggaaccctaaccgaacggtacccgtttaactaaacgttttaaccgtacgttaaaccccgaacgtaaccggttaagtttaacgggaagttccgaacgtaagtaccgaaacggtaaaggtcggtacttaggtacttcgttttagacgttaacgttccgggacgggtaacccgagggtaccgtaaggtttccgg

SEQ ID NO: 113328 - DNA, 1200 bp, Homo sapiens
  misc_feature: GYAE6OF01BTTCO.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtggggggagccgttagggtaaacgtccgtgggggggttcccctttaaggacggttccttcccgttggttcggtcgggtcccttcgtagggtactttcctacgttttcgaggttaaactcgggtaccgttgggaattcgggtaaggtttttcggggggttcccccggacccgtaacggggtcccgttacccccgggaagggggggtaaaacggggggggcccgtttaaggggggtaaccggggttttagggggggttttacgggggttaaacccgggtttttttaaaccgaaaaaaaaggggttttaaaaaaaaaacgttaggggtaaagtttacgggggttaaagggtaaaaagggttaaaaaaaacggttaacgggtaaacccggtttaaaccgggggttacggtaaaccccggttaaacccccccgggggtttaaaaggggaaaaaaaccgggggtaaaaacggttaaaccgttttaaccccgaaaaccccgtaaacgtttaacccggttaacccggaaaaaaggtaaacggtaaaacggtttaaaaacgttttaaacccggaaaaaaaaaacccggggtttacccgggggtttaaaggttttaaacgttttttaaccggggaaaacgtttaaaaaaacgttaccgggtaaaaaaccctaaaccccggggttaaaccccgtttaaaacccggggaaaaaaaaacccccgggtacgggggaaaaccccgtaaaaccccggtaaccgggttaacccccgggtttaaccttttaaaacggttttaaccccgttaaaccgggttaaacccccgtaaacggttaaacgggttaaaccggtttttaacccggggaaaggttcggtaacccggtaaacgttacccggggtaaaaacgggttaaaacggggtacggtaacccgtttagtttacgggttaccgtttttaagaacggttaacggttccgggtaccggggggtaaccccgtaaaggggg

SEQ ID NO: 113329 - DNA, 831 bp, Homo sapiens
  misc_feature: GYAE6OF01C7TOC.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcgaggtggtggagccgtggggagccgttggtaaacgccgtgggggtcctagagtctctgtgtggcctctggattcgtactttcagtatggctggatgagttcggccgcgagcgtccgagggaagggctggagtggttaggtacgtttacgaaaagtaaatgaagtggtagaagtaaatagacgtaacggtgacgtaccgtagaaacggataacgttcaactatctaacgaagaagtaataaacttaccgaaaaacggtcggttacgttaattacgaaacctaaaagttacgaaaaccctaggtaaccccgttaaacggaaaaacccgggacgggaaacctaaccggtaaccggttaccccgttaacgttaaaccgtttaaccgtaacccggttaaacccgaaaccgttaggtaaaccgttttaccgggaaacgtttaccggaaccgttaaacggttacccgggtaaaaaccgggtttaaaaacggggaccgggttaaccctttaaacgggtttacggtttaaaccccgttttttttaaggggaaacctttttaccggggttaaccccggtttaaccggggggggaaccccctttaaaacggggggtaaaccgttaaaaccgggttttccccggggggg

SEQ ID NO: 113330 - DNA, 598 bp, Homo sapiens
  misc_feature: GYAE6OF01BRNBG.15.86.H09.1.454.CMB.1.raw
  modified_base (551)..(551): a, c, t, g, unknown or other
  misc_feature (551)..(551): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggctggagtgggttggacgtttacaaaagtaaaatgatggtagaagaaatagactacggtgacacccgtagaaagagacttcaccatctacaagagtaataattacaaaaacgtacggtagttatttagactaaagtgaaacagcctaaggaaaacccgaggacacgacgccgtactattacctagtaccacgaagtacttacgggaatcgacagtacgaacggtaaaggnggtactagtgtctttagattacgtcggtcgggaccgaggacagtcgg

SEQ ID NO: 113331 - DNA, 615 bp, Homo sapiens
  misc_feature: GYAE6OF01DLBG6.15.86.H09.1.454.CMB.1.raw
  modified_base (531)..(531): a, c, t, g, unknown or other
  misc_feature (531)..(531): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaaagccgtggggggtcccttagagtctcctgtgtggcctcgtggattcactttcagtaatggctggatgtagttgggtccgccaggctccgaggggaaggggcgtgggagtggggttggtacgtttacgaaaagtaaaatgatagggtagaagaaaatagaactagtggtgcgacccgtagaaaggaagattacacatctacaagaagattaataacaaaaacggtacggttagtaatttagactaaatgaacagacctaagaaaaccgaggacacgacgccgtactaacttactacgtacctaanagtagttacggatgactataccggtaagaaaggcgtatagtgttcgttagattacgtcggtagggacccgaaggtacgtaacgg

SEQ ID NO: 113332 - DNA, 778 bp, Homo sapiens
  misc_feature: GYAE6OF01DB4C9.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtggggagccgttaggtaaacgccgtggggggtccttaggacgtctccgtggtgtggcctcgtggattctacttttcgagttaagtggtcgtggattggtaggttcgggtccgccgtaggtccgtaccggaagggggacggggtcgtgggtacggttgggttacggtaacgtttaacgaaaaagtaaaagtgagtagggtaagaaagtaaaagtaaggtaaccgtacggtacgtaccgaaccggtaagaaaaggtaagtacttacgaacctagtacgaacaaagaacgtaataaacgtaaccgaaaaacggtcggttaagttaacgttagaaccgtaaaattcggaaaaccacggtaacccgtaaacgggaaaaacccggtaaggaaccaaccggacgttacccgtaacgtttaacttacgaacgtaccctaagtaagttaacgttaccgaaagtcgaacgtacgttaaccggaaaggtaaacggagtaccgttagtacgtttccgtttagtaacgtcggttaccggtacggggtaaccccgtaagggaaaccgttaggttacccggg

SEQ ID NO: 113333 - DNA, 760 bp, Homo sapiens
  misc_feature: GYAE6OF01DEP73.15.86.H09.1.454.CMB.1.raw
  modified_base (407)..(407): a, c, t, g, unknown or other
  misc_feature (407)..(407): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaacgccgtggggggtcccttaggagtcctcctgtgtggcctcgtggattctactttcagtaatggctggatggtaggttcgggtccgccaggcctccggaggggaacggggctgggacggttgggttggaacgtttacgaaaaagtaaaagtgagtggtagaagaaaatagaacgtacggngaccgtaaccggtagaaacggaagtacgttaccaaccgtatactaacgaaagtaagtaacttaaagtaaaccgaaaaaaccgggtcgggttatttaacgtttacgaacgttaaaatacggaaacctacggtacccgtaaaggaaaaacccggacgggaactaaccgaccggtacccgtttacttaacgtttaaccgtacgtaaaccccgtagtaaggttacgtttaaccgggtaaagttcgaaccgtaaacggttaccggaaaacgggttaaagggacgtacgttaagttgttaccgttttagaagtttacgtacgggtaccggggaccctaaaggggactaagggttccggg

SEQ ID NO: 113334 - DNA, 629 bp, Homo sapiens
  misc_feature: GYAE6OF01AVT2W.15.86.H09.1.454.CMB.1.raw
  modified_base (387)..(387): a, c, t, g, unknown or other
  misc_feature (387)..(387): n is a, c, g, or t
  modified_base (562)..(562): a, c, t, g, unknown or other
  misc_feature (562)..(562): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtggggggtcccttagagtctcctgtgtggcctctggattcactttcagtaatggctggatgtagtgggtccgccaggctccgaggggagggctgggagtgggttggtacgtttacaaaagtaaaatgagtggtagaagaaaatagaacgtacggngacgaacccggtagaaaggagtattaccaacactctacaagagaataatacaaaacggtacggtagttattgactaaagtagaacacgactaagaaaccggagacacgacgccgtactacgttactacgtaccagtagacgttacggaagtgactagtacggaacgtaaacgggnggtacgtagtacgtcgtttaggattacggtcgtacggggaccccgaaggggtaacctaaggttcggg

SEQ ID NO: 113335 - DNA, 671 bp, Homo sapiens
  misc_feature: GYAE6OF01DE2BC.15.86.H09.1.454.CMB.1.raw
  modified_base (387)..(387): a, c, t, g, unknown or other
  misc_feature (387)..(387): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgaggggaaggggcgtggaggttgggtggtaacgtttacgaaaaagtaaaatgagtggtagaagaaaatagactacggngaccaacccgtagaaaggaagacttacaaccatactcaagaagtaattaaacttacgaaaaacgcggttagtactttagaactaaagtagaaacacgtacctaaggaaaacccgaggaaccacaacgtaccgtcttaattaacctagtaacccaacgtagtacgttacggtaagtcgactaacgttaccggaaacggtaaagggaacggtaacttaagttcggttactttttaggaacttagttccggtacgggggacccctaaaggggactaagggttccggg

SEQ ID NO: 113336 - DNA, 639 bp, Homo sapiens
  misc_feature: GYAE6OF01DPR9R.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttggggtccgccaggctccgagggaaggggctgggagtggggtggacgtttacgaaaagtaaaatgatggtgaagaaaatagactacggtgcacccgtagaaaggaagactcaccatctcaagagaataatacaaaacgcggtagtatttagactaatagaaacacgacctaggaaaacccgagggaacacacgccgttactaatttaacctcgtaacccacgtagtaacgttacggaaaggtcgacgtacgtaccggaaacggtaaagggacggtacgttaagttcggtctttttagatttacgttcggtacgggggtccccgaagggaccgtaaggttccgggg

SEQ ID NO: 113337 - DNA, 646 bp, Homo sapiens
  misc_feature: GYAE6OF01BRJ1M.15.86.H09.1.454.CMB.1.raw
  modified_base (429)..(429): a, c, t, g, unknown or other
  misc_feature (429)..(429): n is a, c, g, or t
  modified_base (593)..(593): a, c, t, g, unknown or other
  misc_feature (593)..(593): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtccctagagtctctgtgtggcctctggattctactttcagtaatggctggatgtagttgggtccgccgaggcgtaccgagggagggcgtgggaggtgggttggacgtttacaaaaggtaaagtgtagtggtagaagaaatagacgtacggtgacgaccgtaggaaaggaagtattacacactctacaaganaataactaacgaaaacgtcggttataagtttagaactaaaagttcgaaactacgtaccgtaaacggaaaacccgaggaacccacgaacgtacccgttattaacttaccgtacgtaacccagtaagtacgttaacggagtcgactacgtacggaacggtaaaggnggtactagttcgttactttgattagtcggtacggggaccaagggctagtccgg

SEQ ID NO: 113338 - DNA, 667 bp, Homo sapiens
  misc_feature: GYAE6OF01BX3NF.15.86.H09.1.454.CMB.1.raw
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
  modified_base (500)..(500): a, c, t, g, unknown or other
  misc_feature (500)..(500): n is a, c, g, or t
  modified_base (589)..(589): a, c, t, g, unknown or other
  misc_feature (589)..(589): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtgggagtcgtgggggagccttgggtaaagccgtgggggtcccttagagtctccgtgtgtggcctctggattcactttcagtatggctggatgaggttcgggtccgccgaggcctccggaggggaaggggcgtgggaggtggggttaggacgtttaacgaaaagtaaaagtgtagtaggtagaagaaaatagacgtaggtnacgaccggtagaaagganatacacctatctacaaganaataatacgaaaaggtcgtatagtttagaacaaatagaacacgaccgtaagaaaacccggngaacaccgaggtacccgtattaacttactacgtaccaacaaggtaccgttaggaacgtgacccgtagtaaccggaaggttaaaacgggnggtacttaggttagttaccttttagaacttacggtaccggtacgggaccccggtaagggaaccgtaggtttacccggg

SEQ ID NO: 113339 - DNA, 748 bp, Homo sapiens
  misc_feature: GYAE6OF01ALR0U.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttccgtgacgtgctatcgttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggttggacgtttacgaaaagtaaaatgagtggtagagaaatagacgtacggtagcgacccggtagaaaaggaagagttaccaccgtatccttacgaaagaagtaataaacgttacgaaaaacgtacgggttagttacttttaggactaaagttggaaacctacgacccgtaaggaaaacccggtaaggaacccaccgacggtaccccgttacttaacgtttaaccttaccggtaaccctaaccgtaacgtaacgtttacgggtaaacgtcgtaccgtaacggtaccggtaaaccggtaaaaggggtacgggtaccgtttaagttggttaaccgttttttaggtacgtttaacggttcccgggttaccggggggtaccccccggtaagggggtaaacccgttaacgggtttaccgggg

SEQ ID NO: 113340 - DNA, 653 bp, Homo sapiens
  misc_feature: GYAE6OF01CETTS.15.86.H09.1.454.CMB.1.raw
  modified_base (382)..(382): a, c, t, g, unknown or other
  misc_feature (382)..(382): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccttggtaaagccgtggggggtcccttagagtctctgtgtggcctctggattcactttcagtaatggctggatgagttgggtccgccaggctccgagggaggggctggagtgggttggacgtttacaaaagtaaaatgagtggtagaagaaatagacgtacggngacacccgtagaaaggagatacaccatacctanaaganaataactacaaaacggtacggttagtaagtttacgataaagtgaaacacgtaccgtagaaaaccgagaacacgacggtccttacttaacgttacctacgtaacccaagtagtacgttaccgggtaagtcgacgtacgtacggaaccggtaaagggtcggtacttagttagttcgttttagactttagttaccgggtacggggtaccccgaagggtaaccgtaacggttccggg

SEQ ID NO: 113341 - DNA, 625 bp, Homo sapiens
  misc_feature: GYAE6OF01EQDMV.15.86.H09.1.454.CMB.1.raw
  modified_base (478)..(478): a, c, t, g, unknown or other
  misc_feature (478)..(478): n is a, c, g, or t
  modified_base (561)..(561): a, c, t, g, unknown or other
  misc_feature (561)..(561): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttgggccgcaggctccgaggggagggctgggaggtgggtggacgtttacgaaaagtaaaatgatggtagaagaaaatagactacggtgcaccggtagaaaaggagtacttcacctatctacaagagaataattacgaaaacgtcggtagtatttgaacaaatgaacagacctaagaaaaccgngaacacgacgtcccgtactaattacctagtaacccagtaacgtacgttacggaagtcgacaagtaccggaaaggtaaacgggnggtacttagtacggttcttttagaattacgtcggtacggggacccaaggggtactaaggttcgg

SEQ ID NO: 113342 - DNA, 1037 bp, Homo sapiens
  misc_feature: GYAE6OF01B0VJ6.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtgggttttccttgctgctatacgttaaaaggtgtccagtgtgaagtgcgaggtggtggagtcgtggggacgtccgttagggtaaacgccggttcgggggttacccttaggacgttcctccgttggttggtcggtccctcgtggtactttccgtacttttacgaagttaacgttggtcgttaggtagttggtacgggtttcggggtccccggtcccgtaagggtcccgttaccggaaggggggtaacgggggtccggttagggggtacggggtttacggggggtttacggggttaaaccggtttttaaaaccggtaaaaaaaaggttttaaaaaacggtgggttaaagggtttaggggttaaaagggtaaaaacggtaaaaaaacgtttaacggtaaccggtttaaaccgggttaaccggtaaccccggtaaaccccgggttaaaaggggaaaaacgggtaaacggttaaccgttttaacccgaacccgtaacgtttaccgtaacgaaaaacggtaaacgttaaacgtttaaaacgtttaaacccggaaaaaaaccgggttcgggtttaagttttaacgtttaacggaaactaaaaagttcggaaaacccgtacggtaaccccgtttaaaaccgggaaaaaacccgggaccgtaaacccgaaccgtaaccgggtacccccgttttaaagtttaacgtttaaccgtacccgttaaaccccaacggttaacggtttaacggttaccgggtaaaagttccggaacttaaccgggtaaccgggtaaaacgggttaaaagggtccgtaacgttaagttcggtttaccgttttagaacgttacggttcccggggttacgggaaacccccgtgggtaaacctaacggggtttccggg

SEQ ID NO: 113343 - DNA, 741 bp, Homo sapiens
  misc_feature: GYAE6OF01BZU3K.15.86.H09.1.454.CMB.1.raw
  modified_base (695)..(695): a, c, t, g, unknown or other
  misc_feature (695)..(695): n is a, c, g, or t
tcagtctacgtagccacgaccggtgctcgatttagtgctatagacttggggtttggggggggagaggagccccagccttgggatccccaagtgttttcattcagtgatcaggactgaacacagaggactcaccatggagttcgggctgagctgggttttcctgctgctatcttaaaaggtgtccagtgtgaagtgcagggtggtggagtcgtggggggacgccgttagggtaaacggtccggttcgggggggttccccttaggacgttcctcccgtggttggtcggtcctcgtaggtatttcctacttttcaagttaagtggtcgtggagtggtacggttcgggtcccgccgaggtccgtccgggaggggaggggcgtggggtaggttggggttaggtaacggtttaacgaaaaaggttaaaaagtcggtagtacggtaggaaagtaaaaagtagtaacgtacggtacgtaccgaaccggtaacggaaaaggaaggtacttacacctatctaacgaagaataataaacgtaaccaaaacgggtcgttagttaatttacgaactaaatacggaaactacgacgtaacggaaaacgcggtaacacgacgttccgtaactaagttcctagtaccctagtaacggttatacggaagttccgaatcgtacggaaacgggttaaagcggtatagttcgttntttcggaattacgtcgggtacgggaccggagtaagtcggttacggg

SEQ ID NO: 113344 - DNA, 923 bp, Homo sapiens
  misc_feature: GYAE6OF01DUE5T.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttccgtgctgctatacgttaaaggtgtccagtgtgaagtgcaggtggtggagtcgtggggagtccgttaggtaacgccgtgggggtcccttagagttctccgtgtgtcggcctgtggtattctactttcgtagtaagtggtcgtggagttcggtaggtttcggggtcccgaccgacgggtccgttacccggaagggggaacggggggtcgtaggggtacgggttgggggtttacgggttaaccggttttaaacgtaaaaaaaggttaaaaagtggtaagttagggtaagtaaaaggtaaaaacgtaggtaaccgtaacgggtaccgacccgtaaaccccggttaaggaaaaacgggtaacgtaacgttacccaaccgtacttacccttaacgaaagtaacgtaaacgttaaactttaaacccggaaaaaacggtaccgggttagtttaaacgtttacggaaacgtaaacgttaacgaaaccgtaccggtacccgtaaacgggaaaaacccggtacgggtaaacccaaccggtaaccgtacccgtttaccgtttaacgttaacccgttaacgtaaaccccgtaacgtaacggttaacggtttaaccgggaaggtcggtaaccgtaaaccggttaaccgggtaaaagggttaaaacgggtacggtaacggtttaagttacgggttttaacgtttttaaccggaagtttaccggttcccggggttaacccggggtaccccggtaaaggggtaccttaaccggggttccgggg

SEQ ID NO: 113345 - DNA, 788 bp, Homo sapiens
  misc_feature: GYAE6OF01CL363.15.86.H09.1.454.CMB.1.raw
tcagtctacgtagccacgaccggtgctcgatttagtgctatagacttgggtttgggggggagaggagccccagccttgggatccccaagtgttttcattcagtgatcgaggactgaacacagagactcaccatggagttcgggctgagcttggttttccttgctgctataccttaaaaggtgtccagtgtgaagtgcgaggtcgggtggagtcgtgggggagtccgttagggtaaacgccgtgggggttcccttaggagttcctccgtggtcgtggccttcgtggacttctacgttttcgagttaaactggcgtggtactggtacgttcgggtcccgccgagggtcctaccggaacgggggaaaggggtccgtaggggtaggttagggggttttaggtaaccggttttaacgaaaaaaggttaaaaagttggtaagttagggtaacggaaaggtaaaaaagtacgggtaaccgttaacgggtacgtacccgtaaccccgggttaaggaaaacgggtaagtacgtttacccaaaccgtattaccgtaacgaaacggtacggtaaacttaaacgttaaacccgaaaaacggttcggttagttaagtttacgaactaaaagtcgaaacgacgtacccgtaaaggaaaaccgaggtacaaccgtacgtacccgtattacttaccgacgtaccagtagtacgttacgaagtcgaactagtacgaacggtaaaggcgtcgtagtcgttgttttagacttcggtcggacgggaccgaacgggagtaggttcccgg

SEQ ID NO: 113346 - DNA, 620 bp, Homo sapiens
  misc_feature: GYAE6OF01AP1ST.15.86.H09.1.454.CMB.1.raw
  modified_base (403)..(403): a, c, t, g, unknown or other
  misc_feature (403)..(403): n is a, c, g, or t
  modified_base (491)..(491): a, c, t, g, unknown or other
  misc_feature (491)..(491): n is a, c, g, or t
  modified_base (538)..(538): a, c, t, g, unknown or other
  misc_feature (538)..(538): n is a, c, g, or t
  modified_base (559)..(559): a, c, t, g, unknown or other
  misc_feature (559)..(559): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctctgtgtggcctctggattcactttcagtaatggctggatgagttggtccgcaggcctccgaggggaaggggctgggaggtgggttggtacgtttacaaaagttaaaatgagtggtagaagaaaatagactacggtgaccgaccgagaaagganattccaacatcgtacaaggtagaattaattaacgaaaacgtacggttagttaatttgaactaaatagaaacagaccctaagaaaccgngacaacgacgccgtactattacagttaccatagtacttacggaagtnactagtacgaaggtaaagggngacgttatcggtctttttagagttcgtacggtcggggacccctaaggggactaaggtcggg

SEQ ID NO: 113347 - DNA, 688 bp, Homo sapiens
  misc_feature: GYAE6OF01D8SD7.15.86.H09.1.454.CMB.1.raw
  modified_base (526)..(526): a, c, t, g, unknown or other
  misc_feature (526)..(526): n is a, c, g, or t
  modified_base (561)..(561): a, c, t, g, unknown or other
  misc_feature (561)..(561): n is a, c, g, or t
  modified_base (633)..(633): a, c, t, g, unknown or other
  misc_feature (633)..(633): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttcctgctgctatacgttaaaaggtgtcagtgtgaagtgcgaggtggtggagtcgtggggacgtccgttagggtaaacgccggttgggggtcccttagacgttctccgtgtcgtcggcctgtggtattctactttcgagtagtgcgtgagtggtaggttcggtccgcgaggccgtaccggaggggacgggcgtgggtagggttgggtcggtaacgtttaagaaaagttaaaagtgtagtagtaacggaaagaaagtacgaacgtacggtcgaccgaaccggtaggaaacgagtacttacacctatcaacgaagtaacgtaattaacgtaaccgaaaaggtcgttaagtagttagactaaagtcgaaacncgtaacgaaacgaacggacgactacgacttacgtnttaattccgataaccgagtacgttagtacgtaggctaacgacgtacgaaaggtaaggtgtccttagcgtttntttacggaacttttaggtccggggacgggtacccgtaacggtaagtcgggttacg

SEQ ID NO: 113348 - DNA, 771 bp, Homo sapiens
  misc_feature: GYAE6OF01EFLMW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcgttgggttttcctgctgctatacttaaaaggtgtccagtgtagaagtgcgaggtggtggagtcgtgggggagtccgttaggtaaacggccggtgggggtcccttagacgtctccgtgtgtggcctcgtggattctactttcaagtaagtggctaggatggtaggttcgggtcccgccgacggtcctaccggaggggaggggtcgtgggtagggtgggttaggtacgtttaacgaaaagtaaaatgagtaggtagaaagaaaagtagaacgtacggtacgaccgtaacccggtaaggaaaaggtaagtacgtacgaccctaatcgtaacgaaagtaagtaaacttaaacgttaaaccgaaaaaacggtacggtttagttaacttttaaggaactaaaacgtacgaaaccacggtaaccgtaaacggaaaaaccgtcggaaacaacgtacggtccgtaacttagttaacctacggtaaccctagtaacgtacgttaggtaacgtcgaacgtaacgtaacccggaaagggtaaaacggacggttacttacggttacgtttcgtttaaggactttaaccggttcggtacccggggaacccgtaacgggtaacgtaacgttaccgggg

SEQ ID NO: 113349 - DNA, 925 bp, Homo sapiens
  misc_feature: GYAE6OF01EQAIK.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagccgttagggtaacgccggtgggggtcccttagacgtcctcctggtgtcggcctgtggtacttcctactttcaagttaatggactggagtggtacggttcggggtcccgtaccgacggtccgtacccggaagggggtaacgggggtcgttaggggtacggggtttgggggtttacgggttaacccggttttaaacggtaaaaaaggttaaaaaagttgggtaaagtttaggggtaagaaaaggtaaaaagtacggtaacgttaacgggtacgaccgtaaacccggtaaggaaaagggtaacgtaacttacccgaacctaacgtaccgtaacgaaaacggtaagtaaacgttaaaacgtttaaaccgaaaaaaccgggttacgggtttaattaaggttttaacggaaacttaaaaacgtacggtaaaccgtaacggtaacccgttaaaagggaaaaaccccggtaagggaaacccaccgtaacgggttaccccttaacttaacgtttaaccgtaaccggttaaaccccaaacgtaaacgggtttacggttaaccgggaagttcggaaccttaagggtaacccgggtaaaacgggtaaaagggacgggttacctttaaggttaccggtttacgtttttaaggatttaaccggtcccgggggttacggggaaaccccgttaacgggggtaaacttcgggtttacccgggg

SEQ ID NO: 113350 - DNA, 642 bp, Homo sapiens
  misc_feature: GYAE6OF01COM5Q.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggcgggatgagttgggtccgccgaggctccgaggggaaggggcgtggaggtgggttggacgtttacgaaaaggtaaaatgaagtggtagaagaaaatagaactacggtgacacccgtagaaaggaagattcaccatctacaagagaataattacgaaaaacgtacggtataagtttgaacaaatgaacagacctagaaaaccgagaaccagacgccgttactaacttactacgtaacccagaagtacgttacgggaagttgccgtaagtaccggaaacgtaaagggaggtacttagtacggtacttttagagttaacgtcggtacggggacccaaggggaacctaaggttcgggttacccgg

SEQ ID NO: 113351 - DNA, 628 bp, Homo sapiens
  misc_feature: GYAE6OF01D6WSZ.15.86.H09.1.454.CMB.1.raw
  modified_base (464)..(464): a, c, t, g, unknown or other
  misc_feature (464)..(464): n is a, c, g, or t
tcagtctacgtagccacgaccggtgctcgatttagtgctatagacttgggtttgggggggagagggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtggggggtcccttagagtctcctgtgtggcctctggattcactttcagtaatggctggatgagttgggtccgccaggctccgaggggaaggggctgggagtggggttggacgtttacaaaaggtaaaatgatggtagaagaaaatagactaggtgcaccgtagaaaggaagacttcactatctacaaagagaataattacaaaaacgtcggtatatttagacaaatgaaacngacctaagaaaacccgaggtacacgagccgtactattaactgtaacccgataagtacttacgggaagttgactaagttaccgaaagggttaaaagggcggtacttaagttcgttcttttaggactagttcggtacgggggaccctaaggggctaaaggttcggg

SEQ ID NO: 113352 - DNA, 812 bp, Homo sapiens
  misc_feature: GYAE6OF01BAVVZ.15.86.H09.1.454.CMB.1.raw
tcagtctacgtagccacgaccggtgctcgatttagtgctatagacttgggtttgggggagaggagccccagccttgggatccccaagtgtttttcattcagtgatcaggactgaacacagaggactcaccatggagttcgggctgagcgtgggttttccttgctgctatcttaaaagtgtccagtgtgaagtgcaggtggtggagtcgtgggggagccgttggtaaagtccgtgggggtcccttagacgtctccgtgtgtcggcctcgtggattctactttcgagttaagtggctaggatggtacggttgggtcccgaccgacggccgtccggaggggaaggggcgtagggaggtgggttggacgtttaacgaaaaagtaaaatgtagtaggtagaagaaaatagacgtacggtcgtaccgaacccgtaggaaaggtaagtaacgttaccaaccgtactaccgtaagaaaggtaacgtaagttaaacgttaaccgaaaaaacggttacggttagtttaagtttacgaaacgtaaaacgtacggaaacctaaccggaccgtaaacggaaaaccggaacggaacctaaccggaggtttaacccgtaactttaaacgtttacccgttaaccggtaacctaaccggtaacgttaaaccggtttcgggtaaacgtcggtaaccgtaacggttaccgggtaaaacgggttaaagggaacgttacgttacggtttacgtttacgttttagggaaactttaccgggtcccgggttaacgggggtaccccggtaaaggggtcctttaaagggttacccggg

SEQ ID NO: 113353 - DNA, 755 bp, Homo sapiens
  misc_feature: GYAE6OF01C1X49.15.86.H09.1.454.CMB.1.raw
  modified_base (653)..(653): a, c, t, g, unknown or other
  misc_feature (653)..(653): n is a, c, g, or t
  modified_base (684)..(684): a, c, t, g, unknown or other
  misc_feature (684)..(684): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttcctgctgctatactaaaaggtgtcagtgtgaacgtgcgaggtggtggagtcgtgggggactcgttaggtaaagccggtgggggtcccttaggagtctcctggtgtggtcctgtggtattctactttacagtaagtcggcgtaggagttggtaggttcggggtacccgccgacgggtccgtacccgggaagggggaacggggtcgttacggggacggttggggttccggtaacggttttaacgtaaaaagttaaaagtagtaaggtacggtaggaaagtaaaagtaacgtacgtaacggtacgacggtaaccggttaaagaaaaggtaacgtaactcgaacctactacgtaacgaaggtaaagtaactaaagttaaacccggaaacgtacgggttagtaatttacgaactaaagacgtaagaacgtccgtaaacgaaaccggagtacacgtacgtcgttaactacttcgacgtaccgagtaagactttacgggaanccggtaatcggtaaccgaaacggtaaaggtnttccgtaagttacgttgtttacgagttaccggtaccggtcggaacccgggaggttaactaacggttccggg

SEQ ID NO: 113354 - DNA, 762 bp, Homo sapiens
  misc_feature: GYAE6OF01CZZ91.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttcctgctgctatacttaaaaggtgtccagtgtgaagtgcaggtggtggagtcgtgggggagtccgttagggtaaagccgtggggggtacccttaggacgtcctccgtgtgtgggcctcgtggacttctactttcagtaatggctggatggtaggttcgggtccgcgaggcgtccgaggggaaggggcgtagggtaggtgggttggtacgtttacgaaaaagtaaaaatggagtagggtaagaaacgtaaaagtaggtaacgtaacgggtagaccgtaacccggtaaggaaaaagggtaacgtaacgttaccaaccgtaactccgtaaacgaaagaagtaaacttaaacgtttaaaccgaaaaaacgggttacgggttacgttaagttttacggaactaaaaagttacgaaaacccgtaagaacccgttaaacggaaaaaccggacggaacctaaccggaacggtacccgtacctttaagttaccctaacgttaacccaacgtaagtaacgttacggaaagtgaccaaggttaaccggaacggtaaaggacgtactagttagtcgtttagaattacgtcggtacggacccggaggtaactaggttacgg

SEQ ID NO: 113355 - DNA, 612 bp, Homo sapiens
  misc_feature: GYAE6OF01EODY8.15.86.H09.1.454.CMB.1.raw
  modified_base (406)..(406): a, c, t, g, unknown or other
  misc_feature (406)..(406): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttggggtccgccgaggctccgaggggaaggggcgtggaggtggggttggtacgtttacaaaagtaaaatgatggtagagaaaatagacgtacggtgacacccgtagaaaggaanattcacatctacaagagataattacaaaacgtacggtagtaattgacaaatgaacagacctaagaaaccgagaacacgacgccgtataacttacagtacccaacgtaagtaagttcggaagtcgactagtaccgaacggtaaaagggaggcttagtacgttcttttagatagttcgtacggggaccccacgggtaacaagttcggg

SEQ ID NO: 113356 - DNA, 782 bp, Homo sapiens
  misc_feature: GYAE6OF01EW3VJ.15.86.H09.1.454.CMB.1.raw
  modified_base (435)..(435): a, c, t, g, unknown or other
  misc_feature (435)..(435): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctggagcttgggttttccttgctgctatcttaaaaggtgtccagtgtgaagtgcaggtggtggagtcgtgggggacgtccgttgggtaaacgccggtggggggtcccttaggagtcgtcctgtgtcggtcctcgtggtattcctacttttcaagttaatggctggatggtaggttcgggtccgcgacggtccgtaccggaggggaagggggtcgtggggagggttgggtttgggtaacggtttaacgaaaaaggttaaaagtgaagttaggtagaagaaatagacgtacggngacacccgtaaggaaggaagtactacactatcgtacaagaagtataactaaacgaaaacggttacggtagttaattcggaaactaaagtacgaaccaacggtacccgtaaacggaaaacccgaggaaccaaccgtacggtaccccgttataaacgttaccgtaacgtaccctaagtaacgtaacggtttacggaacgttaccggaacgtaacgtaaccgggtaaacggttaaaagggtacggttacgttaaggttaccggtttcttttaaagggtacctttaagggttccccccggggttacgggggaccccggtttaaaccggggaaataacgggtttacccgggg

SEQ ID NO: 113357 - DNA, 788 bp, Homo sapiens
  misc_feature: GYAE6OF01CMWTW.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttggtaaagccgtggggggtcccttagacgtctcctgtgtcggcctcgtggattctactttcagttaagtggctggatggtaggttcgggtcccgccgaggcctaccggagggggaagggggtcgtggggaggttggggttagggtaccggttttaacgaaaaaaggttaaaaatggtaagttagggtagtaaaaggaaaaagtaaggtaaccgtaacggtcgaccgtaaacccggtaaggaaaaaggaacgtaacgtttaccaacccgtaattaccgtaacgaaacgtaagaaattaaaacgttaaccgaaaaaacggtacgggtttagttaacgtttagaactaaaagttcgaaacgtacggtacccgtaaacgggaaaaacccggaggtaacccaacgtaccggtacccgttaactaagtttaccgtacgtaacccgagtaacggttacgttaacggaagtacgactaacgtacggaaacgtaaagggtacggtacttagttacgtccgtttttagacgttacgttccgggtaccggggaccccgaagggtacctaaggttcggg

SEQ ID NO: 113358 - DNA, 822 bp, Homo sapiens
  misc_feature: GYAE6OF01ACTAG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatcttaaaaggtgtccagtgtgaagtgcgaggtggtggaggtcggtagggggacgtccgttagggtaaacggtcccggtacggggggttcccttaggacgtcctccgttggtggtcggcctcgtggtacttctactttcgaagtaagtggtacgtggtagttaggtacggttccggggtccgaccgtacgggcccgtaccgggaagggggaacgggggtccggtaggggtacggtttggggtttacggtaacgttttaaacggaaaaaagttaaaagtggtagtagggtaagaaagtaaaacgtagaccgtacggtcgaaccgtaaccggtaaaggaaaggtaacgacttaccaacgtactaccgaagaaaggtataaacgttaaacttaaccggaaaaacgggttcggttagtttaaacgttagaaaccgtaaagtacgaaaccgtaaccgaacccgtaaaggaaaacccggacggtaaccaccggaccgtacggttaacttaacgttaacgtactaaccgtaacgtagttaacgttacggaatacgacaaggtaccggtaaaggaacgtacggtacttaggttgtaccgttttagaacggtttcgtacccgggttacggacccggtaaagggtacccgtaggttccccggg

SEQ ID NO: 113359 - DNA, 628 bp, Homo sapiens
  misc_feature: GYAE6OF01EJDMR.15.86.H09.1.454.CMB.1.raw
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttggtccgccaggctccgaggggaaggggcgtggaggtggggttggacgtttacaaaagtaaaatgaatggtagaagaaaatagatacggtncgacccgtagaaaggagatcaacatctacaaganaataatacaaaaacggtacggtagtatttagacaaagtacgaaacacgtacctagaaaacccgagaacacaacgccgtactaagttactacgtaaccacgtaagtacttacggaagtcgacagtaccgaacgtaaagggcggtacgttatggtcttttagaagttacgtccggtacggggaccccaaggggtaactaaggttacggg

SEQ ID NO: 113360 - DNA, 803 bp, Homo sapiens
  misc_feature: GYAE6OF01AU3R5.15.86.H09.1.454.CMB.1.raw
tcagtctacgtagccacgaccggtgctcgatttagtgctatagacttgggtttgggggggaggagggaggccccgagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaagccggtgggggtccctaggtacgtcgtccgtgtcggtggccgttacgtggtattccgtaccgttttacgtaggttaaacgtgggtaccgttaggagttaggtacgggttcggggtcccggaccgtaacgggccgttacccggaaggggggtaacgggtcggttaggggacgggttggggttggggtaacgttttaacggaaaaaggtttaaaaagtcggtaaggttagggtaggaaagttaaaagtacggtaacgtaacgggtcgacgtaaccggtaaggaaacggaacggttactacgaaccgtactacgttaacgaaggtaagtaacttaacgtaacgtaaaacggtacgttaagttagttaacgaactaaagacgtaacgaagtaccgtaaggaaaaccggtagacctacggacgtaccgtattaacgtctacgtaccgtaagtacggtaagttacggtaacggctaacgtacgtacggtaaacgtaaagggtcgtaccgttagtcggtttaaccgttagtgttaaccgtcggtaccgggtacccgaagggtaacctagggttaccgg

SEQ ID NO: 113361 - DNA, 653 bp, Homo sapiens
  misc_feature: GYAE6OF01BGZ6X.15.86.H09.1.454.CMB.1.raw
  modified_base (385)..(385): a, c, t, g, unknown or other
  misc_feature (385)..(385): n is a, c, g, or t
  modified_base (419)..(419): a, c, t, g, unknown or other
  misc_feature (419)..(419): n is a, c, g, or t
  modified_base (592)..(592): a, c, t, g, unknown or other
  misc_feature (592)..(592): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaagccgtggggggtcccttagagtctcctgtgtggcctctggattcactttcagtaatggctggatgagttgggtccgcaggctccgaggggaaggggctgggaggtgggttggacgtttacaaaagtaaaatgataggtagaagaaaatagactaggngcaccgtagaaaggaagatacaccatcacaaganaataattacaaaacgtacggtagttatttagactaaatcgaaacacgaccgtaagaaaacccgaggaaccacgacgtacccgtacttaattaacctacgtaacccaacgaacgtaagttaccggaagttcgaccgtaagttaccgggaaacgtaaagggtacggtacttaagnggtttaccgttttagagttacgttccggtacggggacccaggggtaaccttagggttcggg

SEQ ID NO: 113362 - DNA, 716 bp, Homo sapiens
  misc_feature: GYAE6OF01ALAS4.15.86.H09.1.454.CMB.1.raw
  modified_base (247)..(247): a, c, t, g, unknown or other
  misc_feature (247)..(247): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagngtctctgtgtggcctcgtggattcactttcagtaatggctggatgagttggccgcaggctccgaggggagggctggagtggtggacgttacaaaagtaaatgatggtagaagtaaaatcgaactacggtgaccgtacccgtaggaaaaggagtataccactatctacgaagtagtaataacttaacgaaaaacggtcggttaagttaagtttagaactaaatcgaaacacgtacccgtaaaggaaaacccggtacggaacaaccgaacggtcccgttaactacgtttaaccgtagtaaccccaacgtaagttaccgttacgggaaacgttcgaaccgacgtaaccgggtaaaacggtaaaacgggcggttaaccgttagttagggttaccctttttaaggaacgtttaacggttaccgggtcggggggtaaacccccgaagggggtaaaccctagggggtttacccggg

SEQ ID NO: 113363 - DNA, 974 bp, Homo sapiens
  misc_feature: GYAE6OF01AE7QS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatcttaaaaggtgtccagtgtagaagtgcagggtggtggagtcgtgggggagtccgttagggtaaacggtccggttcggggggtacccttaggacggttcctccgttggttgggtcggtccccgttaccgttgggtactttcgtacctttttaccgaaggtttaagtcgggtacgttgggagttgggttacgggttcgggtcccggaccgtacgggttccctacccgggaaggggggtaacgggggtccggttaggggacggggtttagggggtttaggggttaaccggtttaaaccgtaaaaaagggtttaaaaaggtggttaaggttagggtaaggtaaaggtaaaaagtaccgggtaaccgttacgggtacggtacccgtaaacccgggtaagggaaaaggtaacgtaacgttaccgtaaccgtagttacgtaacgaaaggtaagtaaatttaacgtaacggtaaaaaacggtcggtttaagtttaaccgttacgtaaacgtaaaacggttcgaaaacccttcgggtaacccgtaaaccggggaaaaaccgtaccggaaaccggtactaacccgggttacccttaatttaaccggttaacgttaaccgtaaaccccgtaacgtaagggttaacggtaaacggtttaacgtaacgggtaaccttacgggttaacgaaaaacccgggggttaaaggtaccggttacccgttaaagtttcggttagttttaaccggaaagttacccggttcgggttaacccggggacccctaaaaggggtaccggtttaaaccgttcccggggggg

SEQ ID NO: 113364 - DNA, 791 bp, Homo sapiens
  misc_feature: GYAE6OF01EEXJK.15.86.H09.1.454.CMB.1.raw
  modified_base (502)..(502): a, c, t, g, unknown or other
  misc_feature (502)..(502): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccagtggagttcgggctgagtcgttgggttttccttgcttgctatacgttaaaggtgtccagtgtgaagtgcgaggtggtggagtcgtgggggagtccgttagggtaacgaaccggttcgggggttacccttaggtacgtccttccgtggtcggtcggtcctcgtggtacttctactttcgagtatggtcgttggattggtaggttcggcccgtacgacggtccgtacggaggggtagggcgtgggtaggttgggttaggtaacgtttaacgaaaagttaaagtagagttaggtaagtaaagtaaaagtaggtaccgtacggtacgaacccgtaacggtaaggaaaggtaagtactacaaccgtataccgtanaagtagtaacttaacgtaaacgaaaacgtacggttagttaagttacgaataaacgtacaaacgtaccgaaccgtaaacggaaaaccggtacgaaaccgtaccgtaacgttaccgttacctttaacgttaccgttaacgtaacccgaagtaacgttacggttaacggaagttcgaaccgtaacggttaccggtaaaggtaacggtagttacgttaagttcgttacgttttagaaccgtttacggtcccggaacgggtacccggtaaacgggtaccgttaagggttcccgg

SEQ ID NO: 113365 - DNA, 1173 bp, Homo sapiens
  misc_feature: GYAE6OF01BC2ZK.15.86.H09.1.454.CMB.1.raw
tcagtctacgtagccacgaccggtgctcgatttagtgctatagacttgggtttgggggggagaggagccccagccttgggatccccaagtgttttcattcacgtgatcaggactgaacacagaggactcaccatggagttcgggctgagctgggttttccttgctgctatcttaaaaggtgtccagtgtgaagtgcaggtggtggagtcgtgggggacgtccgttgggtaaacggccgtcgggggggtaccccttaggacggttccgtcccgtggtggtcgggcccttcgttgggtactttcctaccgttttaccaaggttaaagtgggtccgttggggaacttgggtaacggtttcgggggtcccggtcccgaacggggtccttacccggaaggggggtaaacggggggtccgttagggggtaacgggtttcggggggtttacggggtaaccgggtttttaaccgaaaaaaagggttaaaaaaacgttcgggtaaaggtttacggggttaaacggtaaaagggttaaaaaaacgttaacgggtaaacccggtttaaaccgggggttacgggtaaccccggtaaacccccgggggttaaagggaaaaaacggggtaaaaccggttaaccgttttaacccgaaacccctaaccgtttacccgttaaaccgaaaaagggtaaaccggttaaacgtttaaaaccgttttaaaccccggaaaaaaaacccgggttaccggggttttaagggtttaaacgttttttaaccggggaaaacccgtttaaaaaacggtttaacgggaaaaacccttaaaccggggttaacccccgtttaaaacggggtaaaaaacccccggggtaacgggaaacccgaaacccggtaaaccgggtttacccccggtttaaccgtttaaaacgttttaacccgtttaaccgggttaaaccccccgtaaacggttaaaccgggttaaccgggttttaaaccgggggtaaaacgggtttaccgggaacccgttaacgggttaaacccgggtaaaacccgggtaaaaacggggtaacgggtacccggttttaagttcgggtttaccgttttttacgggaaacctttacgggttacccgggttacccggggggtaacccccgtaaaggggtacccgttaaacggggtttcccgggg

SEQ ID NO: 113366 - DNA, 689 bp, Homo sapiens
  misc_feature: GYAE6OF01BN6WV.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgccaccctaagtagtgagcactccgaacctacaccatacgaatggtatacaacagacgaccgaggaaccgtccccagtaatataatagaaagttaagagtgagtgacgacgaccaacgaacggaacgggggaccggacgtaccccgactcgtactacgacggtcggctcgtacgttcggtcgggtctcggaccgtctacctccgaacctactacccgtaccctaaccctccgacgtctacgacgtacgttacggaacggtcgtagaacgttactaccgtacgtgggtaggaacggacggtacgacccgaactaacgtaacgttacggaacggttacgggaaccgtaaacggggttacggggttcggggttacgggttacggggacccggggtaacgggaaacccgaacgggtacccggtaccgggtaaaccccggttccggttaaacgggtccggtaaccccgggg

SEQ ID NO: 113367 - DNA, 733 bp, Homo sapiens
  misc_feature: GYAE6OF01DIM90.15.86.H09.1.454.CMB.1.raw
  modified_base (605)..(605): a, c, t, g, unknown or other
  misc_feature (605)..(605): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtgtccagtgtgaagtgcgaggtggtggagtcgtgggggagtccgttaggtaaacggtccggttcgggggtacccttaaggtacgttccgttccgttggtgtcggtcccttcgtggtacttcctacctttcgaagttagtcggtacgtggagtaggtaggttcggggtcccgccgtaggccgtaccggaagggggtaacggggtacggtagggggtacgggttggggttacggtaacggtttaaacgaaaaaggttaaaagtgtaagtggtagaaagtaaagtagacgtacggtacgaccgtaccggtaaggaaggtaactactaccgacctactactaacgaagtaagtaagtaacttaacggaaaacggtggtttattaagttacgaacgtaaagtgaaccgacgtaaccgtaagggaaaacccgnggaacctacggaccggtccttaagttactaccgtacgtaacagtagtgttacggatcgaatacggacgaagacggagttctagttggttacttagataccgtcggtacccggacgtaggactggttcg

SEQ ID NO: 113368 - DNA, 652 bp, Homo sapiens
  misc_feature: GYAE6OF01A34N2.15.86.H09.1.454.CMB.1.raw
  modified_base (385)..(385): a, c, t, g, unknown or other
  misc_feature (385)..(385): n is a, c, g, or t
  modified_base (485)..(485): a, c, t, g, unknown or other
  misc_feature (485)..(485): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtcccgccgaggctccgaggggaaggggcgtggagtgggttggacgttttacaaaagtaaaatgagtggtgaagaaaatagactacggngcaccgtagaaggagattcaaccatcctacgaagagaataaattacaaaaacggtcggtagtatttagactaaagtgaaactacgactaacgaaaaccgnggaacacgacgaccgtctaacttaccgtacgtaaccacgtaagacgtttacgggaagttcgactacgtaccgtaaacggtaaagggacgtacgttaatcggttacgtttttacggaatttacgtcggttaccgggggaccctacggggtaaacgtaagttaccgggg

SEQ ID NO: 113369 - DNA, 812 bp, Homo sapiens
  misc_feature: GYAE6OF01BVJ06.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtcagtgtgaagtgcgaggtggtggagtcgtgggggagtccgttagggtaaacggccggtcggggggtcccttaaggacgttcctcctgtgtcggcctcgtggattcactttcagtaagtggctggatggtaggttcggtccgccgaggcctaccggaggggaacgggtcgtgggtaggtcgggttaggtaacgtttaacgaaaaaggtaaaatggaagttaggtagaaacgtaaaagtacgaacgttacggtacgaccgaacccggtaagaaaaggtaacgtaacttaccaactaagtactaacgaaagaagtaaattaaacgttaaaccgaaaaacggttacggttagtttaactttagaacctaaaagtacggaaaacctacggtaacccgtaaacggaaaaacccggtgaacccaacgaacgggttacccttaacgttaacgttaaccgtaaccggttaaaccaacgttaagtaacggtttaccggaagttcgaaccaacggtaaccggaaacgggtaaaaacgggcgtaacgttaacgttggtttaacccgttttaagggaaaccttacggttacccggggtaacccggggaccccggtaaacgggtaaagttccggtttaccgggg

SEQ ID NO: 113370 - DNA, 687 bp, Homo sapiens
  misc_feature: GYAE6OF01CEM60.15.86.H09.1.454.CMB.1.raw
  modified_base (516)..(516): a, c, t, g, unknown or other
  misc_feature (516)..(516): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtggggagtccgttggtaagccgtgggggtcctagagtctctgtgtgcctctggattcactttcagtaagtggctggatggtaggttggtcccgccgacggtcgtccggaggggaagggcgtagggtacggttggggttaggtacgtttaacgaaaaagtaaaagtgtaagtaggtagaaagtaaaatagtaacgtacggtcgacgaacccggtagaaaaggaacgtaacgttaccaccgtaactactaacgaagaagtaattaacgtaaacgaaaacggtacggttattaagtttacgaactaaancggtaaaccagtacccgtaaagaaacccggtagaaccacgacgttacccgtaataactttacgacgtaccagtagagttacggagcgcaacgtacgaaaggtaaggagtcttaagtcgttactttagaacttgtcccggttacgggaccccaaggggtaaacttggtccgg

SEQ ID NO: 113371 - DNA, 835 bp, Homo sapiens
  misc_feature: GYAE6OF01A92W3.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtggggggttcccttaggacgtctccgtggtgtcggcctcgtggtattctactttcagtaatggctggatgagttggtccgcaggctccgaggggaggggcgtgggaggtgggttggtacgtttaacgaaaaagtaaaagtgaagttgggtagaaagaaaataggtaacgtacggtcgacgtaacccggtaaggaaaaggaacgtaacttaccaaccgtaattacctaacgaaagtaacgtaacttaaaacgttaaccgaaaaaacggtaccgggttaagtttaacttttaacggaactaaaaacgttacgaaaaccgtaacggtaaccccgttaaacgggaaaaaaccccggtacgggaaaccctaaccgaaccgggttacccgttaaccgttttaaacgtttacccgttaaccggttaaccccgtaaacgtaaacggttaacgtttaacccggggtaaagtaccgaacgtaacgttaaccgggtaaaacggttaaaaggggtacgtaccgtttaaagttcggtttaagttttacgaacgttacgttccggggtaacccggggtaccccggtaaacggggtaaccgtaagggtttacccgggg

SEQ ID NO: 113372 - DNA, 645 bp, Homo sapiens
  misc_feature: GYAE6OF01CHVTH.15.86.H09.1.454.CMB.1.raw
  modified_base (598)..(598): a, c, t, g, unknown or other
  misc_feature (598)..(598): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcggctgagctgggttttcctgctgctatcttaaaaggtgtccagtgtgaagtgcgaggtggtggagtcgtggggagccttggtaaagccgtggggggtcccttaggagtccgtcctgtgtggcctctggattcactttcagtaagtggctggatggagttgggtccgcgaggctccgaggggaaggggcgtgggtaggtgggttggtaacgtttacgaaaagtaaaatggaagtaggtagaagtaaaatagaacgtacggtagacacccgtaggaaaaggagattacgacctagtactacgaaagagtaattaaatacgaaaaaacggtacggttagttagttagaacgaaatacgaaacagaccgtaagaaaccgaggaaccacgacgaccgtactattactacgtacacagtacgttacggaagtacgacgtacgtacggaagtaaagggngtacgtagttacgtgttttagatttacgtcgggttacgggtacccgg

SEQ ID NO: 113373 - DNA, 709 bp, Homo sapiens
  misc_feature: GYAE6OF01EJL8V.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtggtggagtcgtgggggagccgttaggtaaacgccgtgggggtcccttagagtcctcctgtggtcggcctcgtggtattctactttcaagtaatggctggatggtaggttcgggtcccgccgaggcctccggaggggaaggggcgtgggaggtggggttaggtacgtttaacgaaaaagtaaaagtgaagtggtagaaagaaaatagacgtacggtgaccgaccgtagaaaggaagactacaaccatactacaaagagtaataaactaacgaaaaacggtacggttagttaagtttagaactaaagtacgaaacaacgacccgtaaaggaaaacccggaaggaaccacgaacgtacccgtacttaacttacctacgtaaccaacgtagtaacgttacgggaagtcgactaagtaccggaaacggttaaaagggtacgtacttaagttcgttcgttttagtaattacggttccggtaccggggacccgtaaggggaacctagggttccggg

SEQ ID NO: 113374 - DNA, 832 bp, Homo sapiens
  misc_feature: GYAE6OF01C4Z95.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacgttaaaaggtgtccagtgtagaagtgcagggtgggtggagtcgtgggggacgtccgttagggtaaacggccggtgggggttcccttaggacgtctctggtgtcggcctcgtggattctacttcgaagttaagtggtctaggagttggtacgggttcggggtcccggaccggacgggtccgtacccgggaaggggggtaacgggggtccggttaggggtacgggttggggtttacgggttaacggttttaaacggtaaaaaaggttaaaaagtaggtaaggtagggtaaggaaagtaaaaacgtaaggtaacgtaacggtcgaaccgaacccggtaaggaaaacggaaagtacttaccgaacctaactacctaacgaacgaaagtaaacttaaacgttaaaccgaaaaacgggtacgttaagttaacgtttaacggaaactaaaagttaacgaaaccgaacgtaacccgaaaggtaaaaccgaacggaaccaaccgaccgtacccgttaccttaacgttacctaacggtacccctaagtaacgttaggttaaccggtagtacgtaacgaacgttacggaaaccggtaaagggtacgtaccgttagtgttccgtttagtaacgtacgttacccggacgggaacccgtagggaagtcgttcggg

SEQ ID NO: 113375 - DNA, 1098 bp, Homo sapiens
  misc_feature: GYAE6OF01AZ54G.15.86.H09.1.454.CMB.1.raw
  modified_base (895)..(895): a, c, t, g, unknown or other
  misc_feature (895)..(895): n is a, c, g, or t
tcagtctacgtagccacgaccggtgctcgatttagtgctatagacttgggtttgggggggagaggagccccagccttgggatccccaagtgtttcattcagtgatcaggactgaacacagaggactcaccatggagttcgggctgagctgggttttccttgctgctatcttaaaaggtgtccagtgtgaagtgcgaggtggtggagtcgtgggggacgtccgttaggtaaacgtccggtcggggggttaccccttaaggacggttccgttacccgttggttcggttcgggtccccttccgttcgggtacttttaccgtaaccgtttttaccgaacggtttaaacgttccggggtaccgttacggggtaacgtttaccggggtaaccggggtttttaccgggggtcccccggtaccccggtaaccggggtaccccgttacccccgggaaagggggggtaaaaccggggggtccgttacgggggttaacgggtttcggggggttttaccggggttaaccggtttttaaacccggaaaaaaaagggtttaaaaaaaccgttgggtaaaacggtttacggggttaaacggtaaaagggtaaaaaaacggtttaacgggtaaaccccggtttaaacccggggttaccggtaaccccgggttaaacccccggggttaaagggaaaaaaaccggggtaaacggttaaaccgtttaacccgaaaccccgttaaacgtttacccgttaaaccgaaaaagggtaaacgtaaacgtttaaaaccggtttaaacccgtaaaaaaaaccgggtacccggggttttaagtttaaacgttttacgggaaaccttaaaaacggttcggaaaaaccgtaacggtacccgttaaaacggggaaaaaaccccgnggtaaacccgtaaccgaacggtaccccgtttaacgttaactttaccgtaacgttaacccgaacgtaaggttaccgtttaaccgggaagttaccgaccgtaagtacccggtaaaggtaaacgggtcgtaccgttaattccgggttattttagaacgtttcgttacccgggacggggtacccctaagggtaacgtacggttccgg

SEQ ID NO: 113376 - DNA, 742 bp, Homo sapiens
  misc_feature: GYAE6OF01BKGNF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatgggagttcgggctgagctgggttttccttgctgctatcttaaaaggtgtccagtgtgaagtgcaggtggtggagtcgtgggggagccttgggtaaagccgtggggggtcccttagagtctcctgtgtggcctcgtggattcactttcagtaatggctggatgaggttcgggtccgcgaggcctccgaggggaaggggctggaggtgggttggtacgttacaaaaggtaaaatgagtggtagagtaaaatagacgtacggtgaccgaacccggtagaaaagggaagacttacgaaccccatcctacgaaagaagaataaacgttacgaaaaaccggacggtttagtaactttagacaaaagtcgtaaacacggaccctaaaggaaaaaccgggtaggaacctaacgacgtacggttacccttaagtttaaccgtacgtaacccataacgaacgtttacgggaacttacggaccgtaagtaccgggtaaaacgttaaaacggggacggtaccttaagttacggtttaccggttttttacgaaatttacgggtaaccgttcgggggggaaaccccccaggggggtaaaaccccgttaggttaacccgggggg

SEQ ID NO: 113377 - DNA, 578 bp, Homo sapiens
  misc_feature: GYAE6OF01CD0EX.15.86.H09.1.454.CMB.1.raw
  modified_base (394)..(394): a, c, t, g, unknown or other
  misc_feature (394)..(394): n is a, c, g, or t
  modified_base (543)..(543): a, c, t, g, unknown or other
  misc_feature (543)..(543): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaggggctggagtgggtggacgtttcaaaagtaaaatgatggtagaagaaaatagactacggtgcacccgtgaaagganattcacatctacaagagataattacaaaacgacggtagtatttagataaatgaaacagacctaaggaaaaccgagaacacacgccgtactacttactataccagtagtacttcggaagtgacatacgacggtaaaggagtctagtcgtntttagattagtcgtagggaccagggacctagtcgg

SEQ ID NO: 113378 - DNA, 751 bp, Homo sapiens
  misc_feature: GYAE6OF01CCJDZ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccttggtaaagccgtgggggtcccttagagtctcctgtgtggcctctggattcactttcagttaatggctgggatggtaggttcgggtccgccgaggcctaccgaggggaacggggtcgtggggtaggttggggttggtaacggttttaacgaaaaaggttaaaaagtggaagttgggtaagaaagtaaaaagtaggaaccgtacggtagaccgtaacccggtaggaaaaggaagtacttaccaacctatacctacgaaaggtaagtaatttaaacgttaaaccgaaaaaacgggtaccgggtttaagtttaagttttacgaaccttaaaaagtacggaaaacctaacggaacccgttaaacggaaaaacccggacggaaccgaacgacgtacccgttaccttaagttaaccctacgtaaccccaagtagtaacgttacggaagtgacagtaccggaaacggtaaaggaggtctagttcgttcgtttagacgttacgtacggtacggggacccgtaagggacctaggttacggg

SEQ ID NO: 113379 - DNA, 967 bp, Homo sapiens
  misc_feature: GYAE6OF01CW5XM.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctgggttttccttgctgctatacttaaaaggtgtccagtgtgaagtgcgtaggtggtggagtcgtgggggagtccgttagggtaaacgccggtgggggttccccttaggacgttctccgtgtgtcggcctcgtggattctacttcagtagtggtcgtggtatggtaggttcgggtcccgccgacggccgtaccggaaggggaacgggggtcctaggggtggttaggggttacggtaacggttttaaacgaaaaaaggttaaaaagtggtaagttagggtaaggaaaaggtaaaaagtacggtaaccgttaacggtacggaacccgtaaacccggtaaggaaaaacgggtaagtaacgttaacccgtaaccctattaaccgtaaccgaaaaggtaagtaaaacgttaaacgttaaaaccgtaaaaaaccgggtacggtttaagtttaagtttaacggaaattaaaacggtaacgtaaaacccgtaccggtaacccggtaaaaccgggaaaaaccccggtaacgggtaaacccaaaccggtaaaccgggttaccccgtttaactttaaaccggtttaaacccgttaacccggtaaacccgttaacggtaaacggttaaaccggtttaaccgggtaaaggttcggaaaccgtaaacgggttaaccccgggtaaaaacggggttaaagggtaacccgggttaaacgttaggtttaccggttttacgtttttaaacgggtaaagtttaccgggttaaccccggggttaaccgggggtaacccccggttaaacgggggtaaaccgttaaccggggtttaacccgggg

SEQ ID NO: 113380 - DNA, 972 bp, Homo sapiens
  misc_feature: GYAE6OF01EG12K.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatacgttaaaaggtgtccagtgtgaagtgcaggtggtggagtcgtggggacgtccgttaggtaaacgccggtgggggttcccttagacgttcctccgttgtggtcggtcctcgtggtatttcactttcagtaagtggcgttggatggtaggtttcggggtcccgtccgacggtcctacccggaagggggaacggggcgttggggtaggttggggttaggtaaccgttttaaacgaaaaaaggttaaaaagttggaaggttagggtaagtaaaggtaaaaaagtaggtaaccgttaaccgggtacgaacccgtaacccggtaaaggaaaacgggtaaacgtaacgtttaacccgaaccgtaacttaccgtaacgtaaaacggtaaagtaaacgtttaaaacgttaaacccgaaaaaaaccgggttaccgggtttaagtttaacgttttaacgaaaaccgttaaaaagttacggaaaaaccgtacccggttaaaccccgttaaaaggaaaaaacccccgggtaacggaaccctaaaccggtaccggttaacccccggttttaacttaaacgtttaaacccggttaaccgttaaaccccaaacggttaacgggttaaacggttttaaccgggaaacggtttacggaccgttaaaacggttaacccggggtaaaacggttaaaacgggacgggttaaccgttttaaggtttaccggtttaaccgttttttaggaaacgtttacgggtttcccggggtaaccccggggaaacccggttaaacggggaaagttacgggttttacccggg

SEQ ID NO: 113381 - DNA, 677 bp, Homo sapiens
  misc_feature: GYAE6OF01BNCXG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccgaggctccgaggggaaggggctggagtgggttgacgtttacaaaagtaaaatgatggtagagaaaatagactacggtgaccgaacccgtaggaaaacggaagtacttacgaaccctaatcctacaaaggtagaattaaacttaacgaaaaacggtcggttagttagtttagacctaaaagttacgaaacgaacacccgtaacggaaaaccgaggaaccacgacgtaccgtacttaactttaactacggtaacccaatagtacttacgggaatcgactacgtaccgaacggtaaaggacggtactaagtcgttcgttttagaacgtttgtaccgggtacgggggaccccaagggggtaactaacggttcgggg

SEQ ID NO: 113382 - DNA, 855 bp, Homo sapiens
  misc_feature: GYAE6OF01DI98I.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagccgttagggtaaacggtccggttgggggggtccccttaggacgttccgtccgttggtcgtcggccttcgtggtattctactttcgaagttaagtggctggtatggtaggttcgggtcccgccgacggcctaccggaagggggaacgggggtcgtaggggtagggttcggggttaggtaacgtttaacgaaaaaaggttaaaagtggtaagtagggtagaaaagtaaaagtagtaacgtacggtacgacctaacccggtaaggaaaacggtaacgtacttaccaaccgtataccgtaacgaaagtacgtaacttaaacgttaaaccggaaaaaaccggtcggttaagtttaagtttaacggaaactaaaacgttaacggaaaacctaccgggtaacccttaaacgggaaaaaacccggtaggaaaccctaaccggtaacggttaccccggtttaacttaacgtttaacccgtaccgttaaacccgaacgtaacggtaacggtttacgggaaacgttcgactaaaccggtaacgggaaacggtaaagggacggtaacttaagtttcggttaccgttttaaggacttacggtaccgggttaccggggaccccgttaaaggggaccttaagggttcccggg

SEQ ID NO: 113383 - DNA, 675 bp, Homo sapiens
  misc_feature: GYAE6OF01ATJYD.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaagtgtccagtgtgaagtgcaggtggtggagtcgtgggggagccgttggtaaagccgtgggggtcccttagagtctcctgtgtggcctctggattctactttcagtaatggctggatggagttgggtccgcgaggctccgaggggaggggctgggaggtgggttggacgtttacgaaaagtaaaagtgataggtagaagtaaaatagaacgtacggtgacacccggtagaaaggaagattacacctatctacaaagagtaattaattaacgaaaaacggtcggttagtaactttagaactaaaatcgaaactagacccgttaaggaaaacccggagaacgaaccgacgtacccgtacttaacgttaactacgtacccaactaaggtacgttaacgggaagttgaaccgtagtaccggtaaacggtaaaagggaggtacttagttcggtacttttgaattacggttcgacgggggtaaccccaaggggtaactaacgggttcggg

SEQ ID NO: 113384 - DNA, 814 bp, Homo sapiens
  misc_feature: GYAE6OF01BBU93.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgagggtggtggaggtcggtgggggagtccgttaggtaaacggccggtggggggtcccttaggagtcctccgtgtgtcggcctcgtggtacttctactttacagtaagtggtcgtggagttggtacggttcggggtcccgccgacggccgtccggaagggggaacggggtcgtgggaggttcggggttaggtacgtttaagaaaaagtaaaagtgaagtaggtagaaagtaaaagtacggtacgtaacggtacgaccgtaacccggtaaggaaaaggtaacgtaacttaccgaacctacgtacctaacgaaagtaagtaaattaaacgttaacgaaaaaaccggtcggttaagttaactttaggaaacttaaaggtaacgaaacgtaacggaacccgttaaacggaaaaacccggacgtaacgaaccgtaacgtaccgttaactaacttaccgtacgtaacccacgtaagtaacgttacggaacgtcgaacgtagtaaacccggtaaagggtaaacggaggtacttaggttacgttaaccggttttacgaagtttaccggttccggggtaacggggtaccccgggtaacggggttaaaccgtaaagggtttcccgggg

SEQ ID NO: 113385 - DNA, 574 bp, Homo sapiens
  misc_feature: GYAE6OF01BGT0F.15.86.H09.1.454.CMB.1.raw
  modified_base (215)..(215): a, c, t, g, unknown or other
  misc_feature (215)..(215): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
  modified_base (475)..(475): a, c, t, g, unknown or other
  misc_feature (475)..(475): n is a, c, g, or t
  modified_base (533)..(533): a, c, t, g, unknown or other
  misc_feature (533)..(533): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtcgtggggganccgttggtaaagccgtgggggtcccttagagtctccgtgtgtggcctctggattcactttcgagtaatggctggatggagttggtccgcgaggctccgagggagggctgggagtgggtggacgtttacaaaagtaaatgatggtagaagaaatagacgtacggtgcgacccgtagaaaggagtactacacatctacaagagtaataatacaaaacgtgtagtatttgactaaangaacngacctagaaaccgagacacgngccgtactatctagtaccacgtatagttacgagtcgaccagtccgagaagcgctagtntctttagacttgtacgtcgggacccaggacctaggttccgg

SEQ ID NO: 113386 - DNA, 650 bp, Homo sapiens
  misc_feature: GYAE6OF01BSFHU.15.86.H09.1.454.CMB.1.raw
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagctgggttttccttgctgctatcttaaaggtgtcagtgtgaagtgcaggtggtggagtctgggggagccttggtaaagccgtgggggtccttagagtctcctgtgtggcctctggattcactttcagtaatggctggatgagttgggtcccgccaggctccgaggggaacgggggctgggagtggggttggacgttttacaaaaggtaaaatgagtggtagaagaaaatagacgtacggtgcacccggtgaaaggaagattacacctatttacaagagaataattacaaaaacgtacggtagttaattgacaaatagaacacgacctagaaaaccgtaggaccacgacgccgttactacttacgtacgtaacccaacagtacgttacgggtaacgtgacctaagtaccgaaacggttaaagggaggtactacgtttagtcgttttagaagttgtccggtacgggggacccctaagggggaacctaaaggtcgggttacccgg

SEQ ID NO: 113387 - DNA, 916 bp, Homo sapiens
  misc_feature: GYAE6OF01C0PUX.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgagtgcgaggtggtggagtcggtgggggagtccgttagggtaaacggccggttggggggtacccttaggtacgtcctccgttggtggtcggtccttcgtaggtactttcctaccttttacaaggttaagtgggtacgttagggtagttggtaacgggtttcggggtacccggcccgtaacgggtcccgtaccccggggaaggggggtaacggggggtccggttagggggtaagggtttcggggggtttacggttaaccgggtttttaaaacggtaaaaaaaggtttaaaaaagtgggtaaaggttaggggttaacggaaaaggtaaaaaacggtacggtaaaccggttaaccgggtacggtaaaccccggttaaaccccgggtaaaggaaaaacgggtaaacggttaaccttacccggtaaaccctaacttaccgtaaacgaaacggtaaacgtaaacttaaacgttaaaccgaaaaccggttacggttagttaacgtttacgaaacgtaaagtacgaaacgtacgaaccgtaaacggaaaccggacgaaccgacgtaccggtaccgttaaccttaacgttaaccgtacgtaaacccaggtaacggttaaccgttaacggaacgttgaccgtaaggttaaccggaaacgggtaaaggtcggtacttagtcggttacgttttgaagttacgtccggacgggtacggaaacgtacgtaaggttccggg

SEQ ID NO: 113388 - DNA, 712 bp, Homo sapiens
  misc_feature: GYAE6OF01CVIB3.15.86.H09.1.454.CMB.1.raw
tcagtctacgtagccacgaccggtgctcgatttagtgctatagacttgggtttggggggagaggagtcccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttggtccgccaggctccgagggaggggctgggagtgggtggacgtttacaaaagtaaaatgatggtagaagaaaatagactacggtgacaacccggtagaaaggaagtatacaaccatacctacgaaagagaactaaactaacccgaaaaacggtacggttagttaatttacgaactaaaatacgaaacacgtacccgtaaaggaaaaacccggaggaaccaaccgaacggtaccccgttaattaaacgtttaaccgtacgtaaacccaacgtaaggtaacgtttacgggaaagttgaaccgtaagttaccggaaacgggttaaaagggacggtaccttaagttcggtttaccgtttttaggaacttacggttccgggttaccgggggacccgaaaggggtaacctaaagggttccgggg

SEQ ID NO: 113389 - DNA, 681 bp, Homo sapiens
  misc_feature: GYAE6OF01D6CFC.15.86.H09.1.454.CMB.1.raw
  modified_base (246)..(246): a, c, t, g, unknown or other
  misc_feature (246)..(246): n is a, c, g, or t
  modified_base (289)..(289): a, c, t, g, unknown or other
  misc_feature (289)..(289): n is a, c, g, or t
  modified_base (468)..(468): a, c, t, g, unknown or other
  misc_feature (468)..(468): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttctgacgtgctatacgttaaagtgtccagtgtgagtgcgaggtggtggagtcgtggggatccgttaggaacgtccgtcgggggtccctagngtctccgtgtgtcggtcctcgtgtacttctacttcgagtaagnggtctggtagtggtacggttcggccgccgaggtccgaccgggaggggaacggggtcgtggggtagggttggggttacggtaacgtttaacgaaaaagttaaaagtgtaagtaggaacgtaaagaagtacgacgtaggtcgacgtacgtaaggaagtagtactcgactatacgtaagaanaagttaataaccgtaagaaacggtacggttagttagttagaactaaagacgaataaccgaagtaacgaaaccgtacgaacagtacccgacgttactacgttactaccgtaacacgtagtacgtagactgacgtcgtaaggaccgtaaggactcgttagttacgtttagtacgtacgtcgtacggtacggaaccgtacggtacgtggttaccgg

SEQ ID NO: 113390 - DNA, 735 bp, Homo sapiens
  misc_feature: GYAE6OF01BSWNR.15.86.H09.1.454.CMB.1.raw
  modified_base (451)..(451): a, c, t, g, unknown or other
  misc_feature (451)..(451): n is a, c, g, or t
  modified_base (474)..(474): a, c, t, g, unknown or other
  misc_feature (474)..(474): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggttttccttgctgctatacgttaaaaggtgtccagtgtgaagtgcgaggtggtggagtcggtggggacgtcgttaggtaacgtcggtcgggggtcctaggtacgtctccgtgtgtcggcctcgtgtattctacttcgagttagtggtcgtgagtggtaggtcggtccgcgacggcgtcggaggggagggtcgtaggtaggttggggttaggtaacgtttaaacgtaaaagtaaaagtgtaagtaggtagaaagtaaaagtagacgtacggacgaccgtaaccggaaggaaacggtaanagttaccaaccgtactacgtaanaaacgaagtaactaaagtaacgaaaccggtagttaacgttaagttacgtaaacgtaaagtacgtaaaacaccgtaaccgtaaacggtaaaaccggaccgacgtaaccgacgttacccgtaattaacgtactaccgaacaacgtagtaacgtacggaacgtgactaggtaacggaaggtaaggtaggtcttaaggtcgttagttacgtaaagttccggtaaccgggaccggtaacccggtaaggtaaccgttcgggtaccgg

SEQ ID NO: 113391 - DNA, 591 bp, Homo sapiens
  misc_feature: GYAE6OF01CROC2.15.86.H09.1.454.CMB.1.raw
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (454)..(454): a, c, t, g, unknown or other
  misc_feature (454)..(454): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgaggttgggtccgccgaggcctccgaggggaaggggctgggagtgggttagacgtttacgaaaagtaaaatgagtggtagaagaaaaatagactaggtgacaccgtagaaaggaagatcacanctanaagagatatacaaaagcgtgtattagataatgaacngacctagaaaacgaggacacgacgtcgtactattactagtaccaacagtacttacggaagttagacagtacggaacgtaaaggcggtactagtgtctttagattagtcggtacgggacccagggactaaggttcggg

SEQ ID NO: 113392 - DNA, 808 bp, Homo sapiens
  misc_feature: GYAE6OF01BAZBV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagacgtctcctgtgtcggcctctggtattcactttcagttaatggctggatgtaggttggtccgccaggctaccgaggggaaggggtcgtggagtgggttggtacgttttaacaaaaagtaaaagtgagtggtagaagaaaaatacggactacggtcgacctaacccggtaaggaaaaggacgtaacgttacaacccgtaattaccctaacgaaaaggtagtaaacttaaaacgttaaaccgaaaaaaccgggtacggttaggtttaatttacgggaaactaaaagtaggtaaaccgaacggtacccgtaaacgggtaaaaacccgaacggaaccaaccgtaacgacccgtttaaccgttaacttttaacccgtaacgttaaccccgaaacgtaacgggttaaaccgttacggggtaaacgttcggaacctaacggttaccggaaaaccgggttaaaaaggggcgttacccgtaaagtttacgggttctttttaaacggactttaacgggtacccgggtaccgggggaacccctaagggggtaaaccgtaaaggtttcccgggg

SEQ ID NO: 113393 - DNA, 913 bp, Homo sapiens
  misc_feature: GYAE6OF01DGCIY.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagtcttgggttttccttgctgctatacttaaaggtgtcagtgtgagtgcgaggtggtggagtcggtgggggacgtccgttagggtaaacggtccggttcggggggtcccttaaggtacgttccgttccgttggttcggttccgggtcccttcgttgggtaactttcctaccttttacgtaaggttaagtggtccgtagggtagttggtacggttcggggtcccgaccgacgggtccgtaccgggaagggggaacgggggtcgtaggggtagggtttacgggggtttacgggttaacggttttaaacgaaaaaaggttaaaaagtggtaaggttagggtaaagaaaacggtaaaaacgtaaggaaccgttaacggtacgacccgtaacccgggtaaaggaaaacgggtaacgtacgtttaaccaaccgtacgtaccgtaaacgaaaacgtaaacgttaaactaaaacccgtaaacccggtaaaaaacggggtacggtttaacgtttaacggtttaacgaaacgtaaaagtaaaccggtaaaccgaaacgtaaccccggtaaaacggaaaaacccgggcggaaacccaaccgtacggtacccgttactttaaaccgttaaccttaaccgtaaccaacggtaagttacgtaccgggtaagtcgacgtaacgtaacggaaacggttaagggaggttacctaggtttacgtttcgtttaagagtttaccggtccgggtaacggggtcccgaaagggtacgttaagggttccgg

SEQ ID NO: 113394 - DNA, 967 bp, Homo sapiens
  misc_feature: GYAE6OF01B102J.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttcctgctgctatacgttaaaggtgtccagtgtagaagtgcgaggtggtggaggtcggtggggacgtccgttagggtaaacggccggtcggggggtcccttagagtccttccgtggtcgtcggccttcgtggtacttctactttacgaggttaagtcggtcgtggtagtcggtacgggtttccggggtcccgaccggtacgggtcccgtaccggggaagggggtaacgggggtcgttaggggttacgggttcggggtttaacggttaacggttttaaaacgtaaaaaaggttaaaaaggttaggtaaggtagggttaaggaaaaggtaaaaagtacggtaaccggttaacggttaccggaacccgtaaacccgggtaaaggaaaaacgggtaacgtaactttaacccgaacctaacgttaccgtaaacgtaaaaggtaaacgttaaactttaaaaccggttaaaccggtaaaaaacgggtaccggttttaaggtttaaacgtttaacggaaaaccgtaaagttaaccgaaaaacccggttacggaaacccgttaaaaaccgggaaaacccgtaacgggtaaacccaacggtaacccggttacccgttaaccgtttaacgtttaaccggaaaccgtaacccgtaaaaccgttagttaaacccgggtttacggtaaagttacgaacccggttaaaggtaacccggggtaaaagtaaaccggggaagtttaccgtaagtttaccggtttatttaaggaacctttcgggtaaccccgggacgggtaaccccggaagggtaccgttaagttccggg

SEQ ID NO: 113395 - DNA, 1008 bp, Homo sapiens
  misc_feature: GYAE6OF01EHSYP.15.86.H09.1.454.CMB.1.raw
  modified_base (333)..(333): a, c, t, g, unknown or other
  misc_feature (333)..(333): n is a, c, g, or t
tcagtctacgtagccacgaccggtgctcgatttagtgctatagacttgggtttgggggagaggagcccccagccttgggatccccaagtgttttcattcagtgatcaggactgaacacagaggacctcaccatggagttcggctgagcgtggtttcctgctgctatacttaaaggtgtccagtgtgaagtgcgaggtggtggagtcgtgggggacgtcccgttagggtaaacgccggttcggggggttccccttagtacggtcctccgtggttcgtggcccttgtggattcctactttcagtaatggcgtggtatgtaggttcggggtccccnccgacggccgtcccggaagggggaacggggtcgtggggtagggtttgggggtttacgggtaaccggttttaaacgaaaaaaaggtaaaaaagttaggtaagttagggtaaggaaagtaaaaagtacgtaaccgtaacggttacgaaccgtaaccccggttaaaggaaaaagggaaacgtaacgttacccgaaaccctaaacgttacccgtaacgaaaaacggtaaagtaacttaaaaacgtttaaaccccgaaaaaaacggggttaacccgggttaaggttttaaaccgtttaacgggtaaaccctaaaaaaggttacccgggaaaactaaacccgggtaacccgttaaaaaccggggtaaaaaaacccccgggaacgggaaaccccgaaacccggtaacggtacccccggtttaaacctttaaaaccgttttaacccgttaacccggtaacccctaaaccgttaaagggtaaccgtttaaccggggtaaacgttacggtaaccgtaaacccgggttaaccgggtaaaaaccgggtaaaaaggggttaaccgggtaaccgtttaaggtttacccggtttaagttttttaaacggaacgtttttaacccgggtaccgggttaaccccgggggtaaaccccgggtaaacggggtaaaccgtaacgggtttaccgggg

SEQ ID NO: 113396 - DNA, 1077 bp, Homo sapiens
  misc_feature: GYAE6OF01DW2VQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtgggggagtccgttagggtaaacggccgttggggggttccccttaggacggttcctccgttggtggtcggtcccttcgtgggtactttccgtaccttttacaaggttaatgggtccgtggattgggtaaggtttcgggggtcccgacccggaagggtccgttacccggaaggggggaaacggggggtccgttagggggtagggtttaggggggtttagggtaaaccggtttttaaccgaaaaaaaggttaaaaagtggtaagttagggtagaaaaggtaaaatacggaacgttacgggtcgaaccgtaaccccgggtaaggaaaacgggtaaagtaacgtttacccgaaccgtaacttaccgtaacggaaacgtaaaggttaaactttaaacgtttaaaacccgaaaaaaaccgggtaccgggtttaaaggtttaacgttttacggtaaacccgtaaaaagtttaaacgggaaaaccgtaacggtaaccccggttaaaacgggtaaaaaaccccgggaacgggaaacccgtaaacccggtaacggttaacccccggtttaacgtttaaccgtttaaaacccgttacccggttaaaaccccgtaacggttaaacggttaaaccggtttaaccggggtaaacgggtttaccggaacccggttaaaacgtttaaacccgggggtaaaaacccgggtttaaaaaaggggggtacccgggttaaacccgttttaaggtttacggggttttaacccgtttttttaaacgggaacgtttttaaaccgggtttaccccgggggtaccccgggggggttaacccccggggaaaacgggggttaaacccgttaaacggggtttttaaccccggggggg

SEQ ID NO: 113397 - DNA, 884 bp, Homo sapiens
  misc_feature: GYAE6OF01A1YTE.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggacgccgttaggtaaacgccgtggggggttcccttaggagtcctccgtggtggtcggccttcgtggtattctactttcagtaatggtcgtggagtggtaggttcgggtccgccgacggtcctaccggaagggggaacgggggtcgtagggtagggttggggtttacgggtaaccggttttaacgaaaaaaggttaaaaagtcggtaagttagggtaagaaaggtaaaaagtacggtaaccgtaacggtcgaaccgtaacccggtaaggaaaagggaaagtaacttaccgaacctacgtaccgtaacgaaacgaagtaaacttaaacgttaaaccgaaaaacgggtaccgggtttagttaaacgttttaggaaacctaaaagtaggaaaacccgtaacggtaccccgtaaaacggaaaaacccggtacggaaacccgtaaccgtaaccgggtaccccgtttaaacgttaaactttacccggtaacgttaaccccgaagtaacgtaacggtttaacggaacggttcgaaccgtaaacggtaccggtaaaacgggttaaaagggacggtactttaaggtacggttttaacgtttaacgggtactttaacccgggtttacgggtaacccggggggtaacccgtaaacggggtaaaccgttaacgggttaccgggg

SEQ ID NO: 113398 - DNA, 629 bp, Homo sapiens
  misc_feature: GYAE6OF01B2BXX.15.86.H09.1.454.CMB.1.raw
  modified_base (396)..(396): a, c, t, g, unknown or other
  misc_feature (396)..(396): n is a, c, g, or t
  modified_base (432)..(432): a, c, t, g, unknown or other
  misc_feature (432)..(432): n is a, c, g, or t
  modified_base (492)..(492): a, c, t, g, unknown or other
  misc_feature (492)..(492): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcaggtggtggagtcgtgggggagccgttaggtaaagccgtggggggtcccttaggagtctccgtgtgtcggcctcgtggattcactttcagtaatggctggactggtaggttcgggtccgccaggcctccgagggaaggggctgggagtggggttgacgtttacaaaagtaaaatgataggtagaagaaaatagacgtacggngacaaccgtgaaaggagattcaaccatctacaaganaataatacaaaaacggcggttatatttagataaaatgaaacacgacctaaggaaaaccgngaacacgagtccgtactattacacgtacactagtacttacggaatgacatacgggaacgtaaagggcgtactagttggtccttttaggaattcgtaccgggtacggggaccctaaggggtaacctaaggttccgggg

SEQ ID NO: 113399 - DNA, 709 bp, Homo sapiens
  misc_feature: GYAE6OF01BT3OM.15.86.H09.1.454.CMB.1.raw
  modified_base (624)..(624): a, c, t, g, unknown or other
  misc_feature (624)..(624): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggaggtcgtgggggagccgttggtaaacgccgtggggggtcccttagagtctctgtgtcggcctctggacttcactttcgagtaatggcgtggatggagttcggggtccgccaggcctccgaggggaggggtcgtgggaggtggggttggtacgtttacgaaaagtaaaatgagtggtagaagaaatagacgtaggtgacacccggtagaaaggagtatcgaacctagtctacgaagaagtaattaaacgtaacgaaaaacggtacggttagttaattgaacaaagtacgaaactagacccgtaacggaaaaccggaacggaactaaccgagtcccgttaacttacgttaacgtacgtaacccgaagtaagtaacgttacgggtaacgtcggacctacggtacggaaaccggtaaaagggngggtaccttagtacggtttcgttttacggaattaaccgtccgggttacggggaccccggtaagggtaacccgtaggtttcccggg

SEQ ID NO: 113400 - DNA, 763 bp, Homo sapiens
  misc_feature: GYAE6OF01DKC1Z.15.86.H09.1.454.CMB.1.raw
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (284)..(284): a, c, t, g, unknown or other
  misc_feature (284)..(284): n is a, c, g, or t
  modified_base (701)..(701): a, c, t, g, unknown or other
  misc_feature (701)..(701): n is a, c, g, or t
tcagtctacgtagccacgaccggtgctcgatttagtgctatagacttgggtttggggggagaggagccccagccttgggatccccaagttgttttcattcagtgatcaggactgaacacagaggactcaccatggagttcggctgagcgttggttttcctgctgctatacgttaaaggtntcagtgngagtgcgnggtggtggngtcggtggggactccgtaggtaacgcgggtcgggtcctagcgtctcgtgtgtcggtcctgtgtatctacttacgagtagnggcggtatggtacggtcgggtccacgacggtccgacggaggggtaggggtcgtgggtagggttagggttacggtaaacgtttaacgaaaaagtaaagtgtagtaggtaagaaagtaaacgtacgtacgtacggtacgaccgtaacggtaagaaacgtacgtactaccaacctaatacgaacgagtaaataacgttaaacgtaaacggaaaggtcggtttatttaacgtcgaaaaactaagtaacgaaccaacggttaaccccgaaacgggaaaccgacgtaacctaaccgtaccggtaccctttaagtaactttaacccgaaccgaaccgtaaggtagttaacggttaccggaatccgtaacgtaacggtaacggtaaacggtaacggacttacgtttaggtactttttcggtaaanacggttacccgtacggggggtaccccgtaaggtaaccgttaagttccgtcgggtttaccccg

SEQ ID NO: 113401 - DNA, 853 bp, Homo sapiens
  misc_feature: GYAE6OF01EPULC.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggttttccttgctgctatacttaaaaggtgtccagtgtgaagtgcgagggtggtggaggtcgtggggggagtccgttagggtaaacggtccggtcgggggggttaccccttaggacgttccttcccgttggtggtcggccttcgtggtacttcctactttcgagttaagtggtcgtggatggtaggttcgggtcccgcgacggccgtaccggaaggggaggggcgtgggtaggttggggttacggtaacggtttaacgaaaaagttaaaagtgaagtagggtagaaaagtaaaagtacggtacgtaacggtgaccgtaacccggtaaggaaaggtaactacgttaccgaacctactacgtaacgaaaggtaagtaaacttaaacttaaaccgaaaaaacgggttacgggtttacgtttaagttttaacgaaacttaaaaaggtaccgtaaaacgtaaccggtaacccgtaaaacgggaaaaaccccggtaacgggtaacccaaaccggtaacggttacccgtttaaattaacgtttaacccgtacgttaaacccaacggttaaggtaacgtttacccggggaagttacgaaccgtaaggtaaaccgggtaaacggtaaagggcgttacgttaggttcgtttaactttgaaaccgttggttaccgggaccgggacccgggtaagggtaccgtagggttccgg

SEQ ID NO: 113402 - DNA, 724 bp, Homo sapiens
  misc_feature: GYAE6OF01BWH2I.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtctgggttttccttgctgctatcttaaaaggtgtccagtgtgaagtgcgaggtggtggagtcgtgggggagccgttaggtaaagccgtgggggtcccttagagtctctgtgtggcctctggattctacttcagtaatggcgtggatggtaggttcggggtcccgccgaggtccgttaccggaaggggtaacggggtcgtgggtaggtgggttaggtacgtttaacgaaaaagttaaaacgtgagtaggtagaaagtaaaagtagacgtaggtagaccaaccggtagaaaaggaataacttacaacgtatacgtaacgaaagagtaagtaaacttaacgaaaaacggtacggttagtaagtttacgaactaaaagttagaaacgtacgaccgtaaaggaaaaccgtaggaaccacgaacgtccgtaacttaagttaccgtaccgtaaccacgtaacgtaagttacggaagtcggaacacgtacggtaaaccgtaagggtacggtacttaaggtcgttcgttttaggaactttacgtaccgggacggggtaaccccagggtaacgtaacggttcgggg

SEQ ID NO: 113403 - DNA, 756 bp, Homo sapiens
  misc_feature: GYAE6OF01D97DS.15.86.H09.1.454.CMB.1.raw
  modified_base (183)..(183): a, c, t, g, unknown or other
  misc_feature (183)..(183): n is a, c, g, or t
  modified_base (293)..(293): a, c, t, g, unknown or other
  misc_feature (293)..(293): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctggagtcgttgggtttcctgctgctatacgttaaaggtntcagtgtagaagtgcgagggtggtggagtcgtggggctcgttaggaagtccggtgggggtacctagacgtctcgtgtgtcggtcctcgtggtattactacttacgagtanggtctaggtagtgtaggttcggtccgcgacggtctacgggaggggaagggtcgtaggggtaggttcggggttaggttaaccgttaaagtaaaaacggtaaatgtaaggtgtaagtaaaaggtaaaagtcgtaacggtacggtacgaaccggtaacggtaaggaaagtaacgtaacttaccgaactaactacgtaagaagtaaacgtaacttaaacgtaaacggtaaaacccgtaggtttacgttaacgttataaactaaagtacgaaacgtaacgaacgtaacgaaacgtacgactacggtactacgttaacctaagttactacgtaaccaggtaacgttacgtacgggaattcggaactacggtaaccggaaacgtaagggtacgtacgttacttagggttcttttaaggattaccgggtacgggtaccgggtaacggaaccggtcggtaaagggttcccgg

SEQ ID NO: 113404 - DNA, 855 bp, Homo sapiens
  misc_feature: GYAE6OF01CWRBT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttcctgctgctatacgttaaaggtgtcctagtgtagaagtgacgtaggtggtggtagtcggtggggacgtcgttaggtaacgtccggtcgggggtccttagacgtcgtcgtgtgtcggtcctcgtggtacttctacgttacgaagtagtggtcgtaggtagtggtacggttcgggtcccgacgtacggtccgtaccgggagggggtacgggtcgtagggtaggttgggttacggtaacgtttaaaacgaaaaagttaaaagtggtaacgtaggtaagaaacgtaaaagtacgtaacggtacggtacgaaccgtaaccggtaaggaaaaggtaacgtacctacaactacgtaccgtaacgaaagtaaacgtaaacgttaaacgtaaccggaaaacggttagtttacggtttaacttaacggaaaacttaaacgaggtaaacccgtacggaacccgtaaaacgggaaaccggacgaacctacggaccgtttaactaccttaattacccgtaacgtacccgtaaagtacggttaaccggttaaggtaaccgtcgtaaccgtaacggtaaccgggttaaaagggtaaggtaccgggttactttaagggttcttttaccggtttaaacgaggtttaaccccgggtttccggggaaccccggggaacccgggttaaaggtaaccggttccgggtttacccgggg

SEQ ID NO: 113405 - DNA, 880 bp, Homo sapiens
  misc_feature: GYAE6OF01C9HB5.15.86.H09.1.454.CMB.1.raw
  modified_base (405)..(405): a, c, t, g, unknown or other
  misc_feature (405)..(405): n is a, c, g, or t
  modified_base (648)..(648): a, c, t, g, unknown or other
  misc_feature (648)..(648): n is a, c, g, or t
tcagtctacgtagccacgaccggtgctcgatttagtgctatagacttgggtttgggggggagaggagccccagccttgggactccccaagtgttttcattcagtgatcaggactgaacacagaggactcaccatggagttcgggctgagcgttgggttttccttgctgctatacgttaaaggtcgtccagtgtgaagtgcgaggtggtggagtcggtgggggacgtcgttaggtaaacggccggtcgggggtaccttaggacgtccttccgtgtgtcggccttcgtggtactttctacttttacgaagtaagtggcgtaggagttggtacggttcgggtcccgcgacggccgtaccgggaagggggaagggtcgtagggtaggttggggttagtaacgtttaaanaaaaagtaaaagtgaagtcggtaagaaagtaaaagtagtaaccggtacggtagaacccggtaaccggtaaaggaaaaggaacgtaacgttacccaaaccctaatacccgtaaagaaagtaaacgttaaagttaaaccgttaaaacggaaaaaaccggttggttttaacgtaacgttttacggaaaacgtaaaagttacggaaaaccgtaaccggttaaccccaaaaacgggaaaaaacccggnggaaaccccaacggttaaaccccggttaccgtttaaacctttaaacgtttaccgaacccgttaaacccgtaaccgggtaaagttaacgttttaacggggaacgttacgaaccgtaacgttaaaccggggaaaacggttaaaaagggcggttaacgttaagtttcgttaaccgttttaagaaggttccgttaccgggacccggggtaaacccagggtaacttaggggttcccg

SEQ ID NO: 113406 - DNA, 724 bp, Homo sapiens
  misc_feature: GYAE6OF01E3GJ3.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctccgtgtgtggcctctggattcactttcagtaatggctggatgagttcgggtccgccgaggctccgaggggaaggggcgtgggaggtgggttggtacgtttaacaaaaagtaaaaatgatggtagaagaaaatagactacggtgacgtaccggtagaaaaggaagtattaccaacctatctacaaagaagtaattaaattaaccgaaaaacggtcggttagttaatttagaactaaaatcggaaacaacgtacctaaacggaaaacccggaggaaccaaccgacggtaccccgttacttaacttaccgtaacgtaacccaacgaagttacgttacgggaaagtacgaccgtaagttaccgggaaaccggtaaaagggtacggtacctttaagtcggtttacgtttttagaaacgtttacggttaccgggtacgggggtaaacccccgaaggggtaaacctaaagggtttccgggg

SEQ ID NO: 113407 - DNA, 740 bp, Homo sapiens
  misc_feature: GYAE6OF01BC3MO.15.86.H09.1.454.CMB.1.raw
  modified_base (683)..(683): a, c, t, g, unknown or other
  misc_feature (683)..(683): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaagccgtgggacggttccttagagtctcctgtgtggcctcgtggattcgactttcagttaatggctggatggtagttcgggccgcgaggctcgaggggagggctgggagtggggttagtacgtttagaaaagtaaaatgagtggtagaagaaaagtgaacgtacggacgaccgaaccggtaggaaaagggaacgtattaccgaacctactactaacgaaagaacgtaacttaaaagttaaaccgaaaaaacggtaccggttagtttaaactttaggaaacttaaacgacgttaaacgaacgtacccgttaaacgggaaaaacccggtacggaacccgtaaacgtacggtacccgttaacgttaacttaaccgttacggtaacccaaccgtaagtacgtttacgggaattcggacgttaacaccgggtaaaggtaaacggcggttacaagtttccgtnttttaacggattaaccggtcggggttaaccgggaccgttaacggggaattaaacggg

SEQ ID NO: 113408 - DNA, 669 bp, Homo sapiens
  misc_feature: GYAE6OF01CN8AC.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctggttttccttgctgctatacttaaaaggtgtccagtgtgaagtgcaggtggtggagtcgtggggagccgttaggtaaagccgtgggggtcccttagagtctcctgtgtggccttctggattctactttcagtaatggctggatggtagttgggtcccgcgaggtctaccgagggaaggggctgggagtgggttaggacgtttacgaaaaagtaaaatgagtggtagaagaaaagtagacgtacggtgacaccgtaagaaagaagattacaccatactacgaagagtaataataacgaaaacggtggttagtattagactaaatcgaactagacctaacgaaaccgagaacacgacgtaccgtacttaacgttaccacggtaacccacgtaacgacgtttaaccggaagtcgaacctagtaaccggaaacggtaaacggtggtacctttaagtacggttcgttttacggatttaccggtaccgggtaggggacccctaaggggtaacctaagggttccggg

SEQ ID NO: 113409 - DNA, 756 bp, Homo sapiens
  misc_feature: GYAE6OF01BHRWI.15.86.H09.1.454.CMB.1.raw
  modified_base (597)..(597): a, c, t, g, unknown or other
  misc_feature (597)..(597): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtcagtgtgaagtgcgaggtggtggagtcgtggggagccgttaggtaaagccgtgggggtcccttagacgtctcctgtgtgcctcgtggattcactttcagtaagtggctggagttggtaggttcggggtcccgaccgtaggccgtacccggaagggggaacgggggtcgtaggggtagggttggggtttagggtaacggttttaacgaaaaaaggttaaaaagttggtaagttagggtaagaaagtaaaaacgtacggtaacgtaacggtacgaccgaacccggtaaggaaaggaacggtaacttacgaacctactacctaacgaaagtaagtaacttaaaacgttaacgaaaaacggtacggttagtttaagtttacgaactaaagtagaaacgtaccgtacgtaacgaaaaccggngaacaacgacggtccctattactaacctacgtaaccctacaagtacgttacgaagtcgtaacgacgtacgaaaggtaaacggtgggacctttagttcgttcgtttaagacgttacggttccggtaaccgggggacctaacgggtacgtaagggttccgg

SEQ ID NO: 113410 - DNA, 797 bp, Homo sapiens
  misc_feature: GYAE6OF01EPGE6.15.86.H09.1.454.CMB.1.raw
  modified_base (629)..(629): a, c, t, g, unknown or other
  misc_feature (629)..(629): n is a, c, g, or t
  modified_base (728)..(728): a, c, t, g, unknown or other
  misc_feature (728)..(728): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaagtgtccagtgtgaagtgcaggtggtggagtcgtgggggacgtccgttaggaaagtccggtcggggggttcccttaggacgtctccgttggtggtcggtcctcgtggtatttcctacttttcgaagttaagttggtcgttgggattggtaagggtttcggggtcccggacccgtaggggtcccgtacccgggaagggggaacggggggtcgtacgggggtagggttgggggtttagggttaacccgttttaacgtaaaaaaaggttaaaaagtgtagtagggtagaaagtaaaaagtaggtaacgtaacggtacgaccgacccggtaagaaaaggtacgtattaccactaatccgaacgtaaagaacgtaattaaacgtaacgaaaaacccggtaggttagttaactttacgaaactaaaagtacgaaactaacgtaccctaaaggaaaacccgnggaacaacgtacgtaccgtacttaagttaacctacgtaacccaacgagttaacgtacggtaacgtacgtactaaacggtccgtaaaagggtaaaacggnggtaacttagttacggttacctttagaagtacttcgggacccggggtacccaagggtactaggttccgg

SEQ ID NO: 113411 - DNA, 803 bp, Homo sapiens
  misc_feature: GYAE6OF01CK582.15.86.H09.1.454.CMB.1.raw
  modified_base (515)..(515): a, c, t, g, unknown or other
  misc_feature (515)..(515): n is a, c, g, or t
  modified_base (553)..(553): a, c, t, g, unknown or other
  misc_feature (553)..(553): n is a, c, g, or t
tcagtctacgtagccacgaccggtgctcgatttagtgctatagacttgggtttgggggggagaggagccccagccttgggatccccaagtgtttttcattcagtgatcaggactgaacacagaggactcaccatggagttcgggctgagcttgggttttccttgctgctatacttaaagtgtcagtgtagagtgcgaggtggtggagtcggtgggggacgtccgttaggtaaacggtccggttcggggggttacccgttaacggtagttccttccggttggtcggttcggtcccgttcgttggtactttcttaaccttttcgtaagttaagtggtcgtggtagtggtaggttcgggtcccgccgacggccgtacggaggggaacgggggcgtgggtaggttggggttaggtacgtttaaagaaaaagtaaaagtagagtaggtagaaagtaaaagagtacgtacggcgaccgtaacggtagaaacggtaagactacactaatacgaagaagtaanaattaaacgtaacgaaaacggtaggttagttacttaanaactaaagtacgaacgacgaaccgtaaacggaaaaccgaacggaacctaacggaccgtaacgttacttaacgttacgaccgtaacctaacgaagttaaccggtacggtaaggttacgaacgtaacggttaaacggaaaccgggtaaagggaacgttacgttagtttacgtttcgtttacggtaaggtttccggtaccgggtaccgggggttaacccggaaaggggttaaccgttaaggggtttcccgggg

SEQ ID NO: 113412 - DNA, 685 bp, Homo sapiens
  misc_feature: GYAE6OF01D7BZO.15.86.H09.1.454.CMB.1.raw
  modified_base (506)..(506): a, c, t, g, unknown or other
  misc_feature (506)..(506): n is a, c, g, or t
tcagtctacgtagccacgaccggtgctcgatttagtgctatagacgttgggttgggggggagaggagccccagccttgggatccccaagtgtttcattcagtgatcaggactgaacacagaggactcaccatggagttcggctgagctgggtttccttgctgctatacttaaaggtgtacagtgtgagtgcaggtggtggagtcgtggggagtccttggtaaagccgtgggggtccctagagtctcctgtgtggcctctggacttcgactttcagtaatggctggatggagttcgggccgccgaggctaccgaggggacggggcgtgggaggtggggttggtacgtttagaaaagtaaaatgagtggtagaagaaaatacgacgtacggtgacctaaccgtaggaaaggagacttacaacctatacgtacaagagtaactaagttacgaaaaacgtcggtagttagtttagaactaaagtagaaacgacgacctaagaaaaccggngaacctacgacgtaccgttactaattaccacgtaaccgacgtaagtacggtttacggaacgtcgtacgaacgtacgggtaaacgggtaaaggtacgggtactttaaggttcggtttcttttacgggattaacggttccggtacgggggaccccgtaaggggacttaacgggttccgggg

SEQ ID NO: 113413 - DNA, 843 bp, Homo sapiens
  misc_feature: GYAE6OF01B35RZ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaagccgtgggggtcccttagagtctcctgtgtcggcctcgtggattctactttcagttaagtggctggatggtaggttcgggtccgccgaggcctaccggaggggaacggggcgtagggaggttggggttacggtacgtttaacgaaaaagttaaaagtggtagtagggtagaaagaaaagtagaacgtacggtacgaccgtaacccggtaaggaaaaggtaacgtacttaccgaacctaacgttacctaacgaaaggtaagtaaacgttaaaacgtttaaacggaaaaaaccggttcgggttaagtttaacgttttaacggaaacgttaaaaaagttccggaaaaaccgtaaccggtaaccccgtaaaacgggaaaaacccggtacggaaaccctaacggtacccgtaacccgtttaacttaaacgttttaaccgaccgttaaacccgacgtaaacggtaaccgtttacgggaaagttcgaaccgttaacgtaaacgggaaacggttaaaagggcggttaccttaaggttacgtttaccggttttaagtaaaccttcgggttacccggggtacccggggaacccggtaaaggggtaaccgttaacgggtttccgggg

SEQ ID NO: 113414 - DNA, 975 bp, Homo sapiens
  misc_feature: GYAE6OF01BHE4J.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcgttggttttccttgctgctatacgttaaaaggtgtccagtgtagaagtgcgaggtggtggagtcgtgggggacgtccgttagggtaaacgtccggttcggggggttacccttaggtacgttccgttcccgttggttcggtcgggtcccttcgtaggtactttaccgtacttttacgaaggttaagtcggtcgtggtagttcggtaggtttcggggtcccgaccgtacgggtcccgtaccgggaagggggtaacgggggtcggttaggggttacgggttgggggtttacgggtaacgtttaaaacgtaaaaaaggttaaaaagtggtaaggttagggtaaggtaaaagtaaaagttaacggtaaccggttaaccgggtacgtaacccggtaaacccgggtaaaggaaaacggtaaacggtaacttaaccgaaacccgtaagtaccgtaaacgtaaaacggtaacgtaaacgttaaaacgttaaaccgaaaaacgggtaccggtttagttaaacgtttacggaaacgtaaaagtacgaaaccgtacggaacccgttaaaaccgggaaaacccggtacggaaacctaaccggtaacggtaccccggttaactttaaccgttaaccgtaaccgtaaacccgtaacgtaacggttaacggttaccggtaaagtaccgtaaccgtaaacgggttaacgggtaaaaccggtaaaggggtaccgtaacggtttacggttaaccgtttagggtttttacaacggtttacgggttaccgggaaccccggggggttaacccctaaaacgggggttaccgtaagggtttaccccggg

SEQ ID NO: 113415 - DNA, 860 bp, Homo sapiens
  misc_feature: GYAE6OF01EE79G.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagacggactcaccatggagttcgggctgagcgttgggttttccttgctgctatacttaaaaggtgtccagtgtgaagtgcaggtggtggagtcgtggggagtccgttaggtaaacgtccggtcggggggttcccttaaggtacgttccttccgtggttggtacggtccttcgtggtactttcctaccttttacgaagttaagtggtcgttaggagttggtaacggtttcggggtcccgaccgtacggtccgtaccggaagggggaacggggtcggtggggtagggttacgggggtttagggtaaccggttttaaacgaaaaaaggttaaaaacgttgtaagttagggtaagaaagtaaaagtacggtaaccgtacggtacgaccgtaaccgggtaaggaaaaggaagtaactttaccacctatactaacgaaagtaagtaattaaacgttaacgaaaaaccggttacggttaagttaagtttaacgaagtaaacgtacgaaaccgtaacggtacccgttaaaacggaaaacccggaaggtaaccaaccggtaacgttacccgttaattaacgttaaccgtaacggtaacccgaacgtaggttaaccgttacgggaaacgttaccgaacgttaaccgggtaaacggtaaagggtacgttacgttagttacggtttagtttagaaccgtttacgtccgggttaccggggacccaaggggttactaccgggttcgggttacccg

SEQ ID NO: 113416 - DNA, 675 bp, Homo sapiens
  misc_feature: GYAE6OF01DLTFQ.15.86.H09.1.454.CMB.1.raw
  modified_base (514)..(514): a, c, t, g, unknown or other
  misc_feature (514)..(514): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaacgccgtggggggtcccttaggagtctcctgtgtggcctcgtggattctactttcagtatggctggatgagttcgggtccgccgaggctccgaggggaaggggcgtgggaggtggggttggtacgtttacaaaaaggtaaaatgaagtgggtagaaagaaaagtagaacgttacggtgaccgaacccggtaaggaaaaggaagtacttaccaacctatcctacgaaaggaagaattaattaaacgaaaaacggtcggttagttaatttagaactaaagtacgaaacncgaccgtaaggaaaacccggaggaaccacgacgtccttacttaattacctacgtaacccagtagtacgtttacggaagtcgactacgtacggaaggtaaaggaggtactagttgttctttagagttacgtcggtacgggacctaagggactaaggttcggg

SEQ ID NO: 113417 - DNA, 889 bp, Homo sapiens
  misc_feature: GYAE6OF01ES7H2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatcttaaaggtgtccagtgtgaagtgcgaggtggtggagttcgtggggggagtcccgtttagggtaaacgtccggttcggggggggttccccctttaaggtacgttccgttcccgttggttcggttcggggtccccttcgttgggtaacttttccgacttttttacccgaagttaagtcgggtccttagggaattgggtaagggtttccggggtcccgacccgtacgggtacccgttacccggaagggggggaagggggtccgtaggggttaacggggtttcgggggtttaggggttaaccggtttttaaacgaaaaaagggtttaaaaacgttggtaaggttagggtaaggaaagtaaaacgttaacggtacgtaacggttaccgaccgaacccgggttaaggaaagggaaacgtacttaccgaacctacgtacctagaaagagtaactaaacgttacgaaaaccggtgttaagttactttagaactaaagtagaaaccgtaagtacccgaaaggtaaaaccgaggaacctaaccgacggttacccggtctaaacgttttaccgtaccgtaaccgaacctaggtaaccgttagggaacgtcgtaacaaggttaccggtaaaacggtaaagggttacggtattaagtcggtttaccgtttagaacgttttcgggaccgtttaccggggaccggtaaacgggtaactaacggggttccggg

SEQ ID NO: 113418 - DNA, 645 bp, Homo sapiens
  misc_feature: GYAE6OF01BY9HW.15.86.H09.1.454.CMB.1.raw
  modified_base (458)..(458): a, c, t, g, unknown or other
  misc_feature (458)..(458): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaagccgtggggggtcccttagagtctcctgtgtggcctctggatcactttcagtatggctggatgagttggtccgcaggctcgagggagggctggagtgggtgagttacaaaagtaaaatgatggtagaagaaaatagacgtacggtgacctaacccggtagaaaggaagtattaccaaccatctacaaagagaattaacgtacaaaacggtacggttagttaatttcgaanaaagtcgaaacacgacctaaggaaaaccgagaccacgacgtactactaacttacgactaacccactaagtacttaccgggaagtcgacgtactacggaaccggtaaaaggcggtactagttacggttcttttaggaagttaacgttcggtaccgggggacccgaagggtacctaaggttacccgggg

SEQ ID NO: 113419 - DNA, 677 bp, Homo sapiens
  misc_feature: GYAE6OF01EODDK.15.86.H09.1.454.CMB.1.raw
  modified_base (417)..(417): a, c, t, g, unknown or other
  misc_feature (417)..(417): n is a, c, g, or t
  modified_base (450)..(450): a, c, t, g, unknown or other
  misc_feature (450)..(450): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggacgtccgttggtaaacgccgtcggggggttcccttagacgtctcctgtggtcggcctcgtggtattctactttcaagttaatggtctgggatggtaggttggggtcccgccgaggcctaccggaggggaaggggcgtgggaggttggggtggtacgtttaacaaaaggttaaaatgatggtagaagaaaatgacgtacggngacgacccggtagaaaggagtactcacatctanaaagagaataattaacgaaaacggtcggttattagttcgaataaatagaactagaccgtaacggaaaaccggagaacaccgagtacccgttataacttaacgtacgtaaccacgtaagtaagttacgggaagtcgacacggttacgaaacggtaaaagggcgtacttagtggttacttttagacttaacgtcggtacggggaccctaaggggactaagggttccggg

SEQ ID NO: 113420 - DNA, 690 bp, Homo sapiens
  misc_feature: GYAE6OF01CE0BM.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagccttgggtaaagccgtggggggtcccttagagtctcctgtgtggcctctggattcactttcagtaatggctggatgagttgggtccgcaggctccgaggggaaggggctgggaggtgggttggacgtttacgaaaagtaaaatgatggtagaagaaaatagaactacggtgacgacccggtaggaaaggaagacttacacctatctacgaagtagattaactaacgaaaacggtacggtagttaatttcgaactaaaagttacgaaacaacgtaccgtaacggaaaaacccggtaggaaccaacgaacggtacccgttacttaacgttacgtacgtaaccacgtagtaacgtttagggaacttggaactacgtacggaaacggtaaagggaggtacttagttcggttactttttaggaatttacggtccgggttacgggggaccccgtaaaggggacctaagggttaccggg

SEQ ID NO: 113421 - DNA, 721 bp, Homo sapiens
  misc_feature: GYAE6OF01CA95C.15.86.H09.1.454.CMB.1.raw
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
  modified_base (497)..(497): a, c, t, g, unknown or other
  misc_feature (497)..(497): n is a, c, g, or t
  modified_base (553)..(553): a, c, t, g, unknown or other
  misc_feature (553)..(553): n is a, c, g, or t
  modified_base (579)..(579): a, c, t, g, unknown or other
  misc_feature (579)..(579): n is a, c, g, or t
  modified_base (585)..(585): a, c, t, g, unknown or other
  misc_feature (585)..(585): n is a, c, g, or t
  modified_base (591)..(591): a, c, t, g, unknown or other
  misc_feature (591)..(591): n is a, c, g, or t
  modified_base (598)..(598): a, c, t, g, unknown or other
  misc_feature (598)..(598): n is a, c, g, or t
  modified_base (623)..(623): a, c, t, g, unknown or other
  misc_feature (623)..(623): n is a, c, g, or t
  modified_base (626)..(626): a, c, t, g, unknown or other
  misc_feature (626)..(626): n is a, c, g, or t
  modified_base (662)..(662): a, c, t, g, unknown or other
  misc_feature (662)..(662): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctggttttccttgctgctatcttaaaaggtgtcagtgtgaagtgcaggtggtggaggtcgtgggggacgtccgttagggtaaacggtccggttgggggggttacccctttaggaacggttccttcccgttggttcggtcggtccgttccgtcgggtaatttcctaccttttacgaaggttaaacgttggccgtaggtagtggtaggttcggggtcccgtccgacggtctaccggagggggaaggggcgtagggagttggggttggtaacgtttaagaaaataaagtgtacgnggtagaagaaaatgaactcggtnaccgaccggtagaaaggatacgtaccacatacgtanaacgtataaacttaataaaccgaaacggtacgtagttagtttacgaaactaagtanaaaccgagtacccgtagaaaaaccgnggaacncgaacnccgttanattactacgacagtatagtacgganacncgactacggaacgtaaggtcgtacgtagttacgttnttttacgattaaccggtcggttaacggggaacccagggtaaaccgtaggtttccccggg

SEQ ID NO: 113422 - DNA, 1021 bp, Homo sapiens
  misc_feature: GYAE6OF01A5KHX.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacgttaaaggtgtccagtgtgaagtgcgaggtggtggagtcgtgggggacgtccgttagggtaaacgccggtcggggggttccccttaaggtacgttccttccgtggttcggtcggtcccgttcgtggtactttctacttttacaagttaagtcggtcgttaggtagtggtagggtttcggggtaccccgcccggtacgggccccgttaccggggaacggggggaaacggggggtccggtaggggtacggggttcgggggttttacgggttaaaccgggtttttaaaaccggtaaaaaaaggtttaaaaaaagttacgggttaaaggttaaggggtaaaggtaaaaaggtaaaaaagttaacgggtaaccggttaaaccgggttacggtaaccccggtaaaccccggggtaaagggtaaaaaacgggtaaaacgttaaacgtttaacccgaaacccgttaacgttaaccgttaaacggaaaaacgggtaaacgtaaaacgtttaaaaaccgtttaaaaccggtaaaaaaacccggggttacgggtttagtttaaaacggtttacggtaaaccgtaaaaagttaacggaaaacccgtaaacggtaaccccgttaaaaacgggaaaaacccggaacgggtaacccaaacggtaccggttaacccgtttaacccttaaacgtttaacccctacggtaaaccccgttaagtaacggttacggtttaaccggggaaagttcgaacgtaaacgttaccgggaaaagggtaacgggtagtcttaagttacggttcttttaaaggactttacggttaccgggtacccgggtaccggaaaggtaaccgttaacggtccggg

SEQ ID NO: 113423 - DNA, 823 bp, Homo sapiens
  misc_feature: GYAE6OF01DVVXX.15.86.H09.1.454.CMB.1.raw
tcagtctacgtagccacgaccggtgctcgatttagtgctatagacttgggtttgggggggagaggagccccagccttgggatccccaagttgttttcattcagtgatcaggactgaacacagaggactcaccatggagttcgggctgagcgttgggttttccttgctgctatacgttaaaggtgtccagtgtagagtgcgaggtggtggagtcggtgggggacgtaccgttagggtaaacggtccggttcggggggttacccttaggtacgttccgttccgttggtcggtcggtcctcgtaggtactttcctactttacgtagtaagtcggtcgtaggtagtggtacggttccgggtcccgaccgacggtccgtaccggggaagggggaacggggtcgtaggggtaggtttaggggttacggttaacgtttaaacgaaaaagttaaaagttgtaagtaggtaagaaagtaaaagtaggacgtacggtcgaaccgaaccggaagaaaggaactacttaccaacgtatacgtaacgaagtaacgtaacgttaaacttaaaccggaaaacggtttagttacgttaattttacgaaaacttaaagtaacggaaacctaacggaaccgtaaaacgggaaaccgcgaaacccaacggtacccgtacgtttaactaacgtttaccgtaactaccgaaacgtaggttaacgttaacggactacgtaaccgtaagaacccgggtaaaggtaaggaccgttagttacgttaggtttacgttagtaagttccgtacgggtaccgggaacccgttaggtaccgtagggttcccgg

SEQ ID NO: 113424 - DNA, 642 bp, Homo sapiens
  misc_feature: GYAE6OF01AQHMX.15.86.H09.1.454.CMB.1.raw
  modified_base (431)..(431): a, c, t, g, unknown or other
  misc_feature (431)..(431): n is a, c, g, or t
  modified_base (584)..(584): a, c, t, g, unknown or other
  misc_feature (584)..(584): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggtttcctgctgctatcttaaaaggtgtccagtgtgaagtgcaggtggtggagtcgtgggggagccgttaggtaaacgccgtggggggtcccttagacgtctccgtgtgtcggcctcgtggtattcactttcagtaatggctggatgagttggtccgcaggctaccgaggggaagggcgtgggaggtgggtaggtacgtttaacgaaaagtaaaatgaagtggtagaaagtaaagtagacgtacggtgacgaccgtaggaaagagattacacctatcanaacgagtaataataacgaaaaacggtcggtatatttaggaactaaagtgaaacagaccgtaacgaaaaccggagtactaagtacgaccgttactaactacgtacgtaaccagtaagtacgttacgaagtcgactagtacgaaacggtaaaggngtacttatgttcgttagacttagtccggtacgggaacccgtagggtacctaggttcgg

SEQ ID NO: 113425 - DNA, 822 bp, Homo sapiens
  misc_feature: GYAE6OF01E46XV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttaggtaaagccggtgggggtcccttagagtctccgtgtgtggcctcgtggattctactttcagtaagtggcgtggagtggtaggttcggggtcccgaccgacgggccgtaccggaagggggaacgggggtccgtaggggacgggtttgggggttacgggtaaccggttttaaacgaaaaaaggttaaaaagtggtaagttagggtaagaaagtaaaagtaacggtaaccgtaacggtacgaccgtaacccggtaaggaaaaggtaacgtacttaccgaacctactaccgtaacgaaaggtaacgtaaagttaaaacgttaaaccgaaaaaccggttacgggttagtttaagtttacgaaacttaaaagtcggaaaccgtaacgtacccgtaaacggaaaaaccggtacggaaaccaaccgtaacgtcccgttaacttaacgttaaccgtaacgtaacccgtaacgtaaggttaacgttacgggtaagtcgtaacgacgttacggaaacgggtaaacggacggtacgttagttacggttacgttttagaacgttaccgtacgggtaccggggaacccgttaaggggactagggttaccgg

SEQ ID NO: 113426 - DNA, 1041 bp, Homo sapiens
  misc_feature: GYAE6OF01B143Y.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtagaagtgcgagggtggtggaggtcggtgggggagtccgtttagggtaaacggccggtggggggttaccccttaggacgtccttccgttggtggtcgggcccttcgtaggtactttccgtactttcgaagttaacgtggtcgtaggtagtggtaggtttcgggtccgccgaggtccgtaccggaggggaacggggtcgtgggtaggttggggttacggtaaccggtttaaacaaaaaggtaaaaagtggaagttaggtaaggaaagtaaaagtacgaacggtacggtacgaaccgtaccggtaaggaaaaggaacgtaacttaccgtaccgtacttaccgtaacaaacggtaaagtaacttaaacgtttaaaacccgaaaaacgggtacgggtttaagttaacgtttagaaaacgttaaaacgtacggtaaaaccgtaaccgggtaacccgtaaacggaaaaaaccccgggtaggaaaccccgtaaaccggtaacccggtttaaccccggtttaaacccgttttaaacgttttaaacccggtttaacccgggttaaaaacccccctaaaggggtttaaaacccgggttaaacggttttaaccccgggggtaaaaggtttaacccgggttaacccgttaaaacggggttaaaccccgggttaaaaaacgggggttaaaaccgggggtaaaccggttaaccggttttaaacggttaaccgggttttttaacgttttaaacggggtaacccgttttaaacccgggtttaccccgggggggttaaacccccggggggttaacccccgggaaaagggggtttaaaacccccggttaaaggggttttaccccgggggg

SEQ ID NO: 113427 - DNA, 861 bp, Homo sapiens
  misc_feature: GYAE6OF01B73AJ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccagtggagttcgggctgagtcttgggttttccttgctgctatacgttaaaggtgtccagtgtagaagtgcgaggtggtggagtcggtggggagtccgttaggtaaacggtccggtcgggggtacccgttaggacgtcctccgttggtggtcggtccttacgtggtacttccgtactttacgtaaggtacgtggacgtggtaagttggtacggttccggggtcccgaccgtacgggtccgtaccgggaagggggtaacggggtcgtacgggtaggttacggggttacggtaaaccgtttaaacgtaaaaaagtaaaaagttgtaaaggttagggtaaagtaaaaggtaaaaactagggtaaccgtaacggtacgaacccgtaaacccgggtaaaggaaaacgggtaatacgtaccaactactacgtaacggaaagtaacgtaacgttaaacgtaaccgtaaaaaccggtggttaagttaagtttacgaaacgtaaaagtaacgaaaaccgttcgaaacccggtaaccggaaaaacgtacggaacaccgtaaccggtacctttaacgttaacgttaccccgtaaacgtaaccccgtaacgtacggtaacggtttaacccggaggtaacacccggtaaaggtaccgggtaaaacgaagggttcgtaacgttacgtcgtttacgttaagacgttacgtccggggtaacggaacccgttaggacgtagggttcccg

SEQ ID NO: 113428 - DNA, 776 bp, Homo sapiens
  misc_feature: GYAE6OF01AQ3E2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtagaagtgcgaggtggtggagtcgtggggagtccgttaggtaaacgccggtgggggtcccttaggacgtctcctgtgtcggccttctggtattctactttcagtaagtggctggagtggtacggttcgggtccgccgaggtccgtacggaagggggacggggtcgtagggtacggtggggttacggtaacgtttaacgaaaaaggtaaaagtgtagtagggtagaaagtaaaagtacgacgtacggtgaacctaccggaagaaaaggacgtactaccaaccgtatacgtaacgaaagtaagtaaacttaaacgttaaaccgaaaaacggttacggttaagttaatttacggaaacttaaaacgtaacggaaacgtaacggtaacccgtaaacggaaaacccggtaacggaacaacccgaacggttaccgtttaaaccgttattaacccgtaaccgtaaaccctaggtaacgtaaacggtttcggaaacgttcgaaaccgtaacggtacggtaaaacggtaaggaacgtcttaagttcggttacgtttagagttacgacgggttacgggacgaacggtgtaagtccggg

SEQ ID NO: 113429 - DNA, 726 bp, Homo sapiens
  misc_feature: GYAE6OF01EOWNS.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtcggcctcgtggattcactttcagtaatggctggatgagttggtccgcgaggctccgagggaagggcgtggaggtgggttggtacgtttacgaaaagtaaaatgagtaggtagaagtaaaatagtacgtacggtgacgaccggtagaaaggaagtacgttaccaacctatcctacgaaagagtaattaaacgttaacgaaaaaccggtacggttagttaactttagaactaaaagtacgaaacgtacgtaccgtaaacggaaaaccgaggaaccaacgacgtacccgttacttaacgttaccgtacgtaacccaacgtaaggtaaccgtttacgggaagtcgaaccgtaacggtaccggaaacggtaaaacgggtacggtaccttaagttacggtttaccgtttttaaggtaacttaccgttcgggttacccgggggaaccccgtaaggggtaacctaaacgggttcgggg

SEQ ID NO: 113430 - DNA, 800 bp, Homo sapiens
  misc_feature: GYAE6OF01CHZE1.15.86.H09.1.454.CMB.1.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacgttaaaaggtgtccagtgtgaagtgcgaggtggtggagtcgtggggagccgttggaagccggtgggggtccttagngtctctgtgtggcctcgtgacttcgtactttaagtagtggntggatggtagttcgggtccgacgacggcgtaccgaggggaggggtcgtagggtaggttgggttacggtaacgtttaacgaaaaaaggttaaaatgggtagtagggtaagaaaggtaaaaacgttaggtaaccgttaacggggtcgaacccgtaacccggtaaagggaaaacggtaacgtaaccgtttaccaaacctaacgtaccttaacgaaaaggtaagtaaacttaaacgttaaaccggaaaaaaccgggttggttaacgttaacgttttaacgaaactaaacgttaacgaaaccgtaacgtacccgtaaacggaaaacccggaggtaaacccgaacgtaaccggtacccgtttaacttaacgttaaccgtccggtaaaccaacgtaacggttaacgtacgggtaaagttcgactaacggtaggtaaaccggtaaaggtggtacttagttagtttcgtttagaacttcgtacgggtcgggaccctaaggggaacttaggtcggttaccg

SEQ ID NO: 113431 - DNA, 777 bp, Homo sapiens
  misc_feature: GYAE6OF01CPHYB.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcggctgagctgggttttccttgctgctatacgttaaaaggtgtcagtgtgaagtgcgaggtggtggagtcgtggggagtccgttagggtaaacgccggttgggggtacccttaaggacgttccgttccgtggttcggtcggtccttcgttgggtactttcctaactttcgaagttaagtggtacgtggtaagttggtacggtttcgggcccgtaccgaacggtccgtaccggaaggggaacggggtccgtagggtaggtttggggttacggtaacgtttaaaccgtaaaaaagttaaaagtggtaagtaggtaagaaagtaaaaagtacgtaacgttaacggtacgaaccgtaacccggtaaggaaaacggtaatacgttaaccaacctagtactaacgaaagtagaacttaataacgaaaacgtaggtttaacttaagttacgaactaaagttacgaaaacgtaccgtaactaaaccggaaaacgacgaaaccacgaacgtcctaattactactagaaccctaacgtagtacgttacggaatcgaataccggtacgtaaacggtaaggtacgtacgttagtacggttactttaggaacttcggttccgggtaacggcccgaaggtaacgtcggttcgg

SEQ ID NO: 113432 - DNA, 624 bp, Homo sapiens
  misc_feature: GYAE6OF01D65UQ.15.86.H09.1.454.CMB.1.raw
  modified_base (300)..(300): a, c, t, g, unknown or other
  misc_feature (300)..(300): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtcgtgggggagccttggtaaagccgtgggggtcccttagagtctcctgtgtcggcctcgtggattcactttcagtaatggctggatgagtcgggtcncaagctccgagggagggctggagtgggtgacgtttacaaagtaaatgatggtagaagaaatagacgtacggtgcgaccgtagaaaggatattcgacatctacgaagacgaattaacttacgaaaaacgtaggtacttagtttagactaaatgaaacgtaggacctaaggaaaacccgtaggaacacgacgtccgtactagttaacctgtaaccaccgagtaagttcggaagtcgactagttacggaacgtaaagggtcggaacttaggtacgttcgtttagacttaagtcgtaccgggggacccaaggggtacaacgttcgggg

SEQ ID NO: 113433 - DNA, 929 bp, Homo sapiens
  misc_feature: GYAE6OF01BGDM8.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggttttccttgctgctatacgttaaaaggtgtccagtgtgaagtgcgagggtggtggaggtcggtgggggacgtccggttaggggtaaaccgggtcccccggggggttaccctttaaggtacgttcccgttccgttggttcggtcgggtcccttcgtggtactttaccttaaccgttttacgtaagttaagtcggtcgttagggtagttgggtacgggtttcggggtacccggaccgtacgggtccgttaccgggaaggggggtaagggggtccggttagggggtacggggtttacgggggtttagggttaaaccggttttaaacgaaaaaaggttaaaagttaggtaagttagggtaagaaaggtaaaagtacggtaacgtacggtacgaccgtaaaccggtaaggaaaacggtataactaccgaactactaccgtaacgaaacggtaagtaaactttaaacgttaaaccgtaaaaaccgggttaggttactttaacgttacgaaacgtaaaacgtacggaaaaccgtaaccggtaaaccgtaaaaccgggaaaaccggaaacggaaccgtaaccgtaccggtacccgtttaacttaaccgtttaacgaccggtaaacccacgtaagttaacggtacggtaagtcgactaacggtaaccgggaaacggtaaagggtacctaggtttaacgttcggtttacgttttaggaatttaccggggtacccgggttcccggggaaacccggtaaagggtacggttaccgggttcgggtaccg

SEQ ID NO: 113434 - DNA, 722 bp, Homo sapiens
  misc_feature: GYAE6OF01CAMP8.15.86.H09.1.454.CMB.1.raw
  modified_base (193)..(193): a, c, t, g, unknown or other
  misc_feature (193)..(193): n is a, c, g, or t
  modified_base (639)..(639): a, c, t, g, unknown or other
  misc_feature (639)..(639): n is a, c, g, or t
tcagtctacgtagccacgaccggtgctcgatttagtgctatagacttgggtttgggggagaggagccccagccttgggatccccaagtgttttcattcagtgatcaggactgaacacagagactcaccatggagttcgggctgagtcgttggttttccttgctgctatacgttaaagtgtcagtgtagagtgngaggtggtggaggtcggtaggggacgtccgtaggtaacggtccggtcgggggttacctagtacgtctcgtgtgtcgcctgtggtacttctacgtttacgaagtaagtggcgtggagttggtacggtttcggacccgtacggacggtccgtacggaaggggtaacgggtcggtggtaggttggttaggtaacctttaaaggaaaaagttaaaagtgaacgtaggtaacggaaataaagtacgtacgtacggtacgaacgtacggtaaaggaaacgagtactacgaactagtacctaagaagtaactaagtaactaacgaaaagtcggttagtaacgtagaaacgtaaagtaacaaacgagtaaccgaaaccgaaacggtacgaacgtaacgacgttacctaacgttaacttaacgactaaccgaacgtaattaacgggagtacgtanaacgtacggtaacgtaaacggtaagcggtactagttcgttagttagactcggtaccgggacgaacccggtagtaacgtgtcgg

SEQ ID NO: 113435 - DNA, 763 bp, Homo sapiens
  misc_feature: GYAE6OF01DIJ1B.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaacgccgtgggggtcccttagagtctcctgtgtcgcctcgtggtacttctacttctagtaagtggtcgtggtagtggtaggttcgggtccgccgtaggcctaccggaggggaaggggtcgtagggtagggttgggttacggttacgtttaacgtaaaaagttaaaagtgtaagtagggtagaaaagaaaagtaacgaacgttacggtacgaccgaacccggtaaggaaaggaagtactaccaacctactacgtacaaagtaagtaattaaacgtaaacgaaaaacggtcggtttaagttaagtttacgaaactaaagtaacggaaacaacggtaccctaaacggaaaaacccggagtaaccgaccgaacggtcccttaacttaactttaaccgtacgtaacccagtaagttaccggttaacggaagtcgaacgaacgttacgggaaacggttaaaaggcggttacttaagttcggttacttttaagagttacggttccgggtaacggggacccgtaagggtaaacgtggttcccggg

SEQ ID NO: 113436 - DNA, 857 bp, Homo sapiens
  misc_feature: GYAE6OF01BPEKU.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcttgggttttccttgctgctatcttaaaggtgtcagtgtgaagtgcaggtggtggagtcgtgggggagccgttaggtaaacgtccgtcgggggtcccttagacgtctccgtggtgtcggtcctcgtaggtacttctacgtttcagttaagtggtacgtggagtggtagttcgggtcccgacgacggtccgtaccggaaggggtaacggggacgtgggtaggttggggtttacgggtaacggtttaacgaaaaaggttaaaaacgtaggtaagttagggtaagaaaaggtaaaaagtaacggaaccgttaacgggtacgtacccggtaaacccggtaaggtaaaacgggaaggtaacctttaccgaaaccgttagttacctaacggtaaaagtaagtaaacgtttaaaccgttaaacgaaaaaccgggtccggtttaagttaacgtttaacgaaactaaaaggttacgaaaacgtagtaaacccgtaaacggaaaaaccggactaaccgaacggaccgttaacccgttaccgttaagttaacccgtagtaaacccaggtaagtaacgtttaccgggaagttcgaacgttaacggtacccggtaaaagggtaaacgggtacgttacgttaagttcggtttaacgtttaggtaaagttccggttacccgggaccggggttaacccggaagggttaaacccgtaaggggttccgg

SEQ ID NO: 113437 - DNA, 790 bp, Homo sapiens
  misc_feature: GYAE6OF01EH6T3.15.86.H09.1.454.CMB.1.raw
  modified_base (686)..(686): a, c, t, g, unknown or other
  misc_feature (686)..(686): n is a, c, g, or t
tcagtctacgtagccacgaccggtgctcgatttagtgctatagacttggggtttgggggggagaggacgcccccagccttgggactccccaagttgttttcattcagtgatcaggactgaacacagagactcaccatggagttcgggctgagtcgttgggtttttccttgctgtcttatacgttaaaaggtcgtaccagtgtagaagtgacgtagggttgggtggaggttcggtgggggacgttaccggttagggtaaaccggtccgggttcggggggttacccttaggtacgttcctccgtggtggtcggtccttcgtagtactttctacttcaagttagtggtagtggtattggtacggttccggaccgaccgtacggccgtaccgggaggggtacgggtcgtagggtaggttcgggttacggttaacgttaaacgaaaagttaaagtgtaacgtaggtaagaaagtaaagtacgtacgtacggtcgaccgtaacggaagaaacgatactacactatactaacgaagtaacttaagttaaacgtaaacgaaaggttacgttaagtttacttacgaaacgtaaactacgaaccgtaacgaacccgtaaacggaaaccgtaagaccaacgtaccgttaccttaagttacctacgtaaccgtaccaggttaactacggtacgactancggtaacgtacggtaaacgtaaggtcgtcttaagtttccgttagttagtacccggttacgggtcccggttaacccggggacttaacggtacgttcggtcccggg

SEQ ID NO: 113438 - DNA, 971 bp, Homo sapiens
  misc_feature: GYAE6OF01AT8VJ.15.86.H09.1.454.CMB.1.raw
  modified_base (181)..(181): a, c, t, g, unknown or other
  misc_feature (181)..(181): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtntccagtgtgaagtgcgaggtggtggaggtcgtgggggagtccgttagggtaaacgtccggtcggggggttcccttaggtacgtccgtccgtgtggtcggccttcgtggtacttctactttacagtaagtggcgtggagtgtaggttcggggtacccgccgacggcctaccggaagggggaacggggtcgtaggggtaggttggggttacggtaacggtttaaacgaaaaaaggttaaaaagtgggtaagttacgggtaagtaaaacgtaaaaagtacggtaaacgttaacgggtacgaacccgtaaacccggtaaggaaaaacgggtaagtaacttaccgaaccctaagttcctaaaacgaagtaaacgaaactttaaaacgtaaaccgtaaaaacgggttaccgggtttaagtttaacgtttaggtaaacccaaaaggttacgaaaccgtaaccgtaacccgggttaaaaggaaaacccgggaacgtaaccgaaaccgtacccgggttaacccggttaactttaaaccgttaccggttaacccgtaaaacccggtaacggttaacggttaaaccgggtttaaccggggttaaacggaccgtaaccggtaaaccggttaaccggggttaaaaaacgggttaaaacggggtaccggttaaaccgtttacgggtttaagtttacccggtttttaacgggaaaccttttacgggggttacccccggggttaaccgggggggaaacccccttaaacggggggttaaacccgttaagggggtttaccccccgggg

SEQ ID NO: 113439 - DNA, 1007 bp, Homo sapiens
  misc_feature: GYAE6OF01CVPXR.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtgggggatccgttagggtaaacgtccggttcggggggtcccttaaggtacgtccgttccgttgtcggtcggcccttcgtggtattcctactttcgaagttaagtggtacgtggtatggtacggttcggggtccccgaccgtacgggtaccgttaccgggaagggggtaacgggggtcgttggggtaacggggtttggggtttacgggttaaaccggtttttaaaacgaaaaaaaggttaaaaagttaggtaaggtttaggggtaaaggaaaacggtaaaaaaggttaggtaaaaccggttaaccgggtacggtaaccccgtaaaccccgggttaaagggaaaagggtaaaacggttacctttaacccgaaaccccttaagttaacccgtaaacggtaaaagggaaaacgttaaacgtttaaaacgttaaaacccgggtaaaaaacgggttaccggggttttaaagtttaaacggttttaacgaaaaccgtttaaaaaggttaacccggaaaaacgtaaacccgggtaaaccccgttaaaacggggaaaaaaacccccgggaggtaaaacccctaaccgggtaaaccggttaccccggtttaaactttaacggtttaaaccccgtacgttaaaaccccgtaaaccggtaaggtaaccggttttaaccgggaagtttccggaacttaaacgggtaaccggtaaacgggtaaaaggtcggtaaccgtttaagttcggtttacgtttagaacgttacgtccgggtacgggaaccctaagggaccgtaaggtttcccggg

SEQ ID NO: 113440 - DNA, 691 bp, Homo sapiens
  misc_feature: GYAE6OF01E34B1.15.86.H09.1.454.CMB.1.raw
  modified_base (647)..(647): a, c, t, g, unknown or other
  misc_feature (647)..(647): n is a, c, g, or t
  modified_base (660)..(660): a, c, t, g, unknown or other
  misc_feature (660)..(660): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttcctgctgctatacttaaaaggtgtccagtgtgagtgcgaggtggtggagtcggtgggggagtccgttaggtaacgccggtcgggggtccctaggtacgtcctccgtggtggtcggtcctcgtggtacttcctactttgaagtaagtggcgtggatggtaggttcggtccgacgacggccgtaccggagggggagggtcgtagggtaggtggggttacgtacggtttaacgaaaaagtaaatgagtaggagaaagaaagtagacgtacggtcgaccgtacggtaagaaaggtacgtactacgaactacgtactaacgaagtaataattaaactaaaccggaaaacggtggtttacgttaagttacggaaattaaagtaccgaacgtaacgtacgtaaacggaaaccgaggtaaccaacgtaccgtaccgtatacgttacctaacgtaccagtagtcgttacgatcgactaacgacgaaacgtaaggcgtntagttgtcgttanagttcgacgggtcggaccgaagtcgagtcgg

SEQ ID NO: 113441 - DNA, 935 bp, Homo sapiens
  misc_feature: GYAE6OF01BYP1I.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctgggttttccttgctgctatcttaaaggtgtcagtgtgaagtgcaggtggtggagtcgtgggggagtccgttagggtaaacgccggttcggggggttccccttaaggtacggttccttccgttggttcggtcggtcccgttcgttgggtactttcctaccgttttaccgtaagttaaagtgggtccgttagggtagttaggtaacgggtttcggggtccccgtacccgtacgggtcccgttaccccgggaaggggggtaaacggggggtccggttagggggtagggtttagggggtttacgggttaaaccggttttaaaccgtaaaaaaggtttaaaaaagttggtaaaggttagggtaaaggaaacggtaaaaaagttaacggtaaccggtacggtacggaccgtaacccgggtaaggaaaaggtaacgtaactttaccgaaccctacgtaccgtaacgtaaaggtaaactaagttaaacgtttaaaaccgaaaaaccgggtcgggttttaattaacgttttaacgaaacgttaaaagtaacggtaaccgtaaaccggacccgttaaaacgggaaaaacccggtacggtaaaccgaaccgtaacgggtccccgtttaaattaacggtttaacccgtaccgtaaacccgagtaacggttacgttaacgggacgtacgaccgtaagtacccgggtaaacgggtaaaaggtcggtacgttaagttcggtttacgtttagtaacttacggtcccggacggggacccttaacggggagtaacggtttccggg

SEQ ID NO: 113442 - DNA, 701 bp, Homo sapiens
  misc_feature: GYAE6OF01AI1O4.15.86.H09.1.454.CMB.1.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttcctgctgctatcttaaaaggtgtccagtgtgaagtgcaggtggtggagtcgtgggggagccgttggtaagccgtgggggtccttagngtctctgtgtggcctntggattcacttcagtaagtggctggatgnggttcgggccgcnggctcgagggaagggtcgtggtagtcggttggacgtttacgaaaagtaaaagtgtagtggtagaagaaaagtagaacgtacggtcgaccgaccggtaggaaacggaagtacgttacgaacctatactaacgaagaaggtaacttaaacgttaaccgaaaaacggtacgggttaagttaatttacggaaactaaaagtacggaaacgtacggacccgttaaaggaaaaacccgtagggaacctaacgacggtacccgttagttaacttacgtacgtaacccaacgtaacgtacgttacggaaagtgacctaaggtacgtaaaccggtaaaggtccggtattagttaggtcttttgaagttacgtccggtacggggaccccgtagggaacgtaagttcccggg

SEQ ID NO: 113443 - DNA, 757 bp, Homo sapiens
  misc_feature: GYAE6OF01BZ1RJ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagtccgttaggtaaagccgtgggggtcccttagagtctcctgtgtggcctcgtggattctactttcagtaatggctggatgagttcggccgccgaggctcgagggaaggggcgtgggaggtgggttggtacgtttaacgaaaagtaaaagtgtaagtagggtagaaagaaaagtagaacgttacggtacgaccgaacccgggtagaaaaggaagtacttaccaacctataccgtacaaaggtaacgtaattaaacttaaccgaaaaacggtacggttagttaactttagaactaaaagttacggaaacctaacggtaacccgtaaaggaaaaacccggaaggaaccaaccgtaacggtacccgtttaacttaacgtttaacccgtacgtaacccgaacgtacgttaacggttaaccgggaacgttcgaaccgtaacggtaccggtaaaacggtaaacgggacgtcgttaagtcggttaccttttaggaactttacgttaccgggtacggggaaccccgtaaggggtaacctaagggttccgggg

SEQ ID NO: 113444 - DNA, 645 bp, Homo sapiens
  misc_feature: GYAE6OF01AHQDK.15.86.H09.1.454.CMB.1.raw
  modified_base (395)..(395): a, c, t, g, unknown or other
  misc_feature (395)..(395): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatggagttgggtccgcaggctccgagggaaggggctggagtggttggacgtttacaaaagtaaaatgatggtagagaaaatagactaggtgcgaaccgagaaaggaanattcaccactctacaagtagaataaattacgaaaaacgtacggttagtaatttacggaactaaagtagaaaccaggaccctaaggaaaacccgaggtaaccacgtaacggaccgttacttaattaaccctacgtaaccctaagagtagtttaacggaacgtgacgtaagtaccgaaacggtaaaggaggtacctagttcgtgtttttagattacgtcggtacggggacccgtaagggacgtaagttcggg

SEQ ID NO: 113445 - DNA, 670 bp, Homo sapiens
  misc_feature: GYAE6OF01AMPQ9.15.86.H09.1.454.CMB.1.raw
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctcgtggattctactttcagtaatggctggatgtaggttgggtccgccgacggcctccgaggggaagggcgtggaggtgggttggtacgtttacaaaagtaaaangagtggtagaagaaaatagacgtacggngaccgaccgtagaaaggaacgatacacactactacgaagagtaataactacgaaaacgtacggtagttactttagaactaaagtacaaacacgtaccctaacgaaaaccggacgaccaaccgacgtaccttacttaagttccacgtaaccagtaagtaacgttacgggaatacgacgtaacgaccgtaaacggtaaagggacgtcttaagttgttacgttttacggaatttacggtccgggtaccggggaacccgtacgggtaagtacggttccggg

SEQ ID NO: 113446 - DNA, 732 bp, Homo sapiens
  misc_feature: GYAE6OF01BURGF.15.86.H09.1.454.CMB.1.raw
  modified_base (186)..(186): a, c, t, g, unknown or other
  misc_feature (186)..(186): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtntgcatctgccttgcgtgggacgcctgactcaagctcacctcgacctaccgtaagtagtgacgcactaccgaacctacacatacgaagtgtactacaacgagaacgaccgacgggaccgtaccccgtaagtactaataacgttaaggtaaaggtaaggtagtaggtagcggtaccgacgaaccgaaccgaaccgggaaggggaccggaccgtacccgagtcgtcttacgaggtcggtcctacgtacggttacgtcgggtaccgtacgtaccgtaccgtacctacccgaactactacccgtaccccgtaaccctaccgtacgtcgttacgacgtagttacggacgtcgtaagtacggtaactcgtaacgtggtacggtagagtaccgaccgtaactaacggtaacgtggtaaaccggtcggtaaacggttaaacgggtcgggggttaccgggtttcgggaccgggggtaaccgggtaaccggggtaacaacggggttacccgtacggggtaaccccgtaacgggttaccgggacccggtaaacccggg

SEQ ID NO: 113447 - DNA, 959 bp, Homo sapiens
  misc_feature: GYAE6OF01CV3PU.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctgggttttccttgctgctatacttaaaaggtgtccagtgtgaagtgcgaggtggtggagtcgtgggggatccgttaggtaaacgtccggtcggggggtcccttaggcgtcctccgtgtgtggccctgtggtattcctactttacgaagttaagtcggtacgttgggtaagttggtaacggtttcggggtcccgaccgtaacgggtcccgttaccgggaagggggtaacggggtccgttaggggtagggtttcgggggtttacgggtaaaccgttttaaacggaaaaaaaggtttaaaaagtgggtaaaggtttagggtaaacgtaaaagggtaaaaacgtacggtaaaccggttaacgggtaccggtaacccgtaaacccgggttaaagggaaaaacgggtaaacgtaacgtttaccgaaacccgtacgtttaaccgaaccgtaaaaggtaacgtaaaacgtttaaacgttaaaaaccggtaaaaaaccgggttcggggtttaaacgttttaaagtttaaccgggaaaaccttaaaaacggttaaccggaaaaaccgtacccgggttaacccgtaaaacgggaaaaaaccccgggtaggaaaccccaacgtaaccggtaccccgtttaacttaacgtttacccgtaacgtaaaccccgtaacgtaaggttacgtttaacgggaacgttcgtaacctaacggttaaacgggtaaacgggtaaaggcggttaacttaggttggtttacgttttaagagttttacccggtccgggtaacccgggcccggttaaagggacccgttaaggttccggg

SEQ ID NO: 113448 - DNA, 720 bp, Homo sapiens
  misc_feature: GYAE6OF01C699K.15.86.H09.1.454.CMB.1.raw
  modified_base (187)..(187): a, c, t, g, unknown or other
  misc_feature (187)..(187): n is a, c, g, or t
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccagtggagttcggggctggagtcgttgggttttccttgctgctatacttaaaaggtntccagtgtgaagtgctagggtggtggtaggtcgtggggagtcgttaggaagccggtggggtcctagngtctctgtgtgcctgtgattctacttnagtanggtactggatgtacggtggtccgcgagctacggaggggacgggntagggngttggtagacgtttaanaaaagtaaaangtagtaggtagaagaaaatgacgtaaggngtacaccggtaagaaaggaatacgtacacgatcaacgaaagtagaattaagtaaaccgtaaaaacggtaggttagttaagtttagaaactaaaagtacgaaacgacgtaacctaaacgggaaaaccaacggaactacgaacgttccgttaataccgttaacgtaccaaacgacgtaaggtaacttaacggtaaagtgaacccgttaaaggtaccggtaaagggtaaaagggtccgtaacgttaggttactttaacggttttacaaagggttttaccggaccgggtttacggggaaacccggacgttaaacgggtaacggtttccggg

SEQ ID NO: 113449 - DNA, 987 bp, Homo sapiens
  misc_feature: GYAE6OF01EAS7V.15.86.H09.1.454.CMB.1.raw
  modified_base (179)..(179): a, c, t, g, unknown or other
  misc_feature (179)..(179): n is a, c, g, or t
  modified_base (216)..(216): a, c, t, g, unknown or other
  misc_feature (216)..(216): n is a, c, g, or t
  modified_base (244)..(244): a, c, t, g, unknown or other
  misc_feature (244)..(244): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtntccagtgtgaagtgcaggtggtggagtcgtggggganccgttaggaagccgtgggggtccttagngtctcctgtgtcggcctcgtggtacttctactttcgagttaagtggctggtatggtaggtttcggggtcccgaccgagggtcccgtaccggaggggtaagggggtcgtaggggacgggtttgggggttcgggtaaacgtttttaaccgaaaaaaagggttaaaaaagttgggtaagttaggggtaggtaaaaacggtaaaaagttaacggtaaccggtaaaccgggttcgaacccggtaaaccccggttaaaggaaaacggggtaaacgtaacgtttacccgaaacccgtaaacgtttcccgtaaaccggtaaaaggaacgggtaaaactttaaaaaccgtttaaaaccggaaaaaaaacccgggttaaccggggttttaagtttaaacggttttttaaccggaaaaccgttaaaaacggtaacggtaaaaccggtaaaccggtaaccccggttaaaacggggaaaaaaacccccgggaagggttaaaccccaaaccgtaacccggggttaacccgtttaccgttaaaccgttttaaacggttaacccgtaaccccgtaaaccgtaacgggttaaaccgtttaaccggggtaagttacggtacctaaaacggtcccggggttaaaaaccgtaaaagggggtaccgttagttaacggttcggtttacccggttttaagtaacgttaccgggttccgggtacccggggtaaccccgtaaagggtcgtaaacggggtttcccgggg

SEQ ID NO: 113450 - DNA, 819 bp, Homo sapiens
  misc_feature: GYAE6OF01B7HS3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcttgggttttccttgctgctatacttaaaaggtgtcagtgtgaagtgcaggtggtggagtcgtggggagccgttaggtaacggccgtgggggtcccttagacgtctccgtgtgtcggcctgtggattctactttcagtaatggctggtagtaggtacggttcggggtcccgccgacggtccgtacggaacgggggaagggggtccgtggggtaggggtttaggggtttacgggtaaaccggttttaaagaaaaaaggttaaaaaagttaggtaaagttagggtaaacggaaaagtaaaaaagtacgggtaaacggttacggtacgtaccgtaaacccgggtaaaggaaaaggtaagtaacttaccgaactaacttacgtaaacaaaggaataagttaaacttaacgaaaaacggtcgttaagtttaattaagaacaaagtaacgaaaccgtagaacccgtaaacggaaaaacggtaccgaaaccgactaaccggtacctttaaccgttaactttacccggaaactaccctaaacgtaagttaacgttacgtaacgtccgaacgtaaggttaacccggaaagggtaaaggacggttaacctagtttcgttacgtttacgtaacgttagttacccggggacgggaaacccggaagggtaacctaggttccgggg

SEQ ID NO: 113451 - DNA, 861 bp, Homo sapiens
  misc_feature: GYAE6OF01CUUV3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtccagtgtgaagtgcaggtggtggagtcgtggggagtccgttaggtaaacgccgtgggggtcccttagagttccgtccgtgtgtcggtcctcgtggtattctactttcgaagttaagtggtctggtaagtggtaggttccgggtccgaccgacggtccgtccggaagggggaacggggcgttgggaggttggggttacggtaacggtttaaacgaaaaaagttaaaacgtgtaagttaggtagaaagtaaaagtagaacgtacggtacgaccgacccggtaaggaaaacggtaaagtactaccaacctataccgtaacgaaagtaagtaaacttaaacgttaaaccgaaaaacggtacgggtttaagttaacgtttaacgaaaaccgttaaagtaacggtaaaacccgtacggtaaccccgtaaaacggaaaaccccggaaggtaaacccaaaccggtaccgttaacccgttactttaaacgtttaaccgtaccgtaaacccgaacgttagggtaacgttaaccgggtaaggttcgaacccgttaacggttaaaccgggaaacggttaaaacgggagttaacccgttaagtttaccggtttaacgttttagtaaccggtttaccgtaccggggttaacccggggaacccgtaaaggggtaacccttaggggtttaccccgg

SEQ ID NO: 113452 - DNA, 778 bp, Homo sapiens
  misc_feature: GYAE6OF01C7WL7.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttggtaaagccgtgggggtcccttagagtctcgtgtgtggcctcgtggtattcgactttcaagtaagtggcgtggatggtaggttcggggtcccgaccgacgggcctaccggaagggggaacgggggtctgggagggttcggggttaggacgtttaacgaaaaaggtaaaatggagttagggtagaagaaaagtaggacgtacggtacgaccgaacccggtaaggaaaacgggtaacggtaattaccgaacgtaactccgttaaacgaagtaacgtaattaaaacgttaacgaaaaacgggtcggtttagtaatttacgaacctaaaagtcgaaaccacggtaacccgtaacggaaaacccggtaggaccaaaccgtggtaaccccttattaaaccgtttcgtaacccgtaaccaaacgtaacggtaacggtttaacggaaacgtcggtaacctaaaggtacccggtaaacgggtaaaagggacggtttacctagtacggtttctttagacgtttagtccggggacgggtacccaaggggtacctagggttcccggg

SEQ ID NO: 113453 - DNA, 894 bp, Homo sapiens
  misc_feature: GYAE6OF01CPXAG.15.86.H09.1.454.CMB.1.raw
  modified_base (739)..(739): a, c, t, g, unknown or other
  misc_feature (739)..(739): n is a, c, g, or t
  modified_base (784)..(784): a, c, t, g, unknown or other
  misc_feature (784)..(784): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttcctgctgctatacgttaaaaggtgtccagtgtgaagtgcgagggtggtggagtcggtgggggagtccgttagggtaaacgccggtcgggggtcccttaaggcgtcctccgtggtggtcggccttcgtggtacttctacctttacgaagttaagtggtcgtaggattgggtaggttcggggtcccgaccggtacggccgtacggaagggggacggggtacgtggggacggttggggttaggtaaccggttttaagaaaaaaggttaaaatggtaagttaggggtaagaaacggtaaaaagtggtaaccgtaacgggtacgaccggtaacccgtaaggaaaaggactacgttaccaacgtactactaacgaaagtaacgtaattaacgtaaacgaaaaacggttcgggttaagttaagtttacgaaacgttaaaacgtaggaaaaaccgtcggtaaacccgtaaaacgggaaaaaaccccggcggaaacccaaccggtaccgtaaccccggtttaacttaaacgtttaacccgtaaacccgtaacccgaaaaggttcccggttaaaggtaccccgggttaaanaccggtacgttaaaccggtaacccgggtaaaaccgggtaaagggnggtttaaccgttaggttttacggtttaccggttttaagaaacggttcggttcccccgggaaacggggggtaccccctaaaggggttaacccgttaagggtttccccgggg

SEQ ID NO: 113454 - DNA, 899 bp, Homo sapiens
  misc_feature: GYAE6OF01CWPV4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtccagtgtgaagtgcgtaggtggtggaggtcggtgggggagtccgttagggtaaacgccggttcgggggtcccttaggtacgtcctcctggtgtcggcccttacgtggtacttctactttcgaagttagtggcgtggtagttggtaggttcggggtccgaccgtacggcccgttacccgggaagggggaacgggggtccgtagggtacgggttaggggttacgggttaaaccgtttaaacggtaaaaaaggttaaaagtgggtaagttagggtaagaaaaggtaaaacgtacggtaaccgttacgggtaccgaacccgtaacccgggtaaggaaaaagggtaactaacgttaccgaaccctagttaccgaacgtaaacggtaaacgtaaacttaaacgtttaaaccgaaaaaaccggggttcggtttaagtttaacgtttacgaaaccttaaaaggtaacgaaaaccgtcggtaacccgtaaaggaaaaacccccggaggaaacccgtaacgtaacccgtacccggtttaactttaacgttaacccgttacgtaaaccccaaccgttagttaaccggtaacggtaacgttcgaaccgttaaccgtaaacgggtaaacgtaaagggtccggttaatacggttagtttccgttttaggaaaccgttttcggtcccggggttaaccggggaccctaaacgggggaaccttacgggttccggg

SEQ ID NO: 113455 - DNA, 878 bp, Homo sapiens
  misc_feature: GYAE6OF01DJ8BS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaaggtgtccagtgtagaagtgcgagggtggtggagtcggtgggggagtccgttaggtaaacggtccggttggggggtccccttagacgttccgtccgtggtgtcggtcctcgtggtattctacttcgagtaatggcgtggactggtacggttcgggtcccgccgacgggctacccgggagggggaacgggggtcgtggggtagggtttgggggttacggtaacggtttaaagaaaaaaggttaaaagtggtaagtagggtaacgaaagtaaaagtacgacgtaacggtacgaccgtaacccggtaaggaaaaggtaacgtacttaccgaactacgtaccgtaacgaaaggtaaactaaactttaaacgtaaaccgtaaaaacggtacgggtttagttaactttacggaaactaaagtacggaaactaccggtaccctaaaggaaaacccgggtaggaacctaaccggtaacgtcccgtttaacttaacgttaacccgtacgtaaacccgtacggtaaggttaaccggtttaaccgggtaaggtccgtaaccggtaaacgttaaccggggaaaacgggttaaacgggacggttacccgtttagtttacccgggttttaactttttaacggaagttttaaccgggttcccgggggtaacccggggtaaccccggtaaacggggtaaacgttaccgggtttcccgggg

SEQ ID NO: 113456 - DNA, 740 bp, Homo sapiens
  misc_feature: GYAE6OF01DX9PA.15.86.H09.1.454.CMB.1.raw
tcagtctacgtagccacgaccggtgctcgatttagtgctatagacttgggtttgggggggagaggagccccagccttgggatcccccaagttgttttcattcagtgatcaggactgaacacagaggactcaccagtggagttcgggctgagtcgttgggttttccttgctgctatacgttaaaaggtcgtccagtgtgaagtgcgtaggtggtggagtcgtggggacgtccgttaggtaacgtccggtcgggggttcccttaggtacgtccgtccgtggtgtcggcctgtggtacttcgtactttcgtagttaagtggcgtggtagtaggtcggttcgggtcccgacgacggtccgtaccggaaggggacggggtcgtaggggtaggtttggggttacggttaaccgtttaaaacgtaaaaaaggtaaaagtggtaagtagggtaagtaaagaaaagtacggaacgtacggtacgaccgtaacccggtaaggaaacggtaagtacttaccaactactacgtaacgaagtaacgtaacttaaaacgtaaccgtaaaaacgtcggttagttaagttaacgaaactaaagtaacaacgtaacgaccgtaaacgaaaccgacaccgacgtactcccgttataactacgaaccgtaacagtagtagtacggaatgacgaacgtcggaaaagtaggacgtcttaagttgtacttagatacgtcggacggacctaggactgggttcg

SEQ ID NO: 113457 - DNA, 700 bp, Homo sapiens
  misc_feature: GYAE6OF01BKL5Q.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatggagttgggtccgcaggctccgaggggaggggctgggagtgggtggacgtttacaaaagtaaaatgaatggtagaagaaaatagacgtacggtgacgacccgtaggaaaggaagtacttacacctatctacaagagattaattacgaaaaacggtacggttagttaatttagaactaaagtacgaaacacgacctaacggaaaaacccgaggaacccacgacggtacccgttacttaactttaaccgtacgttaacccaagtacggtagttaccggggaatcgaactacgtaccggtaaacggtaaaagggtacggtacgttaagtttacggttctttttaggaactttaacggttcccgggttacggggggacccccgtaaggggtaaacccgttaagggtttccgggg

SEQ ID NO: 113458 - DNA, 853 bp, Homo sapiens
  misc_feature: GYAE6OF01EW61V.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggacctcaccatggagttcgggctgagcgttgggttttccttgctgctatacgttaaaaggtgtccagtgtagaagtgcgaggtggtggagttcggtggggatccggttagggtaaacggtcccggttcggggggtacccttaaggtacgttccgtccgttggtcgtcgggtcctgtggtattctactttcaagtaagtggcgtggatggtaggttcggtcccgacgacggccgtaccgggaaggggacgggtcgtagggtagggtttcgggttaggttaaccgtttaaacgtaaaaaaggttaaaactgtaaggttacgggtaaagtaaaagtaaaaacgtacgtaacggtaacggtaccgtaaccgaaccggttaaaggaaacggtaagtaacttaccgaactaacgtacctaacgaagtaaacgtaaacgttaaacgtaaaaccgaaaaacgggtttcgttaagtttaacttaacggtaaactaaaagtacgaaaccgtaacgtaaccgtaaacggaaaaccggtacgtaaccaacccgtacgtccgtttaaactaacttaccgtaaccgtaaccgtacggtaacgttaggttaacgtaacgttacgaaccgttaaaggtaccgtaaaaacgggttaacgggtaacgttcgttaacgttcgttttaaacgtagttaacgtcgggttaccggacccgggttaaccggtaagtacggttccggttaccggg

SEQ ID NO: 113459 - DNA, 626 bp, Homo sapiens
  misc_feature: GYAE6OF01A3HUD.15.86.H09.1.454.CMB.1.raw
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
  modified_base (464)..(464): a, c, t, g, unknown or other
  misc_feature (464)..(464): n is a, c, g, or t
  modified_base (571)..(571): a, c, t, g, unknown or other
  misc_feature (571)..(571): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttccgtgacgtgctatcgtaaagtgtcagtgtgaagtgcgaggtggtggagtcgnggggganccttggtaagcccgtggggggtacccttagagtctcctgtgtcgcctgtggnttcactttnagtatggctggatgngttggtccncaggcctccgagggaggctggagtggttagactttanaaaagtaaatgagtggtagaagtaaatagacgtacggtgaccgaccgtaggaaacgaagtcttacaccagtactacgaaggactaattataacgaaaacgtcgtagttactttacgaataaagtanaacgtacaccgtaagaaacggagaaccacggtacgtccgttacctaagttacgtaccgaacctagaaggttgttaacggagtcaccgagtaaccggaggtaaacggnggtctaattccgtatttacgattacggtcgtacgggacccgaggtatacggtcgg

SEQ ID NO: 113460 - DNA, 867 bp, Homo sapiens
  misc_feature: GYAE6OF01B7RTW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcttgggttttcctgctgctatacgttaaaaggtgtccagtgtgaagtgacgaggtggtggtagtcgtgggggacgtccgttagggtaaacgtccggttcgggggtaccttagacgtctccgtgtgtcggcctgtggtattctacttcgagtaatggctaggagtggtacggttcgggcccgccgacggtccgtaccggaaggggacgggggcttaggggacggttggggttacggtaacgtttaacgaaaaagttaaaagtggtaagtagggtagaaagtaaaagtacgacggttacggtacgaccgtaacccggttaaggaaaacgggtaacgttactaccgtaacctagtaccgtacgtaaagtacgtaagttaaaccgttaacggaaaaccggtttacgggttattaacgtttaaccggaaacttaaaacgtcggtaaaacccgtagtaaccccggttaaaagggaaaaacccccggtacgggtaacccgtaacccggtaccgggttaacccccgtttaacgtttaaaccggttttacctaaccggtaacccctaaagggtaccgttaaacgggtttaaccggtaaacggtccgtaacggtaaccggttaaacgggtaaacccgttaaaagggcggttaactttacgggttacgtttactttacggaacgttacgttccggggacccgggtaaccgtaggacgttacggttcccggg

SEQ ID NO: 113461 - DNA, 709 bp, Homo sapiens
  misc_feature: GYAE6OF01DA080.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctggttttccttgctgctatacttaaaggtgtcagtgtgaagtgcgaggtggtggagtcgtgggggagtccgttagggtaaaggtccggttcggggggtcccttaggtacgttctccgtgtgtcggccttcgtggtattctacttcagtagtggtcgtggatggtaggttcgggtacccgccgtaggccgtaccggaggggacgggggtcgtagggtagggttggggttacggtaacggtttaacgtaaaaaagtaaaacgtagtagttaggagtaagtaaaagtagaacgtacgtgaccgacgtagaagaatatcacatacacgaagagaatactaacgaaacgtagtagttattagactaaatagaactacgacgtaaacggaaacccgagtaccaacgtaccgtaccgtagttaacttacgtaccgtaacacgtagacttaacgggtaactggaactacgggtaaacgaaacggttaacgggagttacgttaacgttggtttactttaggaagttcggttacgggtaacgggaccctaaacggggacttaaggttcggg

SEQ ID NO: 113462 - DNA, 923 bp, Homo sapiens
  misc_feature: GYAE6OF01DJMZD.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttaggtaaacgccggttggggggtccccttagacgtcctccgttgtgtcggtcctcgtggattctactttcaagttaatggcgtaggatggtaggttcgggtccgccgaggcctaccggaggggaaggggtcgtgggaggttgggttcggtaacgtttaacgaaaaagtaaaagtgtagtagggtagaaaagtaaaagtagtaacgtacggtacgaccgtaaaccccggtaaggaaaaagggtaagtaacgtttaaccaacccgtaatttacccgtaacgaaaaaggtaacgtaaacgtttaaaacgtttaaaacccgtaaaaaaacgggtaccgggttttaaagtttaaacgttttaacgggaaaccttaaaaagttaacgggaaaaacccgtaacgggtaaccccgttaaaacgggaaaaaaaccccggaaacggggaaaccctaacccgtaaccgggttaacccccgtttaacgtttaaacgttttaaaccccgtacccggttaaaacccgtaaacggtaacggtaaacgttttaacccgggaaaggttacgaaacccgttaacggtaaccggttaaaaccgggtaaaaaggggcggttaaacgttaacgtttggtttacctttttaaggaacgttttacggtccggggttaacccgggggtaccccgaaaggggtaaccgtaaagggtttccgggg

SEQ ID NO: 113463 - DNA, 970 bp, Homo sapiens
  misc_feature: GYAE6OF01BNRD3.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtcagtgtgaagtgcgaggtgggtggaggtcggtgggggacgtccgtttagggtaaacggccggttcgggggggttcccctttaaggtacggttccttcccgttggttggttcgggtcccttcgttgggtactttccgtacctttttacgaagttaaagtgggtcgttagggaagttgggtagggtttcggggtaccccgtcccggtacgggacccgttacccgggaagggggggaacggggggtccggttagggggtagggggtttcggggggttttacggggttaaaccggtttttaaaacggaaaaaaaagggtttaaaaaagttgggtaaaggttaggggtaagtaaaaggtaaaaaagttaacggtaaaccggttaacgggtacggaacccggtaaaccccgggttaaaggaaaaacggggtaaagtaaccttaccgaacctaacgttacctaacgaaaaggaagtaaactttaaaacgttaaaccggaaaaaacgggttcgggtttaagtttaagtttacgaaaacgttaaaaagttacggaaaaccctaacggaacccgttaaacgggaaaaaacccggtcggaaacccaacggtaaccggttacccctttaagttaactttaaccgttacgtaaaccccaagtaacggttaagtttacccgggaaaggttcgaaccgtagttaaccgggaaacggttaaaagggcgttacgttattgggttacttttaggaacttaccggttacgggtaccggggtacccaaggggtacctaaggttcccggg

SEQ ID NO: 113464 - DNA, 828 bp, Homo sapiens
  misc_feature: GYAE6OF01CM4O6.15.86.H09.1.454.CMB.1.raw
  modified_base (247)..(247): a, c, t, g, unknown or other
  misc_feature (247)..(247): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttggtaaagccgtgggggtcccttagngtctcctgtgtcggcctctggattctactttcagtaatggctggatgtaggttcggtccgccgaggccgtccggaggggaacgggggctgggaggtggggttggtaacgtttaacgaaaaaggtaaaaatgaagttaggtagaaagtaaaagtacgaacgtacggtagaccgtaacccggtaagaaaaacggaagtaacttaccgaacctaactacgtaacgaaaaggtaacgaaactttaaacttaaaccggtaaaaaaaccggtcgggtttaaacgtttaaaggtttacgtaaacgtaaaaacgtttacggaaaaccgtaaccggtaacccggttaaaaacgggaaaaaccccggtaacgggaaaacccgtaacccgtaaacgggtaccccgtttaactttaaacccggttttaaccgtaaccggttaaacccctaaacgtaggttaaccgttaaccgggtaaggtacgaccgtaacgtaacggaaaccggttaaaggacggtaccgttagttcggttaccgttttaggtaacttacgtcggttacgggccgggtaaagtaccggtaagttacccgggg

SEQ ID NO: 113465 - DNA, 777 bp, Homo sapiens
  misc_feature: GYAE6OF01DD305.15.86.H09.1.454.CMB.1.raw
  modified_base (200)..(200): a, c, t, g, unknown or other
  misc_feature (200)..(200): n is a, c, g, or t
  modified_base (615)..(615): a, c, t, g, unknown or other
  misc_feature (615)..(615): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagtcgttgggtttttccttgctgctatacttaaaaggtgtccagtgtgagtgngaggtggtggagtcgtggggagtccgttaggtaacgtccggttacggggggtccccttaggacggttcctccgttggttcgtcggtccttcggtggtacttcctacgtttacgtaagttaagtggcgtggtagttggtaggttcggtccgccgaggccgtccggaggggacgggcgtgggtagggttgggttaggtaaccgtttaagaaaaaggttaaagtaggtaagtaggtaagaaagtaaaagtacggaacgttacggtacgaccgaaccggtaaggaaaggaagtactaccaacgtactacgtaacgaaaggtaataacgttaaacgtaaaccgaaaaccggtcgggtttatttaaactaacggaacttaaagtacgaaaaccggtcgtaacccggtaaaggaaaacccgnggaccaaccggtacttcccggttaacttacgttaaccgtacggtaaccctaagtcggtaaccgttagggaacgttgaacttaacgtacgaaacgggtaagcggtacttaaggttgttacttagagttcggtaccggccgggtacaaggtcctggttacccgg

SEQ ID NO: 113466 - DNA, 805 bp, Homo sapiens
  misc_feature: GYAE6OF01C0289.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtggggagtccgttaggtaaagtccgtgggggtcccttagtacggtccttccgttggtggtcggcctcgtggtattctactttacagtaatggcgtggatgtaggttcggtccgccgaggctacgagggaaggggctggtaggtgggttacggtacgtttaactaaaaagtaaaatgtagtaggtagaagtaaaaagtgtaacgttacggacgaccgtaacccggtaaggaaaagaaggtacttaccgaacctagtacccttaacgaaacggtaagtaattaaacttaaccggaaaaacggttacgggttagttaatttacgaactaaagtacggaaacacgtacctaaacggaaaaccgacgaaccgacgaccgtaccgttaccttaacttaacgtcgtaaaccgtaacgtaacgtaacgttaccgggaagttccgaacgttacgttaaaccgggtaaaaccggtaaaacgggggacggtttaaccgtaaggttttacggtttaccgtttttaaaggttaacccgtttacgttaccggggttacccgggggaccccgttaaagggggaaccgttttaaggggtttaacccgggg

SEQ ID NO: 113467 - DNA, 798 bp, Homo sapiens
  misc_feature: GYAE6OF01BNO6S.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacaacagaggactcaccatggagttcgggctgagctgggttttcctgctgctatcttaaaggtgtccagtgtgaagtgcaggtggtggagtcgtgggggagccgttggtaaagccgtgggggtcccttagagtctcctgtgtcggcctctggtacttcctactttcagtaactggtctggatggtacggttcggggtccgcgacggctccggagggggaaggggcgtcgggtaggtggggttacgggtaacgtttaacgaaaaaggttaaaaatggtacgttagggtaaggaaagtaaaagtaggaacgtacgggtcgaccgtaacccggtaaggaaaacggtaggacttacgaactagtactacaaagtagtaactaattaaccgaaaaacgggtcgggttaagttaagtttacgaaactaaaacgtacgtaaacggaaccggtaacccgttaaaggaaaacccgggaacggaacctaaccggaacgtaccccggtttactttaagttaacccgtaaccgtaaacccgaacgtaaggttacggtttaaccgggaagttcccggaacgtaaggtaccggaaacgggttaaagggacggttacttaaggtttggttaccgttttaggaacctttagtccgggttaacgggggacccgtaaaggggtactaacgggtttcccggg

SEQ ID NO: 113468 - DNA, 772 bp, Homo sapiens
  misc_feature: GYAE6OF01DLDNW.15.86.H09.1.454.CMB.1.raw
  modified_base (287)..(287): a, c, t, g, unknown or other
  misc_feature (287)..(287): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcaggtggtggagtcgtgggggagtccgttaggtaaacgccgtggggggtacccttaggagtctcctgtgtcggtcctcgtggacttcactttanagtaagtggcgtggatggaggttcgggtcccgccgaggcctaccggagggggaaggggtctaggggaggtttggggttacggtaacgtttaacgaaaaaaggtaaaaagtgtaagtagggtagaaagtaaaacgtagaacgtacggtacgaccgaacccgtaaggaaaacggaagtaacttaccaacctagtactaacgaaagaacgtaattaaactaacgaaaaacggtcggttaattaagttacgaactaaagtaacgaaacacgtaacgaacggaaaaccggacgaaccgaacgtacgaccgttattaacgttaactagtaaaccaacgtagtaggttaccggaaagtcgaacgtaacgttaaaccgggtaaacggtaaacgggtacggtaacttaaggttcggtttacgttttaaggtaacgttaacggtacccgggttaacggggaccccggtaaagggaaccgttaaagggttcccggg

SEQ ID NO: 113469 - DNA, 700 bp, Homo sapiens
  misc_feature: GYAE6OF01A3QKV.15.86.H09.1.454.CMB.1.raw
  modified_base (528)..(528): a, c, t, g, unknown or other
  misc_feature (528)..(528): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaacgccgtgggggtcccttagacgtctcctgtgtggcctctggtacttcactttcgagttaagtggtctggatggtaggttcgggtccgcgaggtcctaccggaggggaacggggcgtgggaggttggggttaggtacgtttaacaaaaaggtaaaatgaagtggtagaagaaaatagacgtacggtgacgaccggtagaaagaagacttacgactatctacgaagagtaataaataacgaaaaacgtggttattaagtttagaactaaagtcgaaaccgagacccgtaaaggaaaacccgngtaaccacgaacgtcccgtactaagttaccgtacgtaaccagtaacgtacgttacggaacgtcaccgtaagtacccggaaaggtaaaaggtcggtattaaggttacgtttcttttaaggaattcgttaccggggtacgggaaccccgaaggggtaacctaagggtttccggg

SEQ ID NO: 113470 - DNA, 810 bp, Homo sapiens
  misc_feature: GYAE6OF01BU7F3.15.86.H09.1.454.CMB.1.raw
  modified_base (754)..(754): a, c, t, g, unknown or other
  misc_feature (754)..(754): n is a, c, g, or t
  modified_base (771)..(771): a, c, t, g, unknown or other
  misc_feature (771)..(771): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagcgttgggttttccttgctgctattacttaaaggtctccagtgtgagtgcgtagggtgggtaggagtcgtgggggacgtccgttagggtaaacgccgggttcgggggttcccttaggacgttctccgtggtcgtcggtccttacgtggtacttcgtactttacgagtaagtggacgtaggatagggtacggttcggtcccgaccgtaggtccgtaccgggaagggggtacggggcgttaggggtacgggtttcggggttacgggtaacgttttaaacgaaaaaggttaaaaagtcggtaacgttagggtaacgtaaaggtaaaacgttacggtaacggtacggtacggtaaccggtaacccggtaaaggaaaagggtaacttaaccgttaccaacccgtacttacccgtaagaaagaacgttaacttaaacgtttaacgaaaaacggtttcgttaagttaacgtttaagaaactaaagttacgaaaccgtacggttaacctaaacggaaaccggacgaaccacggtaaccgttaccgttaattacgtacctaacgtaccagtaacgtagttacggagtacatacggtaagtaaacggtaagcggtnttaggttctttagttanagttacgtcccggagggtacccagggtactcggttacgg

SEQ ID NO: 113471 - DNA, 783 bp, Homo sapiens
  misc_feature: GYAE6OF01BQS8M.15.86.H09.1.454.CMB.1.raw
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
  modified_base (612)..(612): a, c, t, g, unknown or other
  misc_feature (612)..(612): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggttttccttgctgctatacgttaaaaggtgtccagtgtagaagtgcgaggtgggtggagtcggtgggggagtccgttagggtaaacggccggttgggggggttacccttaaggtacggtccttccgttggtggtcggcctcgtggtattctactttcaagtaatcggntggatggtaggttcgggtccncgaggcctaccggaagggggaagggcgtagggacggttggggttaggtaacgtttaacgaaaaaaggtaaaagtggaagttagggtaagtaaaacgaaaaagtacggaacgtacggtacgaccgtaacccggtaagaaaaggtaataacgttacaacctaagtactaacgaaagtaacgtaaattaaacgtaaccgaaaaacggttcggttaagttaatttacggaaactaaaagttcgaaaacgacgtaacccgtaaggaaaaaccggngaaactaccgacgtacccgttaacttaacgttaccgtacgtaaccgaacgttaggtaacgttaaccgaaggttacgaccgtaaggtaaccgtaaacggtaaaagggtgtaccttaaggttcgttacttaagacttgccgggtacgggaccctaagggtaactaggtccggg

SEQ ID NO: 113472 - DNA, 693 bp, Homo sapiens
  misc_feature: GYAE6OF01B9766.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctctgtgtggcctctggattcactttcagtaatggctggatggagttcgggtccgcgaggctccggaggggaacgggggctgggaggttgggttggacgtttacaaaagtaaaatgagtggtagaagaaaatagacgtacggtcgacgaaccggtagaaaggaatacttacacatctacgaagagaataactaaccgaaaaacggtacggttagttaagtttaggaactaaaagtagaaaccacggtaccctaaaggaaaaacccggaggtaaccgaaccgtaacggtcccgtacttaactttaaccgtaccgtaaccctacgtaaggtaacgtttacgggaagtcgactaaggtacggaaaccggtaaaggcggtacttagttggttcttttagaattcggttaccggtacggggaaccccaggggtaaccgtaaggttcccggg

SEQ ID NO: 113473 - DNA, 813 bp, Homo sapiens
  misc_feature: GYAE6OF01E1313.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttggtaaagccgtggggggtcccttaggacgtctcctgtgtgcctcgtgtattcactttcagtaagtggctaggatggtagttcggggtccgtaccgacggctaccggaggggaaggggtcgtagggtaggttcggggttggtaaccgtttaacgaaaaagtaaaaaagttggaagtgggtaagaaagtaaaagtaggtaccgtaaggtacgaccgaacccgtaaggaaaaggtaagtacgttaccaacgtaactacgtaacgaaagaacgtaattaaaccgttaacgaaaaaaccgggttacggtagtttaagttttacgaaacgtaaaacgtacggaaaactaaccggtaacccgtaaaacgggaaaaaacccggacgggaacccaaccggtaaccggtaccccgtttacgttaaactttaccggttaaccgtaaacccgtaacgtaaacgtttaacggttaaccgggtaaacggtacgtaacgtaacgtaaccgggtaaacggtaaaaggcgggtacttaggttacggttcgttttagaacgttagtccggttaccggggacccgtaagggtaactaacggttccggg

SEQ ID NO: 113474 - DNA, 728 bp, Homo sapiens
  misc_feature: GYAE6OF01CT4WW.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatggagttgggtccgcgaggctccgagggaaggggctggaggtgggttggacgttttacgaaaagtaaaatgatggtagaagaaaatgactacggtgactacccgtagaaaaggaagattacaacgtatacttacgaaagaacgtataaacttaacgaaaaacggtacgggttagtaacttttagaactaaaataggaaacctaaggacccttaaggaaaaacccgacggtaacaaccgaacgacccggtaccttaaggtttaaaccctaggttacccgaaccgtaggtaacgtttacgggaaacgttgcgtaaacgttaccggaaacgggttaaaaagggacgggtacctttaaaggtacgttccgtttttaggtaacctttaggtaccggtttacccgggggacccggtaacgggggaaactaaaccgggttcggggg

SEQ ID NO: 113475 - DNA, 655 bp, Homo sapiens
  misc_feature: GYAE6OF01AMM9B.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctcgtggattcactttcagtaatggctggatggagttcggggtccgccgaggcctccgaggggaaggggctggagtgggtggacgtttacaaagtaaaatgatggtagaagtaaatagacgtacggtgcgacccgtagaaacggaagtactcaacctatctacaaggaagtataacttaacgaaaacggtggttagttatttacgactaaagtagaacacgacctaaggaaaaccggaggtaacacgacgtaccgtacttaattacctagtaacccacgtaagtacttacgggacgtcgacgacgtacggtaaaccgggtaaaggacggtcttaggtagttccgttttagatttacgtccgggtacgggacccggaaggtacgtaggttaccggg

SEQ ID NO: 113476 - DNA, 605 bp, Homo sapiens
  misc_feature: GYAE6OF01A5LKZ.15.86.H09.1.454.CMB.1.raw
  modified_base (530)..(530): a, c, t, g, unknown or other
  misc_feature (530)..(530): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagcctgggggtcccttagagtctcctgtgtggcctctggattcactttcagtatggctggatgagtgggtccgcaggctccaggggaaggggctggaggtgggttggacgtttacgaaaaggtaaaatgatggtagaagaaaataggactacggtgcaacccgtaggaaacggagattcacatctacaagagaataatacaaaacgtcggtatagttagacaaatgaactaagaccgtaacgtaaaacccggagaacaacgacgaccgtacttacttactcgtaccaacagtacttacggaagtnactatcggaaaccggtaaggacggtctagtacgttcgtttagattacgtcgtacggggacccagggactagtcgg

SEQ ID NO: 113477 - DNA, 780 bp, Homo sapiens
  misc_feature: GYAE6OF01DQDIC.15.86.H09.1.454.CMB.1.raw
tcagtctacgtagccacgaccggtgctcgatttagtgctatagacttgggtttggggggggagaggagccccagccttgggatccccaagtgtttcattcagtgatcaggactgaacacagaggactcaccatggattcgggctgagctggtttcctgctgctatacgtaaaggtgtccagtgtcgagtgcaggtggtggacgtcggtgggggatccgttaggtaacgccggttcggggggtacccttagacgttcctccgtggttacgtcggccgttcgtggtacttctaccgttacagtaacgtcggcgtggagtggtacggttcgggtaccgcgacggtccgtccggaaggggggaaggggtcgtgggtagggttcggggttaacggtaccgtttaaacgaaaaaggttaaagtaggtaagtacgggtagaaagtaaacgtacggtacggtacggtcgaaccgtaacccggtaagtaaaacgggtaatacgttaccaacctagtacaacgaagacgtaataacgtaaacgaaacggttcggttattaaccgtttagaactaaagtacgtaaccgaacgtaccgtaaaggaaaacccggcgaacctacgaaccggtccgttaacttaacgtcgtaacggtaacacggtaagtacgttacgggaatcgtacgaaccgttacgggaaacgttaaacggacggtactaggttcgtttaccgtttaggaacgttaacccggttcgggtaccgggacccggtaggtaacggttcggtccgggg

SEQ ID NO: 113478 - DNA, 879 bp, Homo sapiens
  misc_feature: GYAE6OF01CIV0P.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttcctgctgctatacgttaaaaggtgtccagtgtagaagtgcgaggtggtggagtcggtggggacgtcgttaggtaaacgtccggtcgggggtcccttaggacgttcctccgtggtcggtcggccgttcgtggtattcctaccttttagaaggttaagtcggacgtagggtaagttcggtacgggttcggggtcccgaccgacgggtccgtaccggaagggggtaacggggtcgtaggggtaggttggggttacgtaacggtttaaaacgaaaaaaggttaaaagtggtaaagtagggtaaacgaaaagtaaaaacgtaggtaaccgttaacgggtacgaacccggtaaacccgggtaaaggaaaaacggtaacgtaacgttaaccgaaacccttaacgtaaccgtaaacggtaaaagaacgttaaaagttaaaccgttaaaacggtaaaaacggttacgggttaagtttaacgtttaaacgaaactaaaacggttaacgaaaaccgtaacggaacccgtaaaacgggaaaaacccggaacggaaaccaaccggtaaccgtaccgttaactttaaacgtacccgtaacgtaaccgaaacgtaacgtaaccggttaagaaggtcgaacgtaacggtaacggtaaaacggtaaggacgttactagttaccgttagtttacgagttaccggtacggtacggggacctaagggacgtaaggttccgg

SEQ ID NO: 113479 - DNA, 660 bp, Homo sapiens
  misc_feature: GYAE6OF01AO9XH.15.86.H09.1.454.CMB.1.raw
  modified_base (357)..(357): a, c, t, g, unknown or other
  misc_feature (357)..(357): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctcgtggattcactttcagtaatggctggatggagttgggtccgcaggctccgaggggagggctggagtgggttggacgtttacgaaaagtaaaangtagtaggtagaagaaaatagacgtacggtgaccgtaacccgtaggaaaggaacgtacttacgaacctatacgtacaaaggtacgaattaacgttaacgaaaacgtcggttagtatttaggactaaagtcgaacagaccgtaacgaaaccgaggaccaacgacgtaccgtacttacgttaccgtacgtaaccatagtacgttacggaacgttacgacgagttaccggaaacgtaagggacggtcttaagtgttaccttttagatttacgtcggtacggggacccgtaagggactagggttcgg

SEQ ID NO: 113480 - DNA, 715 bp, Homo sapiens
  misc_feature: GYAE6OF01CPYTO.15.86.H09.1.454.CMB.1.raw
  modified_base (333)..(333): a, c, t, g, unknown or other
  misc_feature (333)..(333): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttccttgctgctatcttaaaaggtgtccagtgtgaagtgcaggtggtggagtcgtgggggagccgttggtaaagccgtggggggtcccttagagtctcctgtggtggcctctggattcactttcagtaatggcgtggatgtaggttcgggtccgccaggctccgaggggaaggggctggnggtgggtggacgtttacgaaaagtaaatgatggtagaagaaatagactacggtgacaccgtagaaagatactcgaccatcctacaagagaattaacttaacgaaaacgtcggttataagtttagactaaaagtgaaacgacgtaccgtaacggaaaaccgacggaaccaaccgtaacggacccgttaaccttaacgtttaccgtacgttaacccgaagtagttaacgttacgggtaaagttcgaactaacgttaaccggaaacgggtaaaagggtaccggtagttaaacggttggttaacccgttttttaggaaaccgtttacggttacccgggtacgggggtacccccgtaaacgggggaaccttaaagggttcccggggg

SEQ ID NO: 113481 - DNA, 604 bp, Homo sapiens
  misc_feature: GYAE6OF01CBWOW.15.86.H09.1.454.CMB.1.raw
  modified_base (391)..(391): a, c, t, g, unknown or other
  misc_feature (391)..(391): n is a, c, g, or t
  modified_base (509)..(509): a, c, t, g, unknown or other
  misc_feature (509)..(509): n is a, c, g, or t
  modified_base (550)..(550): a, c, t, g, unknown or other
  misc_feature (550)..(550): n is a, c, g, or t
  modified_base (563)..(563): a, c, t, g, unknown or other
  misc_feature (563)..(563): n is a, c, g, or t
  modified_base (595)..(595): a, c, t, g, unknown or other
  misc_feature (595)..(595): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaaaggtgtccagtgtgaagtgcaggtggtggagtcgtgggggagccgttgggtaaagccgtggggggtcccttagagtctccgtgtgtggcctctggattcactttcagtaatggctggatgagttggtccgcgaggcctccgaggggaaggggctgggaggtgggttggacgtttacaaaaggtaaaatgaagtggtagaagaaatagacgtacggngacgaccgtagaaaggaagtatcacatcgtacaagagtaataatacaaaaacggcggtagtaatttgaactaaagtcgaacagctaaggaaaccgagaacaccgagcctatattactnaacccatagtatacggaagtcgactagtacgaggtaaaggnggtcttagtcgtntttgattacgtcgacggggaccgacgggtaanaggttcggg

SEQ ID NO: 113482 - DNA, 589 bp, Homo sapiens
  misc_feature: GYAE6OF01CFLOI.15.86.H09.1.454.CMB.1.raw
  modified_base (459)..(459): a, c, t, g, unknown or other
  misc_feature (459)..(459): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttgggtaaagccgtggggggtcccttagagtctcctgtgtggcctctggattcactttcagtaatggctggatgaggttgggtccgccaggctccgagggaaggggctgggagtggggttggacgtttacaaaagtaaaatgagtggtagaagaaatagactacggtgacacccgtagaaaggagattcacatctacaagagaataatacaaaacgcggtagtattgactaatagaaacngaccaagaaaccgagacacacgccgtactattacagtaccactagattacggaatgacagtacgaacggtaaagggagtcgtatgttcgtttagattacgtcgtcggggacccagggactaaggttcggg

SEQ ID NO: 113483 - DNA, 712 bp, Homo sapiens
  misc_feature: GYAE6OF01EEWG3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaacgccgtggggggtcccttagagtctcctgtgtcggcctctggattctactttcagtaatggctggatgagttcggggtccgcgaggctccgaggggaaggggctgggacggtgggttggacgtttacaaaagtaaaatgataggtagaagaaaatagacgtacgtgacctaccggtagaaaggaagattcaccatacacaagagtaataacttaacgaaaaacgacggttagtacgtttagaactaaagtaagaacgaacgccgtaacggaaaaccgacgggtaacacgacgtaccccgtacttaacgtttaacctacgtaacctaaccgagttaacgttaccgggaaggttcgaacgtaaacggtaaccggtaaacggtaaagggtaacggtacgtttaagtacggtttacctttttaggaacgttaacgttcgggtacccggggtaacccgtaacggggtaaaccgtaagggttacccggg

SEQ ID NO: 113484 - DNA, 629 bp, Homo sapiens
  misc_feature: GYAE6OF01D1CL4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttgggtaaaggccgtggggggtcccttagacgtctcctgtgtggcctcgtggattcactttcagtaatggctggatggagttgggtaccgccaggctccgagggagggcgtggaggtgggttgacgtttacaaaagtaaaatgatggagaagaaaatgactacggtgacaccggtagaaaggagacttacacctatcgtacaagagaataagttacaaaaacgtcggttagtaattgacaaatgaaacagtacctaagaaaaccgaggacaacgacgtccgtactacgttacgtagtacccagtacgtaacgttcgggaaatggacctagtaccgaaacggttaaaggacggtaccttaagtcggtactttagattacgtcggtacgggacccgtagggactaagtcgg

SEQ ID NO: 113485 - DNA, 731 bp, Homo sapiens
  misc_feature: GYAE6OF01CL82J.15.86.H09.1.454.CMB.1.raw
  modified_base (529)..(529): a, c, t, g, unknown or other
  misc_feature (529)..(529): n is a, c, g, or t
  modified_base (582)..(582): a, c, t, g, unknown or other
  misc_feature (582)..(582): n is a, c, g, or t
  modified_base (607)..(607): a, c, t, g, unknown or other
  misc_feature (607)..(607): n is a, c, g, or t
tcagtctacgtagccacgaccggtgctcgatttagtgctatagacttgggtttgggggagaggagccccagccttgggatccccaagtgttttcattcagtgatcaggactgaacacagagactcaccatggagttcgggctggagtcgttgggttttccttgctgtctatacgttaaaaggtgtccagtgtgagtgacgaggtggtggaggtcggtggggactccgttagggtaaacggtccggttcgggggttacccttaaggtacgttccgttccgttgttggtcgtccttgtggtacttccgttactttacgaggttaagtggtcgtaggtaagttggtacggttccgggtcccgaccggagtccgtacgggaaggggacggggtcgtagggtaggttgggttacggttaaccgtttaaacggtaaaaagtaaagtcgtaagtaggtaagaaaagtaaaagtacggtaacgttacggacgaaccgaaccgggtaagaaaggtaacgtactaccaacattacgaanaacggataagttaacgtaaaccggaaacgtggtaagttaatacgaaataaganaaacgacggactaaaggaaccgganacgaaccgacgtcgttaatattaccacgaaccagactagtacgagcaactaggacgtaaacgaggcgttatagttcgtttactagacgttcgtaccgggtacggacgtaagtacgtgttccggg

SEQ ID NO: 113486 - DNA, 878 bp, Homo sapiens
  misc_feature: GYAE6OF01DB84C.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctggagcttgggttttccttgctgctatacttaaaggtgtcagtgtgaagtgcgaggtggtggagtcggtgggggacgtccgttagggtaaacggtccgggtcggggggtacccttaggtacgttcccgttccgttggtggttccggtccttcgtcggttacttccttacttttacgtaaggttaacgtcggtacgtaggtagttacgggtacggggtttccggggttcccggaccggtaacgggtcccgttacccggggaagggggggtaaacggggggtccggttagggggtacggggttttggggggtttaaccggggttaaacggttttaaaacggtaaaaaaaaggtttaaaaagttcgggtaaggttaaggggtaagaaaacgtaaaaggtacgtaacgttacggtacgaacccggtaaccggtaaggaaaacggtagtaactaccgtaacctactacgtaacgtaaaggtaaataacgttaactaaacgtaaaacggtacgtttagttaattacgaaactaagacgtaaacgcggtaacctaaacggaaaccggacgtaacgacgtaccggtacctttattaacgtaccgtacgtaaccgacgttagtaacgtacggtaactcggaactacggtaaacggaacggtaagtcggtaacttaggttctttaacggttagtaacgttacggttacgggaccgggacccggtaaggacgttagggttcccggg

SEQ ID NO: 113487 - DNA, 614 bp, Homo sapiens
  misc_feature: GYAE6OF01EYWKO.15.86.H09.1.454.CMB.1.raw
  modified_base (508)..(508): a, c, t, g, unknown or other
  misc_feature (508)..(508): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtggggggtcccttagagtctcctgtgtggcctctggattcactttcagtaatggctggatgagttgggtccgccaggctccaggggaaggggctgggagtggggttggtaacgtttacgaaaaagttaaaaatgaagtggtagaagaaaatagactacggtgccgacccgtagaaaggagattccacatcacaagagaataattacaaaaacggtacggtatattttagactaaaatagaaactagaccctaggaaaaccgaggacaacgacgcctntaattactagtaacccanagtattcggaagtagacagtcgtaaacggtaaagggcgacttagcgtcttttagattagtcgtcggggacccagggtacaagttcggg

SEQ ID NO: 113488 - DNA, 819 bp, Homo sapiens
  misc_feature: GYAE6OF01CWKYA.15.86.H09.1.454.CMB.1.raw
  modified_base (284)..(284): a, c, t, g, unknown or other
  misc_feature (284)..(284): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttaggtaaagccgtgggggtccttagagtctctgtgtcggctctggattcactttcagttaagnggctggatggtaggtttcgggccgcgaggctccggaaggggaaggggctgggaggtgggttggtacgttacaaaagtaaaatgaagtggtagaagaaaagtagacgtaacggtgacaacccggtaaggaaaaggaacgtagttaccaaccgtactaccgtaacgaaaggtaagtaaattaaacgtttaaccgaaaaaaccggggtaggtttaacggttaattttaacggaaacctaaaagttacggaaaaccgacggtaacccgttaaaagggaaaaacccggacggaaaccaacggtaccggtacccggtttaaccttaacgtttaaccgtaacgttaacccaaacgtaacggttaacgttaacgggtaaagtaccggtaacgtaacgttaaccgggaaaccgggttaaaaggggacggttacctttaaaggtttacggtttacccgtttttaaggaaacgttttaacgggttcccggggttacccgggggtaaaccccggtaaaggggtaaaccgttaacgggtttcccgggg

SEQ ID NO: 113489 - DNA, 763 bp, Homo sapiens
  misc_feature: GYAE6OF01COMUT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttgggtaaacgccgttggggggtcccttagagtctcctgtgtcggcctctggattctacttcagtaatggctggatgagttggtccgcgaggctccgagggaggggcgtggagtgggttggacgtttacgaaaagtaaaagtgaagtaggtagaaagaaaagtacgaacgtacggtacgacgaacccggtaggaaaaggaacgtaagttaccaacctattacgtacgaaagtaagtaacttaaacttaaaccgtaaaaacggtacggttaacgttaagtttacgtaactaaagtacgaaacgaacggtaccgtaacggaaaaaccggtaacggaaccgaaccgtaacggtaccgtaccgttaactttaaccgtacgaacccgttttttaacgaacggtaacgttacgggaacgtacgtaacgtaacggtaaccggtaaacgggtaaaggtaacggtaccgttagttacggtttacgttttacgtaagtttacggttaccggttaccggggtacccggtaacgggaacgtaaggttaccgggg

SEQ ID NO: 113490 - DNA, 1012 bp, Homo sapiens
  misc_feature: GYAE6OF01DHSWF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacgttaaaaggtgtccagtgtagaagtgcgagggtggtggagtcgtgggggagtccgttaggtaaacgccggttcggggggtacccttaaggacgttcctccgtggtggtcggtcccttcgtggtacttctactttacgaggttaaatggtccgtggaattgggtaggtttcggggtacccgcccgtaagggcccttccggaaaggggggaaacggggggtccttagggggtaacgggtttgggggtttacgggtaaacggtttttaaccgaaaaaaaggtttaaaaaacgtggtaagttaggggtaagaaaaagggtaaaaaacttaggtaaaccggttacgggttacgaaccgtaaaccccggtaagggaaaaaacgggtaagtaactttaccgaaaccctagttacctaacggaaaacgtaagtaaacttaaaacgttaaacgtaaaaaaccgggtacgggtttaacgttttaagtttacgaaaacgtaaaagttacggaaaaccgacgtaaccccggttaaaacggaaaaacccggtaggaaacccgtaaacgtaccgggtaccccttttaaacgtttaaccgtttaacccgttaccggttaaaacccccgtaaggtaaaggttacccgggtttaaaacggggtaacgttcggtaaaccgttaaccgggtttaaaccgggaaaaacccggggtttaaaagggtaccggttaaacccggtttaaggttttcgggttttaaacctttttaagggtaaacctttaccggggttaacccgggttaaccccggggggacccggttaaaacgggggtaacgtttaaaccggggtttccccgggg

SEQ ID NO: 113491 - DNA, 872 bp, Homo sapiens
  misc_feature: GYAE6OF01CCDVY.15.86.H09.1.454.CMB.1.raw
  modified_base (639)..(639): a, c, t, g, unknown or other
  misc_feature (639)..(639): n is a, c, g, or t
  modified_base (678)..(678): a, c, t, g, unknown or other
  misc_feature (678)..(678): n is a, c, g, or t
  modified_base (709)..(709): a, c, t, g, unknown or other
  misc_feature (709)..(709): n is a, c, g, or t
tcagtctacgtagccacgaccggtgctcgatttagtgctatagacttggggtttgggggggagaggagccccagccttgggactccccaagtgttttcattcagtgatcaggactgaacacagaggactcaccagtggagttcgggctggagtcgttgggttttccttgctgtctatacgttaaaaggtcgtcctagtgtagagtgcgaggtggtggagtcggtgggggactccggttagggtaaacggccgggttacgggggtacccttaggtacgtccttccgttggtcggtcggtcctcgtaggttacttaccttacttttacgaagttaacgtggtcgtaggaagttggtacgggtttcgggtcccgacggtacgggaccgtaccgggaaggggggaacggggtcggtaggggtacgggtttggggtttaacggttaacggtttaaaacgtaaaaaggttaaaagtggaacgttagggtaagaaaacgttaaaagtacggtaaccgtacggtacgtacccgtaaacgggtaaaggaaaacgggtaactacgttaaccaacccgtaataccgtaaagaagtaaacgtaaattaaacgtaaaccggtaaaaggttcggttaatttacgtaacgtaanaaacgtaacgaaacgagtacccgaaaaggtaaaccgganaccctaacgcgtaaccctatacttaaccganacccgtaagtaacgtagtacggtaagtcgaacgttaagaaacgggtaaaaccggtaagggtacccttagttaggttttaccggtttccgtttaaaggtacggttaccggtacccgggggtaacgggtaaccccggaaaggtttaaccctacgggggttttccg

SEQ ID NO: 113492 - DNA, 575 bp, Homo sapiens
  misc_feature: GYAE6OF01B4WZX.15.86.H09.1.454.CMB.1.raw
  modified_base (376)..(376): a, c, t, g, unknown or other
  misc_feature (376)..(376): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgcagcctcaggattcgcctttcgcatctatgccatcgacctgggtccgccaggcctccgaggggaaggggctggagtggatctcagtctagttagtgggaggtggtaggtggtagaaaacnctatattacgcaggctcggtagacgggccgcttcacctatctccgagacgacaattaccaacaacactactttatctacaatgaacagtcctgcgacgaccgaggaccacggtcctatactactgtacgcgagagatacgaacgtcggcccggtaggggaccgtcccggttagaccttacggcggggcccgtaaacggg

SEQ ID NO: 113493 - DNA, 715 bp, Homo sapiens
  misc_feature: GYAE6OF01EARSO.15.86.H09.1.454.CMB.1.raw
  modified_base (464)..(464): a, c, t, g, unknown or other
  misc_feature (464)..(464): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacggccgttgggggggttccccttaaggacggttcctccgtgtggttcggccttcgtggtatttcactttcagtaatggctggatgagttgggtccgccaggctccgaggggaaggggcgtgggaggtgggttggacgtttacgaaaagtaaaagtgaagtggtagaaagaaaagtagaacgtacggtgaccgacccgtaggaaaggaagtacttacaaccatactacgaaaganaattaattaacgaaaaacgtacggtagttaactttgaactaaagtagaaacaacgaccgtaacgaaaaacccgaggaaccaaccgacgtacccgtacttaacttaacctacgttaacccgaacgtagtaacgtttacgggaaacgtcgaacgtaagtaccggtaaacggtaaaagggacggtacgttatggttcttttaggattaacgtcgggtacggggaccccgaaggggtaaccgtaaggttacgggg

SEQ ID NO: 113494 - DNA, 741 bp, Homo sapiens
  misc_feature: GYAE6OF01C2L52.15.86.H09.1.454.CMB.1.raw
  modified_base (135)..(135): a, c, t, g, unknown or other
  misc_feature (135)..(135): n is a, c, g, or t
  modified_base (645)..(645): a, c, t, g, unknown or other
  misc_feature (645)..(645): n is a, c, g, or t
  modified_base (710)..(710): a, c, t, g, unknown or other
  misc_feature (710)..(710): n is a, c, g, or t
tcagtctacgtagccacgaccggtgctcgatttagtgctatagactttgggtttgggggggagaggagccccagccttgggatccccaagtgttttcattcagtgatcaggactgaacacagagactcacatggngttcgggctgagctggttttccttgctgctatacttaaaaggtgtcagtgtgagtgcgagggtggtggagtcgtgggggagtaccgttaggtaaacggtccggtcgggggttaccccttaaggacgttccgttccgttggtgttcggccttcgttggtacttcttaacgtttcaagttaagtggtcgtaggtaattggtacggttcggcccgcctaagggtcccgacggtagggggaaacgggtcgtaggggtaggttgggttacggtaaacgtttaaacgtaaaaaaaggtttaaaagtaggtaagttagggaagtaaaaagtaaaagtagtaaacgtacggtaacgaccgttaacccgaaaggtaaagacgtactacctacactctaaacgaagtataacgttaactaaacgaaacgtggttaagttaagttaacgaactaagtaacgaaacgtcgaacgtaaacggaaaccaggtaacaccgtataccgttaattacttaaccggtntaaacccgataggaacttcggaagtcgaacgtattaaccgaagtaaagcgtagtattcgttattnagttcgtacgcgggaagacgtagtacgtggg

SEQ ID NO: 113495 - DNA, 672 bp, Homo sapiens
  misc_feature: GYAE6OF01A7JZI.15.86.H09.1.454.CMB.1.raw
  modified_base (443)..(443): a, c, t, g, unknown or other
  misc_feature (443)..(443): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcacttttcagtaatggctggatgagttggggtccgccaggcctccgaggggaacgggggtctgggagtgggttggtaacgtttacaaaaagttaaaaatgaagttggtagaagaaaatagaactaacggtgaccgacccgtaggaaaggaagtattacacctatctacaagaanataaatacgaaaacggacggtattaatttacgactaaagtacgaaacgacgacctaacggaaaaccgacgggaacaccggtacgaccgtacttaagttaccgtacgttaaccaacgtagtacgtttacggaagtcgacaacgttacggaaaggtaaaggacgtacgttagttcggtctttttagattacgttcggaccggggtacccgaggggtaacctaaggttcggg

SEQ ID NO: 113496 - DNA, 660 bp, Homo sapiens
  misc_feature: GYAE6OF01B3IXG.15.86.H09.1.454.CMB.1.raw
  modified_base (541)..(541): a, c, t, g, unknown or other
  misc_feature (541)..(541): n is a, c, g, or t
  modified_base (653)..(653): a, c, t, g, unknown or other
  misc_feature (653)..(653): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctggagcttgggttttccttgctgtctatacgttaaaaggtgtccagtgtgaagtgcgaggtggtggaggtcgtgggggagtccgttagggtaaacggtccggttcgggggtcccttaggacgtctccgtggtcggtcggtccttcgtggtacttctactttacagttaagtggctggtagtggtaggttcgggtcccgccgaggccgtacggaggggaaggggtcgtgggtaggttgggttagtaacgtttaacgaaaaggtaaagtgtaagtaggtaagaaagaaagtagacgtacggcgaccacggtagaaaggatactacactatacacgaagtagtaattaacgtaacgaaagtgttagttatagaacaagtgaaacagtaccaagaaaccgngacacgtcgctaactacgtacacgtaccatagtacgttcgaagtcgaccgagtaacgaaggtaaaggcgttatatcgtttgttagcttagtccgggtacggaccgaggtacnggttcgg

SEQ ID NO: 113497 - DNA, 922 bp, Homo sapiens
  misc_feature: GYAE6OF01CNHMQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaaggtgtcggtgtgagtgcaggtggtggagtcggtagggggacgtccgttaggtaaacggccgtcggggggtcccttaggacgttcctccgttggtcgtcggcccttcgtaggtattcctacgttttacgtaagttaacgttcgggacttagggtattaggtacggtttcggggtcccgtccgaacggtcccgttaccggaagggggtaacggggtcggtaggggtacgggtttgggggttacgggttaaccgtttaaacgtaaaaaaggttaaaaagttggtaaggttagggtaaggtaaagtaaaaaacgtaggtaaaccgttacggtacggacccgtaaccggtaacggaaaacggtaacgtaacttacaacccgtaacgttccgtaacgaaagtaagtaaacgttaaacgtttaaaccgaaaaacggttccgggttaagttaactttaacggaaccgtaaaattacggaaaacgtaacggtaacccgtaaaccggaaaaccgggtaccgtaaacccgtaaccgaacccggttccgttaaccgttaacgttaacccttacggaacccgtaataaacgtttaccggtaagggtaaacgtcgtaacctaagttaccggggaaaacggttaaagggaccgtttacgttaacgttacggtttaccgttttaagaaggttttaccggacccggggttacccggggtaaccccggaagggtttaaacccgtacgggtttacggttcccccgg

SEQ ID NO: 113498 - DNA, 807 bp, Homo sapiens
  misc_feature: GYAE6OF01EREOS.15.86.H09.1.454.CMB.1.raw
tcagtctacgtagccacgaccggtgctcgatttagtgctatagacttgggtttgggggggagaggagccccagccttgggatccccaagttgttttcattcagtgatcaggactgaacacagaggactcaccatggagttcgggctgagtcgttgggttttccttgctgctatacgttaaaaggtcgtccgagtgtagagtgcgagggtggtggaggtcggtggggacgtccgttagggtaacgccggttcgggggtccttagacgtctccgtgtgtcgcctgtgtattctacttgagtagtggctggagtggtaggttcggtccgcgtcggcgtacgggaggggacgggtcgtgggtaggttgggttacggtaacgtttaaacgaaaaaggttaaaatggtaagtagggtaagtaaaagtaaaagtacggtaaccggtacggtaccgaacccgtaaccgggtaagaaaacggtaacgtaacttaccaacctacgtactaaacgaagtaaagttaaacttaaaacggtaaaccgtaaaacgggttcgttaagtttaacgttacggaaacgtaaagttaacggaaaccgtaaccggtaacccggtaaaacggaaaacccggtacggtaacccaaacggtccggttaaccgtttacttaaacgttaacccgtaacggtacccaaggttacgtacggttacgaagtcgtaactaacgggtaacggtaaaccggtaaggtcgtacgttaggttcttagtttacaagttccgggtacgggaccgggaaccggttaagggagttcggttcggg

SEQ ID NO: 113499 - DNA, 753 bp, Homo sapiens
  misc_feature: GYAE6OF01D8N30.15.86.H09.1.454.CMB.1.raw
  modified_base (335)..(335): a, c, t, g, unknown or other
  misc_feature (335)..(335): n is a, c, g, or t
  modified_base (533)..(533): a, c, t, g, unknown or other
  misc_feature (533)..(533): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttggttttccttgctgctatcttaaaaggtgtccagtgtgaagtgcaggtggtggagtcgtggggagccgttaggtaaacgccgtcgggggtcccttagacgtctcctgtgtggcctctggattcactttacagttaagtggctggatgtaggttgggtccgccaggctccgaggggaagggtcgngggtaggttgggttggaacgtttacgaaaaagttaaaatgaagtaggtagaagaaaatagaacgtacggtcgacgaacccgtagaaaaggaagaacgttacaaccgatactacgtaaagagtaaataagttaaccaaaaaacgtacggttagttatttaggaactaaagtacgaaacacgacgtaacgaaaaaccggngaaccctacggaagtacccctacgttaattaaaccgtagtaacccgaacgtaacggtaagtttaccgggaagttacggtaccgtaaacgttcccgggaaacggttaaaacgggtacggtaaacccgttaggttaccggttcgtttttaaacgggtaacttacggtttacccgggttaaccgggggcccgttaaacgggggaacgttaaaacggttcgggg

SEQ ID NO: 113500 - DNA, 802 bp, Homo sapiens
  misc_feature: GYAE6OF01B6L0X.15.86.H09.1.454.CMB.1.raw
tcagtctacgtagccacgaccggtgctcgatttagtgctatagacttgggtttgggggggagaggacgccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtgggggacgtccgttagggtaaacggtccggtgggggggttaccccttaggacgttccgttccgttggtcggtcggtccttcgtgggtactttctactttcgagttaatggctggatggtacggttcgggtccgccgaggcctaccggaagggggaacggggtcgtaggggtaggttggggttaggtaacggttttaacgaaaaaaggttaaaaatggtaagttagggtaagaaagtaaaagtacggaaccgtacggtacgaccgtaaccggtaaggaaaaggaacgtacttaccgaactacgttactaacgaaagtaagtaacttaaacgttaacgaaaaacggtcggttaattaagtttacgaaactaaaagtacggaaaacgtacgacccgtaaaggaaaacccggacgaaaccgtacgtaacggtaccgttaactttaacgttaacccgtacgttaaacccagtaacggtaacgtttacggaacggttcgaactacgtaacggaaacggtaaagggcgtagttaatggttaccttttagacttacggttccgggacgggaccctaaaggggtaccaggtttcggg

SEQ ID NO: 113501 - DNA, 768 bp, Homo sapiens
  misc_feature: GYAE6OF01EFOVW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcgttgggttttccttgctgctatacttaaaaggtgtccagtgtgaagtgcaggtggtggagtcgtgggggagtccgttaggtaaagccggtgggggtcccttagagtctccgtgtgtgcctcgtggtattcactttcagtaagtggctggatgaggttcgggtccgcaggctccgagggagggcgtggaggttgggttggtaacgtttacgaaaagtaaaatgtagtaggtaggaagtaaaagtagaacgtacggtgaccaacccggtagaaaagggaatacgttaccaacctaacgtactaaacgtaaacggaagtaaacttaaacgttaaaccgaaaaaacggttaccgggttaagttaagtttaacgaacgtaaaagttacgaaaacgtaaccgtaacccgtaaaggaaaaacccggacggtaaccgaacgtaacggttacccgttacgttaacgttaaccgttacgtaaccgtaacgaggttaacgttacgggtaagtcggtaacgtaacgtacggtaaacgtaaaagggtacggaacgtttagttacgttacgtttacggtaattaacggttccgggtaaccgggaccgtaaacgggtacgtaacgggttaccggg

SEQ ID NO: 113502 - DNA, 619 bp, Homo sapiens
  misc_feature: GYAE6OF01BI0RM.15.86.H09.1.454.CMB.1.raw
  modified_base (392)..(392): a, c, t, g, unknown or other
  misc_feature (392)..(392): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtggggggtcccttagagtctcctgtgtggcctctggattcactttcagtaatggctggatgagttggccgcaggctccaggggagggctggagtgggtggacgttacaaaagtaaaatgatggtagaagaaaatagactacggtgacaccgtagaaagganattcacatctacaagagaataattacaaaacggtacggtagttaattgacaaatgaaacagacctagaaaccgagaacacacgccgtactattactacgtaccacgtagtacttacggaagtgacagtacgaacggttaaaacggaggtacttaagttcgtacgtttttacgaatttaacgttccggtacgggggaccccgtaggggtaacctaaggttacccgggg

SEQ ID NO: 113503 - DNA, 749 bp, Homo sapiens
  misc_feature: GYAE6OF01DZOE7.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttcctgctgctatcttaaaaggtgtccagtgtgaagtgcgaggtggtggagtcgtggggagccgttaggaaacgtccggttgggggtcccttaggacgtcctccgtgtgtcggtcctcgtggacttcacttttcaagtaatggcgtggagtgtagttcggtccgccgaggctccggaggggagggcgtggaggtgggttggtacgtttaacaaaagtaaaatgagtaggtagaaagtaaatagaacgtacggtacgaccgtacccgtaaggaaaaggaactacgttaccaactactacgtaacgaacgaataacgttaaactaacggaaaaaccggtggttacgttaagtttacgaaacgtaaaagttacgaaaccgtaacgtaccgtaaacggaaaacccggaagggaacctaaccggacgtaaccccgttaataacgtttaaccgttaccgtaacccgtaacgtacgtaacgttaacggaagttccgaacgtacgtaccgtaaacggtaaaggtcggtaactaggttacgttacgtttaggtaacttacgtaccgggtaccgggacccgtaagggtaccgttaacggtccggg

SEQ ID NO: 113504 - DNA, 656 bp, Homo sapiens
  misc_feature: GYAE6OF01D5BRQ.15.86.H09.1.454.CMB.1.raw
  modified_base (456)..(456): a, c, t, g, unknown or other
  misc_feature (456)..(456): n is a, c, g, or t
  modified_base (567)..(567): a, c, t, g, unknown or other
  misc_feature (567)..(567): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccttggtaagccgtgggggtcccttagacgtctcctgtgtggcctcgtggtattctacttcgagttaatggctggatggagttgggtccgccaggcctcggaggggaacggggcgtggggaggttgggttcggtacgtttaacgaaaaagttaaaagtggtaagtagggtagaaagtaaaagtaggaccgtacgggtcgaccgaacccggtaggaaaacgggaacgtacttacaaccgngtactaacgaagaagtaataagttaaccgaaaaacggtcggttaagttattagacaaagtcgaaacacgaccgtaaggaaaccgagacacacgccgtatatactacgacanacgtagtacgagtcgacgatacggacgtaaggcgtctaagtcttacgttgtaatacggttcgtacgggaccggacggtaatcggttcgg

SEQ ID NO: 113505 - DNA, 943 bp, Homo sapiens
  misc_feature: GYAE6OF01DY7WF.15.86.H09.1.454.CMB.1.raw
  modified_base (201)..(201): a, c, t, g, unknown or other
  misc_feature (201)..(201): n is a, c, g, or t
tcagtctacgtagccacgaccggtgctcgatttagtgctatagacttggggtttgggggggagaggagccccagccttgggactccccaagtgttttcattcagtgatcaggactgaacacagaggactcaccatggagttcgggctgagtcgttgggttttcctgctgctatacgttaaaggtgtaccagtgtagagtgngtagggtggtggtaggtcggtgggggtacgtccgttaggtaaacggtcccgggttcggggggttacccttaggtacgtcgttcgtggtcggtcggtcctcgtggtacttacgtacctttagtaagtaagtggtcgtagggtagtggttacgggttacggggtcccgaccgtacggccgtacgggggtacgggggaacggggtcggttacggggtacgggggttaggggttacggttaaacgttttaaaacggtaaaaaaaggttaaaacggtggtaaaggttaacgggtaaaggtaaaaaggtaaaaacggtaacgggttaaccggttaaccgggtacgtaacccgggtaaaccgggtaaagggaaaaaggttaacgtaaccgttaaccgaactacctacgtaaacgaaaaggtaaacttaaacgttaaacgtaaaacggtaaaaccgggttaggtttaacgttaagttaaacccgtaaagtaaaaccggtcggtaaaacgtaacgtaacccggtaaaagaaaaccgggtaaccgaaccgtaaccggtacgttaacttaacccgttaacgttaaccgtaccccggtaaactaaccggtaggtttaaccgttaacgggaacgttacgacgttaaacggggtaaaccccggttaaaaggtagggaacccgtttaagtcggtttaaggttccttaaggtaacgtcgggtacggtaccgggaaccggtagtacgtacgggttccgg

SEQ ID NO: 113506 - DNA, 786 bp, Homo sapiens
  misc_feature: GYAE6OF01DHA00.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttagggtaaacgccggtggggggttcccttaggtacgttccgttccgtgttcggtggtccctctgggtactttctaaccttttcgaagttaatgggctagggtagtggtaggtttcggggaccgccgacgggcctaccggagggggtaacgggtcgtggggtaggtggggttaggtaacgtttaacgaaaaaagttaaaaagtggtaagtagggtaggaaagtaaaaacgtgaacgttacggtcgaccgtaaccggtaggaaaaggagtactacacctatactacgaaagagtaattaaactaacgaaaaacggtacggttagttaatttacgaacgtaaaagtagaaaacgaacgtaaccggtaaacgaaaaccggtacggaaccaacgacgtaccgttacttaacgttaccgtaacgtaccaacggtagtaaacgttacggtaagtcgaacgtaacggtaccgtaaacgggtaaaagggacgttcgttagttacgtttcgtttagtaacgttacggttaccgggtaacccggggacccgtaaagggtcgtaaacggttcggg

SEQ ID NO: 113507 - DNA, 739 bp, Homo sapiens
  misc_feature: GYAE6OF01EL0JZ.15.86.H09.1.454.CMB.1.raw
  modified_base (432)..(432): a, c, t, g, unknown or other
  misc_feature (432)..(432): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacttaaaaggtgtccagtgtgaagtgcgaggtggtggagtcgtgggggagccgttaggtaaacgccgtgggggtcccttagacgtctccgtgtgtcggcctcgtgtattcactttcagtaatggctggatgtaggttcgggtccgcgaggctccgaggggagggcgtgggtaggtgggttggtacgtttaacgaaaagtaaaatgagtggtagaagaaatagactacggtacgcgacccggtagaaagtaagagtacactanactacgaaagagtaataaagttaacaaaacgtacggtagttaatttagaacaaagtagaacacgtaccaaacggaaaaccgaacggaaccaacgacgtacccgttaccttaacgtttaccgtaccgtaaacccgaacgtaacggtaacgtttaccgggtaagtacgaaccgtagttaaacccgggtaaacggttaaaaagggaccggttaccttaagtacggttttccttttagggtaatttaccggttaacccggggttacccggggaacccgttaacggggtaaaccgttaacgggttcccgggg

SEQ ID NO: 113508 - DNA, 892 bp, Homo sapiens
  misc_feature: GYAE6OF01A86Y2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtgggggtcccttagagtctcctgtgtcggcctctggattcactttacagtaatggtctggatcggtaggtttcggggtcccgccgtacgggccgttaccccggaaggggggaagggggtccggtaggggtaagggtttcgggggtttacggggtaaaccgttttaaccgtaaaaaaaggttaaaaaaagttgggaaagtttagggtaaggtaaaaggtaaaaacgttaacggtaaccgttaaacgggtacgtaaccccgtaaccccggttaaagggaaaaagggtaaacggtaaacctttaaccgaaacccgtaacgttaccgttaaaccgaaaaggtaaacggtaaactttaaaacgttaaacccgtaaaaaaaacgggtaccgggtttacgtttaaacgttttaggaaaccctaaaagttaacgggaaacctaacggtaacccttaaacgggaaaaacccgacggtaaccaacgtaccggtacccgttacttaacgttacgtaactaaccgtaacgtaagttaacgttaccgggaaagtcggacctaaggtacccgtaaaagggtaaacgggacggtaccgtttagtcggttaccttttaggaacttaacggttccggtacgggggaacccctaaggggtaacttagggttacccggg

SEQ ID NO: 113509 - DNA, 693 bp, Homo sapiens
  misc_feature: GYAE6OF01DFQUX.15.86.H09.1.454.CMB.1.raw
  modified_base (194)..(194): a, c, t, g, unknown or other
  misc_feature (194)..(194): n is a, c, g, or t
  modified_base (285)..(285): a, c, t, g, unknown or other
  misc_feature (285)..(285): n is a, c, g, or t
  modified_base (460)..(460): a, c, t, g, unknown or other
  misc_feature (460)..(460): n is a, c, g, or t
  modified_base (515)..(515): a, c, t, g, unknown or other
  misc_feature (515)..(515): n is a, c, g, or t
  modified_base (584)..(584): a, c, t, g, unknown or other
  misc_feature (584)..(584): n is a, c, g, or t
tcagtctacgtagccacgaccggtgctcgatttagtgctatagacttgggtttgggggggagaggagccccagccttgggatccccaagttgttttcattcagtgatcaggactgaacacagagactcaccatggagttcgggctggagcgtcggtttctgcgtgctatacgttaaagtcgtcagtgtgagtgnggtaggtggtagtcggtgggcgggtacgtacggtacggtacgtcggggttacggtacctagtctccgtcgtggtcgtcgtctggtatactnttctagtacgtgtcgtgtaggtgtacggttggtccggtccgacggacggtacccgagggggtaaggggcgggtaggtagggtagggttacggtacggttaaacttaaaagtaaaagtagtagtaggtacggaataaacgtagtacgcggtacgacgaacgtacggaagacgtacnctacactgtacaagtataataagttaaacaaggtacgtagttattacgaagtaanactagtaagccgtaacgaacgaacgacgaacgtccgaattacccgtattacgaacctataccgagttanagggtacagtacgacgtaacgtaggaaggtaccgtaggtattaggttaccttggtacttaccggtacggtaccgggtaccctaaggtccggttaagtcgggtttacccg

SEQ ID NO: 113510 - DNA, 935 bp, Homo sapiens
  misc_feature: GYAE6OF01BSKUQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtgtccagtgtgaagtgcgaggtggtggaggtcgtggggggagtccgttagggtaaacggcccggttcgggggggttaccccttaggacgttccgttccgttggtggtcgggcccttcgtggtacttcctactttcagtaatggctaggatggtaggttcgggtcccgcgacggctaccggaggggaacggggcgtagggaggttggggttcgggtaacgttttaacgaaaaaggttaaaagtggtaagtagggtagaaagtaaaaagtacggaacgttacggtaggacccgtaacccggtaaggaaaaggtaacgtactttaaccgaacccgtaataccgtaacgaaacggaagtaaacttaaacgttaaccgaaaaaacgggttccgggttaaggtttaacgttttcggaaacgtaaaaacgttacgggaaaaccgtaaccggtaacccggttaaacggaaaaaaccccgggacggtaaaccccgtaacgggtaaccggttacccccgtttaagtttaaacccgttttaaccgttaaccggtaaacccctaaccggttaggtttaaaccggtttacgggggaaagttcggtaaaccgtaacggttaaacccgggtaaaacggggtaaaacggggtacggttaactttaaagggttcggttttaacccgttttaggtaaaccgtttaccgggttacccgggtacccggggggttaaacccctaaggggggtaaaacccttaaggggtttccccgggg

SEQ ID NO: 113511 - DNA, 838 bp, Homo sapiens
  misc_feature: GYAE6OF01A4HTA.15.86.H09.1.454.CMB.1.raw
  modified_base (179)..(179): a, c, t, g, unknown or other
  misc_feature (179)..(179): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (333)..(333): a, c, t, g, unknown or other
  misc_feature (333)..(333): n is a, c, g, or t
tcagtctacgtagccacgaccggtgctcgatttagtgctatagacttgggtttggggggaggaggagccccagccttgggatccccaagtgttttcattcagtgatcaggactgaacacagaggactcaccatggagttgggctgagctgggttttccttgctgctatcttaaaaggtntccagtgtgaagtgcaggtggtggagtcgtgggggagccgttaggtaaagccgtgggggtcccttagagtctcctgtgtggccttcgtggnttcactttnaacgttaatggtctggatgtaggttcggtccgcgaggctccgaggggaacgggngtggacggtgggttaggtacgtttacaaaaggtaaaatggtacgtaggtacgaaagtaaaagtacggacgttaacggtagaccgtaacccggtaggaaaacgggaagtacgttaccgaaccgtaacttaccgtaacgaaagtaaggtaaattaaacgttaaaccgaaaaacggtaccgggttaagttaacgtttacggaacctaaaagtacggtaaacgaacgtaacccgtaaacggtaaaaacccggtacgtaaacccggtaacgaacccggtaaccgttaaccgttaaaccgtttccaaccggttaaccctaaacgaacggtttaacggttaaccgggtaaagtacggaaccctaacggttaaacccgggtaaaacggttaaacggggaaccggtagtttaacccggtaggttttacccgttttaaaggttaacccgttaagttcccgggttacccgggggaaccgttaacggggtaaacccgttaaggggtttaccccgggg

SEQ ID NO: 113512 - DNA, 684 bp, Homo sapiens
  misc_feature: GYAE6OF01BA9LA.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaagccgtgggggtcccttagacgtctcctgtgtggcctctggattcactttcagtaatggctggatgagttggtccgcgaggctccgagggagggcgtgggaggtgggttggtacgttacaaaagtaaaatgagtggtagaagaaaatagactacggtagacgaccgtagaaagaagattacacctatctacgaagagaataattacgaaaacgtcggttatatttagaacaaagtcgaaacacgacctaaggaaaacccgagaaccgacgtacgtaccggtacttagttaccgtacgtaacccgataacgtaacgtttaccgggaagttacgaacgaacgttaccggaaaacgggttaaagggtacggtacttaagttaccggtttgtttttaacgggaatttacgttccgggttaccgggggaccccgtaaacgggggtaccttaagggtttcccggg

SEQ ID NO: 113513 - DNA, 659 bp, Homo sapiens
  misc_feature: GYAE6OF01DX4NF.15.86.H09.1.454.CMB.1.raw
  modified_base (217)..(217): a, c, t, g, unknown or other
  misc_feature (217)..(217): n is a, c, g, or t
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtctggggganccgttggtaaagccgtggggggtcccttaggagtctcctgtgtggcctcgtggattcactttnagtaatggctggatgagttggtccncaggctcagggagggctggagtggtgacgttacaaagtaaatgagtggtagaaagaaatagtacgtaggtacgcctaaccgtaggaaaggatagttaccgaccatctacgaagagtaattaataacgaaaaacgtcggtattagtttagactaaagtacgaaacacggacctaagaaaacccggtaggaaccaagaccgtaccgttacttaagttacctaggtaaccacgtaagtacgttaacggaagttcgacgttaacgtacggtaaacggtaaaaggcggtacgttaagttcgttactttaggtaattacgtccggtaccggggacccgaagggtcctaagggttacccgg

SEQ ID NO: 113514 - DNA, 823 bp, Homo sapiens
  misc_feature: GYAE6OF01BLYTT.15.86.H09.1.454.CMB.1.raw
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
  modified_base (327)..(327): a, c, t, g, unknown or other
  misc_feature (327)..(327): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcgttgggttttcctgctgtccttattacgttaaaaggtgtccagtgtgaagtgacgngggtggtggagtcggtggggatccgttaggtaacgccggtcggggtcctagngtctcgtgtcgtcgctcgtgtatctacgttcagttacgnggtcgtaggtagtggtacggttcggtaccncgtaggtccgtacggaggggtacgggcgtagggtggttggggttacgtaacgtttaaacggaaaagttaaacgtggtaagtagggtaagaaacgtaaagaacggttacggtaacggtcgaacccgtaaccgggaaagaaacggtataaccgtacaacgtactagtaacgaagtaagtaataaaccttaaacggaaaacgttacggttagttaacgttacaaacttaaagtaacgaaaccgtaactaccgtaaaaccgggaaccgacgaacccacgtaaaccgtccgttaaacttaaccgttacgtaacccgtaaccgaacgttaacggttaccgtaacgggtaacttccggaaactacgggttaacgggaaacggttaaaccgggtacgttagttaaccgttagggtttaaacgtttacggttaacgtaacccgggttccggggttaacccgggaaaccggggttaacgtacccggggttaaagggtttccccggg

SEQ ID NO: 113515 - DNA, 878 bp, Homo sapiens
  misc_feature: GYAE6OF01DDAN7.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttagggtaaacgccggtgggggtcccttaggagttcctccgtgtgtcggtcctcgtggtattcgtactttacaagtaatggtctggatggtagttcgggtcccgtcgaggcgtaccggaggggaacggggcgtagggaggttggggttacggtaacggttttaacgaaaaaggttaaaaagttagaagttagggtaacgaaagtaaaacgtagtaacgttacgggtacgaccgaaacccggtaggaaaacggaacgtacttaccaaccgtacttacgtaacgaaagtaaacgtaacgtttaaactaaaccgtaaaaaacccggtcgggtttaagtttaacgttttaacgaaaacgttaaaacgtaacggtaaaaccgtaaccggtacccgtaaacggggtaaaaaacccggacgggaaacctaaccggaaccggttacccggtttaacctttaaacgtttaaccgttaacccggttaaacccgaaaccgttaacgggttaaaccggtttaaccgggtaaagttaccgtaacccggttaacgttaaccgggaaaaccggttaaagggaacgggtaccttaaggtttacccgttagtttttagaatttaaccgggtccggttacggggacccgtaaagggtaaccgtaaggtttccgggg

SEQ ID NO: 113516 - DNA, 666 bp, Homo sapiens
  misc_feature: GYAE6OF01CE49K.15.86.H09.1.454.CMB.1.raw
  modified_base (609)..(609): a, c, t, g, unknown or other
  misc_feature (609)..(609): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatcttaaaaggtgtccagtgtgaagtgcgaggtggtggagtcgtgggggagccttggaaaggtccgtggggggtcccttaggagtctccgtggtgtggcctcgtggattctactttcagtaatggtctggatggagttgggtccgccgaggctccgaggggaaggggcgtggtaggtgggttggacgtttacgaaaagtaaaatagagtaggtagaagaaaagtagacgtaacggtgcaacccgtagaaaaggaagtacgttcaaccagtctacgtaaagagtaataacttacgaaaaacggtacggttagttaatttaggaccaaagtagaaacagtaccctaagaaaccgtaacggacaccagtacccgtactacttaactacgtaccaacgtagagttacggaaggtcgacgagtaccgaacgtaaaggcggtacttanaggttcgtttagtattacgtcggtacgggaccccggaagggaccgtaaggttccggg

SEQ ID NO: 113517 - DNA, 886 bp, Homo sapiens
  misc_feature: GYAE6OF01DQSZO.15.86.H09.1.454.CMB.1.raw
tcagtctacgtagccacgaccggtgctcgatttagtgctatagacttgggtttgggggggagaggagccccagccttgggatccccaagttgttttcattcagtgatcaggactgaacacagagactcaccatggagttcgggctgagtcttgggttttccttgctgctatacgttaaaggtgtccagtgtgaagtgcgtaggtggtggaggtcggtgggggtacgtccgttagggtaaacgtccggtcgggggttacccttaggtacgttcctccgtggttcggtcgtccttcgtggtacttcgtacttttacgaagttaagtggcgttaggaattggtaggtttcgggtacccggccgtagggtcccgtaccgggaggggaacgggggtcgtaggggttacgggttaggggttacggttaaccggttttaaagaaaaagttaaaacgttggtaagttagggtaagaaaaggtaaaacgttaacgtaaccggttaacggtacgaacccgtaacccggtaaggaaaacgggtaaacttaccttaaccaaccgtaaagttacctaacgtaaagtaaacgttaaacgttaaaacttaaaccggaaaaacgggttacgggttagtttaaacgtttacgaaacgtaaaacttacgggaaaaccttaacgggtaacccgtaaaaccgggaaaaaccggtacgaaacctaccggtaacccgttaaccgttactttaaaccgttaccgtaaaccgttaaccctaaacggtacgttaacgtttaacgggagtaccgtaaccgtaagtaaccggaaaggtaaggtcggtagttacgttagttctttaggaacttcggtaccgggtaccgaacgggtacgtaacgtggttcccggg

SEQ ID NO: 113518 - DNA, 874 bp, Homo sapiens
  misc_feature: GYAE6OF01B5VYG.15.86.H09.1.454.CMB.1.raw
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagcgttgggttttccttgctgctatacttaaaaggtgtcagtgtgaagtgcgaggtggtggagtcgtgggggagccgttaggtaaagccgtgggggtccctagtagtcctctgtgtcggcctcgtggtattctactttacagtaagtggtctggagtcggtaggttcggggtccgaccgacggtccgtaccgggaacgggggaacgggggcgttaggggtagggttcggggttacggtaacggttttaaacaaaaaaagggttaaaaagttaggtaaggttagggtaagaaaaggtaaaaagtaaggtaaccgttaacggacgtaccgtaaccccgggtaaggaaaaagggaaacgtaacttaccgaaccctaagttacctaaacgaaaaggtaaagtaaacttaaaacgttaaacccgaaaaacggtacgggtttaagttaagttttacggtaaactaaaagtaacgtaaaacctaacggaaccgtaaacggtaaaaaccgggaaccggaacccaacgtaaacgtcccggttaaaccttaagttaacccgtaaccgtaacccaaacgtaaggttaaaccggttaacgggtaaacggtacgtaacctaaggttaaacccgggaaaacggttaaaacggggagttaccgttaaagttcgtacgtttttacggatttaaccgggttcgggacccgggaccccggtaaggggtaacgtaagggttccggg

SEQ ID NO: 113519 - DNA, 761 bp, Homo sapiens
  misc_feature: GYAE6OF01DWY74.15.86.H09.1.454.CMB.1.raw
  modified_base (218)..(218): a, c, t, g, unknown or other
  misc_feature (218)..(218): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtaccagtgtagaagtgcaggtggtggagtcgtgggganccgttagggtaaacgccgtggggggtcccttaggacgttctccgtgtggtcggccctcgtggtacttctactttcgaagttaacgtggcttaggatcggtaggttcgggtccgccgaggtccgtccggaggggaagggggctggggaggttggggttggtaacgtttaacaaaaagtaaaatgaataggtanaaagaaatgacgtacggtnaccgaaccgtagaaagaagtacttccaacctatacctagaaagtataaagttaactaaacgaaaaaacggtcggtttaagttaatttacggaaactaaagtaacgaacctaacgtacccgtaaacggaaaacccggagtaaccaaccggacgacccgtttactaactttaaccgacggtaacccaagtaggtaaccgttacgggaactcgggaactaacgtacgggtaaaaccggtaaaggtacgggtccttaagttggtttaccgttttaagactttaacggtccggggtaccggggtaccccgggtaaagggtacgtaaggttccggggg

SEQ ID NO: 113520 - DNA, 753 bp, Homo sapiens
  misc_feature: GYAE6OF01EL7TJ.15.86.H09.1.454.CMB.1.raw
  modified_base (254)..(254): a, c, t, g, unknown or other
  misc_feature (254)..(254): n is a, c, g, or t
  modified_base (687)..(687): a, c, t, g, unknown or other
  misc_feature (687)..(687): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtcctagtgtagagtgcgtaggtggtggagtcggtggggagtccgttaggtaacgccggtggggtcccttagngtctccgtgtgtcgtcctcgtggtattcgtactttcgagttagtggtcgtggattggtaggttcggtcccgcgaggtccgaccggaggggaggggtcgtgggtagggttggggttaggtaacggtttaaacgtaaaaaggtaaaagtgtaagtacgggtaagaaaagtaaagtacgtaacgtacggtacgacgaaccgtaaggaaagtaagtactaccactactacaagaagtaagtaaacttaaacgtaacgtaaaaaccgggttggttaacttagttaaacgtaactaaaagtaccgaaaacgaccgtaaccgtaaaacgggaaaccgaacggaactaaccgtaccggttacttaccgtaatttaaccaccggtaaccaacgtaaggttacgttaacggaattcaacggtacgtaacgggaaaggtaacgnggttactagtttgttagttacgaaagttccggtacggtaccgggacgtaacgggtactggttcggg

SEQ ID NO: 113521 - DNA, 853 bp, Homo sapiens
  misc_feature: GYAE6OF01CQ7II.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcggctgagcttgggttttccttgctgctatacgttaaaaggtgtccagtgtgaagtgcgaggtggtggagtcgtgggggacgtccgttagggtaaacggcccggttcggggggttaccccttaaggtacgttccgttccgttggttggtcggtcccttcgtggtactttcctaccttttcaagttaagtggtcgtaggagtggtaggttcgggtcccgccgacggtccgtaccggaagggggacggggtcgtagggtacgggttggggttacggtaaccgtttaaacgaaaaaaggttaaaaagtaggtaagtaggtaagaaagtaaaagtacggtaacgtacggtacgacccgaaccggtaaggaaaacggtaagtaacgttaccaacctacttaccgtaacgaaagtaacgtaacgttaaacgttaaaccgtaaaaacgggttacggttaagtttaagtttagaaacctaaaagtacggaaaccgacggtacccgtaaaggaaaacccggaggaacccacgaccgtacccgttaacttaacgtttaccgtaaccgtaacccgaagtaagtaaccggtttaacggaaggtcgaaccgttacggtaaccggtaaaccgggtaaagggcggttacttagttacggtttacgttttagaacgtttcgtaccggggtaccgggaccccgtaaaggggtacccttaagggtttcccggg

SEQ ID NO: 113522 - DNA, 881 bp, Homo sapiens
  misc_feature: GYAE6OF01ARMGP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatacgttaaaaggtcgtccagtgtagaagtgcgaggtggtggagtcggtgggggtagtccgttagggtaacgtccggtcgggggttacccttaggacgttcttccgtggtcggtcggtcctcgtacggtacttcctactttacgtaggttaagtcggtacgttggagtggtagggttcgggtcccgacgacggtccgtaccggaagggggaaggggtcggtagggtagggttggggttacggtaacgtttaaacgtaaaaaggttaaaagtagtagtagggtaagaaagtaaaagtacgtacggtacggtacgaccgtaaccggtaaggaaaggaacgtactaaccgacctactacgtaacgaaagtaagtaattaaacgtaaccgaaaacggttggttaagttaacttagaactaaaagtacgaaaccgtacgtacccgtaaacggaaaaccggaccgaaaccaaccggtaaccgttacccggttaacttaacgttaacccgtaactaaccccgaagttaacggttaacggttaacgggaactaccggtaacgtaacggtttaaacgggaaaccgggttaaaagggtaccggtactttaaggtttaccggttttaacggttttaaggttaaccgtttacccgggggtaccggggttacccccgggggtaaaccgggtaaaccgggtaaccgtttaacggggtttcccgggg

SEQ ID NO: 113523 - DNA, 868 bp, Homo sapiens
  misc_feature: GYAE6OF01BPLTC.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagacggacctcaccatggagttcgggctgagctgggttttccttgctgctatacttaaaggtgtccagtgtgaagtgcaggtgtggagtcgtggggagccttaggtaacgccgtgggggtcccttagacgtctcctgtgtcggacctcgtgtattctacgtttcagtaatggactggagtgtaggttcgggtcccgaccacgggtcctacccggaggggtaacgggggtccgtaggggtacggttgggggttacggtaacggttttaacgaaaaaggtaaaaagtgtaacgttagggtaggtaaaagaaaattaggtaaccgtacggtacgtaccgaacccggtaggaaaaggaaggtacttacgacctacgtacctagaaagtaagtaataacgttaacgaaaaaccgggtcggtttaagttaacgtttagaacgtaaaacgttgaaaacccggtactaacccgttaaacggaaaacccgggaacgaaccaaccggttaacgggtccctttaaacgttaacgttttaacccgaacgttaaccccgaaggttaacggttacttttaaccggggaagtttccgggaaccctaaagggttcccgtaaaaccggggttaaagggggacccttaacggttttacccgaggtttaaccccgggttttagtaaacgtttcccgggggttaaccccggccgggggtttaaaccccgaaacggggggttaaaccctttcccgggggtttaaccgggg

SEQ ID NO: 113524 - DNA, 644 bp, Homo sapiens
  misc_feature: GYAE6OF01BKWCG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtgggggtcccttagagtctcctgtgtcggcctctggtattccacttttcagtaatggctggatggagttgggtccgccgaggctccgaggggaaggggctggaggtgggttgtacgtttaacaaaagtaaaatagatggtagaagaaatagacgtacggtgaccgaccggtagaaaggagattaccactatactacaagagtaataattaacaaaacgtacggttagtacgtttagactaaatgaaccgagaccgtaacgaaaccgagacacagacctagttattacgtacaccacgtaagtacgttaggaacgtgtcaacgttacggaaacgggtaaaggacggtacttagttacggttcgtttagacttacgttcgggtacgggaccccgaagggtacgtaaggttccggg

SEQ ID NO: 113525 - DNA, 789 bp, Homo sapiens
  misc_feature: GYAE6OF01DLFM8.15.86.H09.1.454.CMB.1.raw
  modified_base (118)..(118): a, c, t, g, unknown or other
  misc_feature (118)..(118): n is a, c, g, or t
  modified_base (596)..(596): a, c, t, g, unknown or other
  misc_feature (596)..(596): n is a, c, g, or t
tcagtctacgtagccacgaccggtgctcgatttagtgctatagacttggggtttggggggggagaggacgccccagccttgggactccccaagttgttttcattcagtgatcaggacngaacacagagactcaccagtggagttcgggctgagtcgttgggttttcctgctgtactacttacgttaaaggtcgtaccagtgtagaagtgcgtagggtggtgggaggtcggtaggggacgtccggttagggtaacggtccgggtcggggggttacctaggtacgtcctccgttgtcggtcggtcctcgtggtacttcctacgttcgagtagtggcgtggtacgtaggtcggtcggtcccgacgacggtccgtacgggaacgggggagggtcggtaggggtagggttacgggttacggtaaaccgtttaaagtaaaaagtaaggtaggtacggtaggtaaacgaaagtaaaagacggtaacgtacggtacgaaccgtaacggtaaaggaaacgtaactacgtacaacgtactacgtaacgaaactaagtaacttaaaggaccgtaaaacgggttacggtattaacgtacaaaggtaanaacgaacgtcgtaacgaaaaccggaacgacgacccaaccgtcggttacccttaagttaaaccgtcgtaaaccacgtaagactacggttacgaacgtcaacgttagaaacggtaacgaaggcgttacgtagttcttaggttaacgacgttaccggtacgggtacccgaggggaacggtagtcgggtttacccgg

SEQ ID NO: 113526 - DNA, 935 bp, Homo sapiens
  misc_feature: GYAE6OF01B2P0E.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaggtgtccagtgtagaagtgcgtaggtggtggagtcgtgggggacgtccgttaggtaaacgccggttgggggttaccccttaggacgtctccgttgtggtcggtccttcgtggtactttctactttcagtaagtggtacgtggtacgtggtaggttcggggtcccgaccgtacggtccgtaccggagggggtaacgggggtccgttagggtacgggtttagggggtttacggtaaccggttttaaacgaaaaaaggttaaaaacgtggtaacgtttagggtaagtaaaaggtaaaaagtaccggaccgttaaccgggtcgaacccgtaaccggtaaggaaaacggtaacgtaacgttaacccacccgtaactaccgtaacgaaaggtaagttaaacgttaaacgttaaaccgtaaaaaacgggttaccgggtttaagttttaaacgttttaacgaaaccgttaaaagtaaccggtaaaccgtaaacccggtaacccgttaaacgggaaaaaccccggacggtaaaccccgtaacccgtaaccgggtacccgtttaaccgtttaaaccgtttaacccgttaaccggttaaccccaaccgtaacggttaccggtttaaaccggaaggttacgacccgtaagtaacccgggtaaacggtaaagggtcgggttacttaaggttacggtttaccttttaggaaactttaccgggttcccgggtaaccggggtacccgtaaacggggtaacctacgggtttaccggg

SEQ ID NO: 113527 - DNA, 875 bp, Homo sapiens
  misc_feature: GYAE6OF01C5M67.15.86.H09.1.454.CMB.1.raw
  modified_base (207)..(207): a, c, t, g, unknown or other
  misc_feature (207)..(207): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttcctgctgctatacttaaaggtcgtcagtgtagagtgcgaggtggtggngtcgtggggactcgttagggtaacgtccggtcgggggtcctagtagtctcgtgtgtcgtctcgtgtacttctacttacgtagtagtggtcgtggtagtcggttaggttcgggaccgcgacggccgtaccgggaggggacgggtcgtaggggtagggttagggttacggttaacggtttaaacgaaaaaaggttaaacgtaggtaggttaagggaaggtaaaagtaaaacgtaacggttaccgtaacggtacgaaaccgtaacccgggtaaaggaaacgtaaagtaccttaaccaccgtataccaacggtaaagtaagtaacttaaagtaaaccgtaaaacggtagggttaacgttaacgtttaacggaaactaaaacggtacgaaaacggtaaaccgtacccgtaaaacggtaaaaccgggtaaccgaaactaacccggtaacggtaccgtttaacctttaacgttaaccgtaaccgttaaacccgacgttagttaaacggtaacggtaacggttctaaaccggtaaacggttacccggtaaaaacgggtaacggaagggtttaaccgttagttacgggttttaactttaccggtaaggttttacccgttacccggggggttaacggaacccccgggttaaagggttaccgtaacggggttcccgggg

SEQ ID NO: 113528 - DNA, 968 bp, Homo sapiens
  misc_feature: GYAE6OF01DJI4A.15.86.H09.1.454.CMB.1.raw
tcagtctacgtagccacgaccggtgctcgatttagtgctatagacttggggtttgggggggagaggagccccagccttgggatccccaagtgttttcattcagtgatcaggactgaacacagagactcaccatggagttcgggctgagctgggttttccttgctgctaatacttaaaaggtgtccagtgtgaagtgcagggtggtggaggtcgtgggggagtccgttaggtaaacggccggtggggggttccccttaaggacgttcctccgtggtggtcggtcctcgtggacttctactttacgagttaagtggtcgtaggagttggtaggtttcggggtaccgccgaaggtccgtaccgggaagggggtaaacgggggcgtggggtagggtttggggttacggtaaaccgttttaacggaaaaaaggttaaaaaagtggtaagtagggtaagaaaagtaaaagtaacgtaacgtacgggtacgaacccggtaaacccggtaaaggaaaaagggtaaacgtaacgttaccaaaccctaagttaccgtaagtaaaagtaaacggtaatttaaaacgttaaaccggtaaaaaaccggtacggtttaaggtttaacttttaacggaaaccttaaaaagtaacggtaaaaaccgtaccggttaacccggtaaaacgggaaaaaaccccgggtaaaggaaacccgtaaaccggtaacgggtaaccccgtttaacctttaaacgtttaacccgtaaccgttaaacccggtaacgtaaacggtaaccggttttaacgggaaacggttacggtaaccgttaaacgtaaaccggggttaaacgggtaaaaaaggggtaccgggtttacgttaaggttaccggtttacggttttttaaacggaacgtttacggttaacccgggggtacccgggggtaacccggttaaaagggggtaccgttaaacggggttcccgggg

SEQ ID NO: 113529 - DNA, 791 bp, Homo sapiens
  misc_feature: GYAE6OF01EMZD6.15.86.H09.1.454.CMB.1.raw
  modified_base (737)..(737): a, c, t, g, unknown or other
  misc_feature (737)..(737): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtggtggagtcgtgggggagtccgttagggtaaacgccgtggggggtccccttaggagtctcctggtgtcggcctcgtggtattctactttcagttaatggctggatggtaggttcggggtcccgccgacggtccgtcccggaagggggaagggggcgttggggtagggttgggggtttagggtaaccggttttaacgtaaaaaaggttaaaaaagtggtaagttagggtaaggaaagtaaaaaagtaaggaaccgttaacggtacgaccgaaaccccggttaaggaaaagggtaaacgtacttaccaacccgtaattaccgtaaccgaaaaggtaagtaaacttaaaactttaaaccggaaaaaaccggtacgggtttagtttaagttttagaaaccgtaaaaagttacgaaaacgtaaccggtaccctaaacggaaaaacccggtacggaaccaaccgacgtacccgttattaacttaccgtacgtaaccaacgtaagtacgttacggaagttgaaccgagtaccggaaagtaaagggngtacttatgttactttagattagtcggtacgggacccgaagggtacaggttcgg

SEQ ID NO: 113530 - DNA, 908 bp, Homo sapiens
  misc_feature: GYAE6OF01BSO98.15.86.H09.1.454.CMB.1.raw
  modified_base (878)..(878): a, c, t, g, unknown or other
  misc_feature (878)..(878): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggtttcctgctgctatctaaaagtgtccagtgtgaagtgcagggtggtggagtcgtgggggagtccgttaggtaaacggccgtggggggtcccttagacgtctcctggtggtcggtcctcgtggacttctacgtttcagtaaagtggcgtggacgtggtaggttcgggtccgccagggcctccgaggggaacgggggcgtgggtaggtgggggtttagggtacgttttaacaaaaaggttaaaaagtggtaagtagggtacgaaaggtaaaaagttagaacgttaacggtcggaacctaacccgggtaaggaaaaagggtaaacggtaactttaccgaaccgtactaccgttaacgaaaaggtaacgtaagtttaaaaccgttaaacgtaaaaaaacccgggtaccggggtttaagtttaaacgttttacggtaaacgtaaaaacgttacggaaaaaccgaacgtaacccgttaaacggaaaaaaaccccgggacggtaaaacccgtaacccgtaaacgggttcccccgttaaagttaaccgttttaacccgttaacggttaaccccgtaaacgtaccggttaaacggtttaacccgggtaaagggtcccgttaacggtaaaccgttaaacccggggaaaacggtaaaaccggggtgggtaaaccttaggttacgggttttacgttttcggaaacgtttacggtcccgggttacgggggtaaccccgnggggtaaaaccgttaccgggtttaccgggg

SEQ ID NO: 113531 - DNA, 934 bp, Homo sapiens
  misc_feature: GYAE6OF01E4QVW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttaggtaaacgccggtcggggggtcccttaaggacgttctccgttgtggtcggcctcgtggtactttctactttcagtaagttggctaggatggtacggttgggtcccgccgaggcctaccggaaggggaacggggtcgtgggtagggttggggttacggtaacgttttaacgaaaaaggttaaaaattggaagttagggtagaaaggtaaaaagtacggtaacgttaacgggtacgacccgtaaacccgggtaaggaaaaacggggtaataaccgttaccgaacctacgttacccgtaaacgaaacgaaacgtaaagtttaaaacgttaaaccgaaaaaaccgggttacgggtttaacgtttaaagttttaccggaaaacccgttaaaaagttaccgggaaaaaccgtaaccgggtaaaccccgttaaaacgggaaaaaaccccgggttaacgggaaacccctaacgtaacccgggtaccccgtttaacgtttaacttttaaacccgtaccgttaaacccctaacggtaaacgggttaaacgttacccgggtaaagtcggtaaaccgtaaggttaaaccggtaaaaccgggtaaaaagggtcgggtaacccgtttaaggttacggtttcgtttttaacgacgtttaaaccggttccggggaacccggggttaacccccggtaagggtaaacccgtaaacgggttcccggg

SEQ ID NO: 113532 - DNA, 920 bp, Homo sapiens
  misc_feature: GYAE6OF01EWNS4.15.86.H09.1.454.CMB.1.raw
tcagtctacgtagccacgaccggtgctcgatttagtgctatagacttggggtttggggggagaggagccccagccttgggatccccaagtgttttcattcagtgatcaggactgaacacagaggactcaccatggagttcgggctgagtcgttgggttttccttgctgctatacgttaaaggtgtcagtgtgaggtgacacgtggtggaggtcggtgggggacgtccgtcggtccgacggggtcccggggggtcctggacgtactcctccgtgtacgaacgtccttcgtacggtacttccgtaaccgttgacgtaccttaacgttttagttaggtacgttcggtaccggtttccggggtcccgaccggacgggtaccggtaccggggaaggggggtaacgggggtcggtagggggtacgggtcgggggtaccggaacccgaaccgtaaagtaaaacgaaaaacgggtagtaagggtaacgtaacgaacctaaccgtaacgttaacgtaggtaacgtaaccgttcgtaggtacggtacggtaccgggtacctaacgtttccccgacccggttacccgtaccgaacggtaaccggaacccggtaacccaaccggtaaacccgttaacccttaaacccaaaccgttaaccgtacgttaaccgtaacgaaacgtaaacgtaaaccgaaacccgtaaccggttaacggaaccgggtaaccggaacccggggtaaggaacccggtacgggttacgttaggtttaaccggttaatttaacggtgggtaacgttaggtaacggtaacggttacggttttccgggttggttacccggggttaggggttaccccccgggacgggttaaacccggtaccccggtttacggtccccgttacccgttcccttccccggtaccggtaaccccgg

SEQ ID NO: 113533 - DNA, 605 bp, Homo sapiens
  misc_feature: GYAE6OF01BCGXR.15.86.H09.1.454.CMB.1.raw
  modified_base (479)..(479): a, c, t, g, unknown or other
  misc_feature (479)..(479): n is a, c, g, or t
  modified_base (502)..(502): a, c, t, g, unknown or other
  misc_feature (502)..(502): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcacttttcagtaatggctggatgagttggggtccgccaggctccgaggggaaggggctggagtgggttggacgtttacaaaagtaaaatgagtggtagaagaaaatagactacggtgcaccgtgaaaggagatcaccatctacaagagataacttacaaaaacgcggttagtatttaggacaaaagtgaacacgtaccctagaaaaacccgnggaaccacgagcctatacttacngtaacccactagacttacggaagtcgacatacgaacggtaaaggaggtcttagtgttcttttaggattacgtcgtacgggggcccagggtactaagttcgggg

SEQ ID NO: 113534 - DNA, 806 bp, Homo sapiens
  misc_feature: GYAE6OF01AF439.15.86.H09.1.454.CMB.1.raw
tcagtctacgtagccacgaccggtgctcgatttagtgctatagacttgggtttgggggggagaggagccccagcccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttaggtaaagccggtcgggggtcccttagacgtctcctgtgtggcctctggtattctactttcagtaagtggctggatggtaggttgggtccgccaggctccgagggacggggctggagtcgggttaggtacgtttaacgaaaagtaaaatgagtggtagaagaaaataggtaacctacggtcgaccgacccggtaaggaaaacggtaacgtaacttaccgaaccctagttaccgtaacgtaaaggaacgtaacttaaaacgttaacccgtaaaaaacggtacgggtttagtttaagttttaacgaaacgtaaaacgttaacggaaacccgtaagaccccgttaaacggaaaaacccgggacggaaacccaacccggaacgtacccgttacttaaccgtttaaccgtaccgttaaacccaacgtaacggtaacggttaacggaacggtagaacccgtaaagtacgggtaaaacccgggtaaaaggccgggtaacttaaggttacgtttacggtttttaagaacgttttaggttacccggggtaccgggggtaacccccgtaaggggttaaaccgtagggtttcccgg

SEQ ID NO: 113535 - DNA, 627 bp, Homo sapiens
  misc_feature: GYAE6OF01A6BNP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtcggcctctggattcactttcagttaatggctggatgagttgggtccgcaggctccgaggggaaggggctggagtgggttggacgtttacaaaagtaaaatgatggtagaagtaaaagtagacgtacggtgaccaccgtagaaagaagatcacatctacaagagtataactaacgaaaacgtcggttagtatttgacaaagtgaacacgacctaagaaaaccgagacacgacgcgtactaattactagtacccagagtaacgttcggaagtcacgtaagtaccgaaacgggtaaaggacggtacttagtggttacttttggaactttacgtcgggaccggggtacccaaggggtaacctaggttccgggg

SEQ ID NO: 113536 - DNA, 909 bp, Homo sapiens
  misc_feature: GYAE6OF01BGDKC.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggtttccttgctgctatcttaaaaggtgtccagtgtgaagtgcgaggtggtggagtcgtgggggagtccgttagggtaaacgccgtagggggtcccttaggacgttcgtccgttggtggtcggcccgttcgtggtacttctactttcgagttaatcggtctggactggtacggttggtcccgctaggcctccggaggggaacgggtctagggacggttgggtaggtacggtttacgaaaaagtaaaagtggtaagttacgggagtaaacgtaaaatacgggtaacgttaacgggtcgtaaccgtaaacccggggttaagaaaaacgggtaaacgttaccgtttaaccgaacccgtaagttaccgttaaccgaaaggtaaacggtaaacttaaacggttaaacccgaaaaacgggttaccggtaaggtttaacgtttaacggaaaccgttaaaaagtaccgtaaaacggtaacgtaaccccgttaaacgggaaaaaccccgtagggtaaacccaacccgttaacgggttaccccctaacgtttaaccgtttaacccgtaaccggttaaaccccaacggttaaacccggtaggtttaaacccgggtaacggtactaaccgtaaccgggttacgggtaaaaaccggtaaacgggggttacgtaacgtttaacggttcgggtttaaccttttaagggaactttacccgggtacgggttacccggggtaacccttaacggggaacggtttacggttaacccgggg

SEQ ID NO: 113537 - DNA, 910 bp, Homo sapiens
  misc_feature: GYAE6OF01A2UT0.15.86.H09.1.454.CMB.1.raw
tcagtctacgtagccacgaccggtgctcgatttagtgctatagacttggggtttgggggggagaggagccccagccttgggatccccaagtgttttcattcagtgatcaggactgaacacagaggactcaccatgggagttcgggctggagtcgttggggttttccttgctgtctatacgttaaaaggtcgtccagtgtagaagtgcgagggtgggtggagtcggtgggggtacgtccgttagggtaaacggtccggttcgggggttacccttaggtacgttccgttccgtggttcggtcggtcctcgtggtacttctactttacgtaagttaagtcggtcgtggtagttaggtacggttccggggtcccgtaccgacgggtccgtaccgggaaggggggaacgggggtcggtaggggtaggggttggggtttacgggttaaccggttttaaaacggtaaaaaacggttaaaagtaggtaaggttaagggtaaggtaaaaggtaaaacgttaacggtaacggttaaccggtacggtaacccggtaaccggtaaggtaaaaggtaacgtactaccgaaccgtactacgtaacgaaaggtaagtaaacttaaacgtaaacggtaaaacgggttacggtttagttaacgttaacgaaaagtaaacgtaacgtaaaccgaaccgtaaacccggtaaaacgggaaaaacccggacgaaacgtaacccgtacggtaacccgtttaacttaacggtacttaacccggacctaaggtaacgtttacggtacggtaacgtacgtaacgaaccgggtaaacggtaaagggtaaacggcggttaacttagttacgtttgtttaacgaagtttccggtaccggggaccggtaccggtaagggtaaccgttgggttaccccgg

SEQ ID NO: 113538 - DNA, 823 bp, Homo sapiens
  misc_feature: GYAE6OF01CFZNC.15.86.H09.1.454.CMB.1.raw
  modified_base (750)..(750): a, c, t, g, unknown or other
  misc_feature (750)..(750): n is a, c, g, or t
tcagtctacgtagccacgaccggtgctcgatttagtgctatagacgttgggtttggggggagaggagccccagccttgggatccccaagttgtttcattcagtgatcaggactgaacacagagactcaccagtggagttcgggctggagtcgttgggtttccttgctgctatacgtaaaggtgtccgagtgtagagtgcgaggtggtggagtcggtggggagtccggttagggtaaacggccgggttcggggggtacccttaggtacgttccgttccggtggttacggtcgggtccttacggtacggttactttaccgttaccgtttacgtaaggttaagtcggtacgtagggtagttagggtacgggtttaccggggtacccggaccggtacgggtacccgttacccggggaaggggggtaacggggtccgtaggggtagggtttggggttacggtttaacgtttaaacgtaaaaaaggttaaaagtggtaaggtacgggtaaggaaagtaaaagtacggtacgtacggtacgtacccgaaccgggtaacggaaaggtaacgtaccgtactaaccgtacgtaactaacgtaaggtaacgtaattaaacgtaaaccggtaaaaggtcggtttaagtttaacgtagaaacgtaaacgttaacggaacctacggtaacccgaaacgtaaacggacggtaccacgtacgttaccttatacgttcgtaacgacctagaccgtaagtcggtaagngtaacaggtaccgaaaggtacgagtacgtattcgttattcgagttcgccgggtacggagaacgtgtaggtcgg

SEQ ID NO: 113539 - DNA, 721 bp, Homo sapiens
  misc_feature: GYAE6OF01ALH9O.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggggagccgttggtaaagccgtggggggtcccttaggagtctcctgtgtggcctctggattcacttttcagtaatggctggatgagttgggtccgcaggcctccgagggaaggggctggagtgggttggacgtttacaaaagtaaaatgatggtagagaaaatagactacggtgcgacccggtagaaaggagatcacatactacgaagagattaaattaccgaaaaacggtcggtagttaacgtttacgaacctaaaagtcgaaaccaagtacccgttaaaggaaaacccgggtagaacccgaacaacggtacccggttacttaacgtttaacctaccggttaacccaagtaaggttaccgtttaacggggaacttcgggactaacgttaccgggtaaaacgggtaaaacgggcgggttaaccttagttaggtttacgtttttaggaactttaacggttaccggggtccggggaaccccggtaaggggtaaaccctaagggtttccgggg

SEQ ID NO: 113540 - DNA, 853 bp, Homo sapiens
  misc_feature: GYAE6OF01C0ARJ.15.86.H09.1.454.CMB.1.raw
  modified_base (819)..(819): a, c, t, g, unknown or other
  misc_feature (819)..(819): n is a, c, g, or t
  modified_base (830)..(830): a, c, t, g, unknown or other
  misc_feature (830)..(830): n is a, c, g, or t
  modified_base (840)..(840): a, c, t, g, unknown or other
  misc_feature (840)..(840): n is a, c, g, or t
tcagtctacgtagccacgaccggtgctcgatttagtgctatagactttgggtttgggggggagaggagccccagccttgggatccccaagtgttttcattcagtgatcaggactgaacacagaggactcaccatggagttcgggctgagcgttgggttttccttgctgtctattacttaaaaggtgtccagtgtgaagtgcgagggtggtggagtcggtggggacgtccgttagggtaaacgtcccgggttcggggggttcccttaaggtcgttccgttccgttggttcggtcggtccctttcggtggtactttccttaccttttacgtaagttaagtcgggtactagggtagttaggtacgggtttccgggtcccgacccggtacgggtcctaccgaaggggtaaacgggggaaacggggtcggtaggggtagggtttcgggggtttaacgggttaaaaccgttttaaaggaaaaaaaggtttaaaaagtgggtaacggttaagggtaaaggtaaaaagtaaaagttaacggtaacggtttacgggacgaacccggtaaaccggtaaggggaaaaacgtaggtaactttacccgaacttaaattccgtaaacgaaagtaacgtaaattaaaacgttaaccgaaaaaccgggttgttaaggtttaattacgaagtaaaacgttagaaccgtacggtaaccgaaacgggaaacgacgtaaccaacggtaccggtacctttaattaacctacctacgtaacccagtaacgagttacggatcgaactagaacgtaacgaaggtctattagttcgtgtttaangtttaaccggngaccccgggngtaagtacgtacg

SEQ ID NO: 113541 - DNA, 746 bp, Homo sapiens
  misc_feature: GYAE6OF01DAH2U.15.86.H09.1.454.CMB.1.raw
  modified_base (67)..(67): a, c, t, g, unknown or other
  misc_feature (67)..(67): n is a, c, g, or t
  modified_base (659)..(659): a, c, t, g, unknown or other
  misc_feature (659)..(659): n is a, c, g, or t
tcagtctacgtagccacgaccggtgctcgatttagtgctatagacttgggtttgggggggagagganccccgggagccttgggatccccaagtgttttcattcagtgatcaggactgaacacagaggactcaccatggagttcgggctgagcttggttttccttgctgctatacttaaaaggtgtccagtgtgaagtgcgaggtggtggagtcgtgggggagccgttaggtaaacgtccggtgggggtcccttagacgttcctccgtgtgtcggcctcgtggtacttctactttcgaagttaagtggtctaggtatggtacggttcgggtcccgcgacggccgtaccggaaggggaacggggtcgtagggaggttggggtttacggtaacgttttaacgaaaaaaggttaaaagtggtaagtagggtagaaagtaaaaacgtggaacgtacggtacgacccgtaaacccggtaagaaaacggtaacgtattaccaaccgtatactacgaaagagtaacttaacgtaaacgaaaacggtcgttagttaattaacgaacgtaaatacgaaactacggtacctaaaggaaaacccgagtaccgaacgtacgaccctttatacgttaacctaccgtaaccaagtagttacggttacgaagttnaccgtaagtaccggaaacggtaggacgtattaggttgttacgtttacgagttagtccgggtacggacccgaaggtactgggttccgg

SEQ ID NO: 113542 - DNA, 790 bp, Homo sapiens
  misc_feature: GYAE6OF01ETQ9N.15.86.H09.1.454.CMB.1.raw
  modified_base (744)..(744): a, c, t, g, unknown or other
  misc_feature (744)..(744): n is a, c, g, or t
tcagtctacgtagccacgaccggtgctcgatttagtgctatagacttgggtttgggggggagaggagccccagccttgggactccccaagtgttttcattcagtgatcaggactgaacacagagactcaccatggagttcgggctgagcgtgggttttccttgctgctatcttaaaggtgtcagtgtgaagtgcaggtgtggagtcgtggggacgtccgttaggtaaacgccgttgggggtccccttaggacgtccttccgtgtcgtcggccttcgtaggtatttcctacgttttacgagttaacgtggcgtaggtatcggtaagttcggggtcccgccgaacggcttacccggaaggggtaagggccgtgggagggttcgggtaggtaacgtttactaaaaaggtaaaaatgtaagttggtagtaaagtaaaagtcgaacgtacggacgtaccgtaacccggtaagaaaggtaaagtaccttaccgaactacgtaccgtaacaaagaagtaaataactaaacgaaaacggtcggtagttaatttaagaacgtaaaagtacggaaactaacggacccgttaaaggaaaaacccggaggtaaacccacgtaaacggttaccctaagttaacccttaacgttaacgaaacccgtacgtaaaccgtaaggttaaccggtaacgtaggaccctaaggttacccgaaaaggtaaacgggtagtacgttaactagttccggttttaaaanacgttacggtaccgggtacgggtaccgaacgggtaacgtaggtcgg

SEQ ID NO: 113543 - DNA, 869 bp, Homo sapiens
  misc_feature: GYAE6OF01ERBQU.15.86.H09.1.454.CMB.1.raw
  modified_base (824)..(824): a, c, t, g, unknown or other
  misc_feature (824)..(824): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagtcgttggttttccttgctgctatacgttaaaggtcgtctagtgtagaagtgcgaggtggtggagtcggtagggggacgtccgttagggtaaacggtccggtcgggggttcccttaaggacgttcctccgttgtggtcggtcctgtgtacttacctacgtttcgaagttaacgtcggtcgtaggtacgtggttacggttccggggtccgaccgacggtccggtaccggaacggggggtaacggggtcggttaggggtaggggtttcggggttaggttaaccggtttaaaacgaaaaaacggtttaaaacgttaggtaacggttagggtaaacggtaaacgggtaaaaaacgttcggtaaccggttaccgggtacgtacccggtaaacccggttaagggaaaacgggtaacgttaaaccgttacctaacccgttaacgtaccgtaaacgtaaaggtaactaaacgtttaaacgttaaaaccggaaaaccggttacgggtttaattaaggtttaacgaaacgtaaaagtaccggaaacgtaccggtaaaccgtaaccgggaaaacgtccgaacgaccgtaccgtaccgtaacttacgtaaccgtacgtaacacgtagtaacgtacgtaacgtcaacgtaggtaactaaccgggaaagtccgtacgtattagtcgtttaanacgtacggttacggacggtacccggtaagtcccgtggttacccgg

SEQ ID NO: 113544 - DNA, 875 bp, Homo sapiens
  misc_feature: GYAE6OF01C8IBN.15.86.H09.1.454.CMB.1.raw
tcagtctacgtagccacgaccggtgctcgatttagtgctatagacttgggtttgggggaggaggagccccagccttgggatccccaagtgttttcattcagtgatcaggactgaacacagagactcaccatggagttcgggctgagctggttttccttgctgctatcttaaaaggtgtccagtgtgagtgcaggtggtggagtcgtgggggagccgttaggtaaacgccgtggggggttccccttaggacgttctccgtggtgtcggcctcgtggattcgtactttcgagtaagtggcgtggatggtagttcgggtcccgccgaggtccgtccgaaggggaagggggtcgtagggtaggttggggtttggtaacggttttaacgaaaaaggttaaaatggtaagttagggtagaaagtaaaaagttaggaaccgttacggtacgtaccgtaaacccggttaaggaaaaacggtaacggtaacttacccgaaccctaacgttaccgtaaccgaaaaggtaaacgttaaacgttaaaacgtttaaaccgtaaaaaaaccgggtaccgggtttaagttaacgttttaacggaaacgtaaaacgttaaacgaaaccgtaacggtaaccccgtaaacggtaaaaaaccccggaagggaaccctaaacgtaaccggttaccccgtttaaccgttaagtttaacccgttacgtaaccccgtaaacgtaacggttaacgtttacgggaacgttacggaccgttaaacgtaccgggtaaacggtaaaaggggtacggtacgttaagttacggttacgtttttagaagttaacgttcgggtaaccggggtaccccggtaaaggggaaccgttaagggttaccggg

SEQ ID NO: 113545 - DNA, 756 bp, Homo sapiens
  misc_feature: GYAE6OF01AJD5P.15.86.H09.1.454.CMB.1.raw
  modified_base (181)..(181): a, c, t, g, unknown or other
  misc_feature (181)..(181): n is a, c, g, or t
  modified_base (674)..(674): a, c, t, g, unknown or other
  misc_feature (674)..(674): n is a, c, g, or t
  modified_base (697)..(697): a, c, t, g, unknown or other
  misc_feature (697)..(697): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtntccagtgtgaagtgcaggtggtggagtcgtggggatccgttggtaaagccgtgggggtcccttagagtctctgtgtcggcctcgtggtattctactttcagtaatggtctggtatggtaggttcgggtcccgcgaggccgtaccggaggggaacggggtcgtagggaggttggggttaggtaacgttttaaacgaaaaaggttaaaaagtggtaagttagggtaagtaaaaggtaaaaattaggaaaccggttacgggtacgaaccgtaacccggtaaggaaaaagggaacgtacttaccgaaaccgtacgtacgtaacgaaaggtagtaaactttaaaacttaaccgaaaaaaccggttggtaagtttaacgtttagaaacctaaagtagaaaccgtaacgtaccgtaaacggtaaaaaccgacggtaaaccactacggtacccgttactaagttaccgtaagtaaccaagtacgtaagttacgagtaccgntaacgtacgaaacggtaaacggngtctagttcgtcttttaagacgtttagtccggacggacccgaaagggtctaggttccgg

SEQ ID NO: 113546 - DNA, 803 bp, Homo sapiens
  misc_feature: GYAE6OF01CC7KG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggaggtcgtgggggagccgttagggtaaacggtccgtgggggggtccccttaggacgttccgtcctgtgtcgggcctctggattctactttcagtaatggctggatggtagtcggtccgccgaggcctaccggaggggaagggggtcgtggggtagggttggggttacgggtaacggttttaacgtaaaaaaggttaaaaagtagtaaggttagggtaaggtaaacggaaaaagttaacggtaaaccgtaggttacggaacccgtaacccgggtaaggaaaaacgggtaacgtaacttaccaacgtacttacctacgtaaaggaacgtaattaaacgttaaccgaaaaaccggtggttagttaatttacggaactaaaaagtacgtaaaccgaaccggtaccgtaaaaccggaaaaaccgggacggaacccaacgtaacgtacccgttacttaaacgttcccgtaataacccggactaggtaaaccgttggaacgtgacctaacgtacggaaacggtaaaggcggtacttaaggtgttacgttttaacgattacctttaccgggaccggggacccgaagggtaaaccgtaggttccggg

SEQ ID NO: 113547 - DNA, 669 bp, Homo sapiens
  misc_feature: GYAE6OF01E3KIB.15.86.H09.1.454.CMB.1.raw
  modified_base (422)..(422): a, c, t, g, unknown or other
  misc_feature (422)..(422): n is a, c, g, or t
  modified_base (619)..(619): a, c, t, g, unknown or other
  misc_feature (619)..(619): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttcctgctgctatacttaaaaggtgtccagtgtgaagtgcaggtggtggagtcgtggggagccgttggtaaagccgtgggggtcctagcgtctcctgtgtcggcctcgtggtattctactttcagtaatggctggatgtaggttcgggtcccgcgacggcctaccgagggggaagggcgtggaggttgggttaggtacgtttaagaaaaagtaaaagtgagtaggtagaagaaatagacgtacggtcgaccgaaccggtagaaaggaanattaccactactaccgtagaaacgtagtaattaactaacgaaaacggtaggttattaacttagaaactaaagacgaacgtaacgacccgtaaaggaaaaccgagaaccacgaacggtcccttataacttacctaaccgtaacctacgtaagtacgtacggtaactcgacgtagtaccggtaaacggtaaaggacgtntagttcgttcgtttagatcgtccggcgggacccaaggtacgtaggttcgg

SEQ ID NO: 113548 - DNA, 787 bp, Homo sapiens
  misc_feature: GYAE6OF01CZ3BM.15.86.H09.1.454.CMB.1.raw
  modified_base (447)..(447): a, c, t, g, unknown or other
  misc_feature (447)..(447): n is a, c, g, or t
  modified_base (756)..(756): a, c, t, g, unknown or other
  misc_feature (756)..(756): n is a, c, g, or t
tcagtctacgtagccacgaccggtgctcgatttagtgctatagacttgggtttgggggagaggagccccagccttgggatccccaagtgttttcattcagtgatcaggactgaacacagaggactcacatggagttcgggctggagcgttgggttttccttgctgcttatacgttaaaaggtgtcgtagtgtagaagtgcgtaggtggtggaggtcggtggggactcgttagggtaacgtccggtcgggggttccttaggcgttccgtccgttggtggtcggtcctcgtaggtacttcgtactttagaagttagtggtcgtggagttgggtacggtttcgggacccgacgaccggtaccgtaccggggaagggggtaacggggtccgtaggggtagggtttacggggttacggttaaccggttttaaaagaaaaaggtttaaaaagngggtacgtaagggtaagtaaaacggtaaaagtacggtaacggtacggtagtaacccggaaacccggtaaggaaaaggtaactactaaccgaacgtacgtacaagaaagtaagtaaattaaacggttaaccgtaaaaagggtccggtttattaagtttaacgaaagttaaacgaacggtaacgtacgaacccgaaagggaaaaccccgagtaacgaccgtaacgtacccttagtaactacgttacaacccgaatacgtaacgtacggagtagaccgttagaacggaagtaggactgttatgttcttaagntttacgcgggacggaccgaggttgaggttcg

SEQ ID NO: 113549 - DNA, 917 bp, Homo sapiens
  misc_feature: GYAE6OF01A3I4P.15.86.H09.1.454.CMB.1.raw
tcagtctacgtagccacgaccggtgctcgatttagtgctatagacttgggtttgggggggaggagggaggccccagccttgggatccccaagtgttttcattcagtgatcaggactgaacacagaggactcaccatggagttcgggctgagctgggttttccttgctgctatacttaaaggtgtccagtgtgaagtgcagggtggtggagtcgtgggggagccgttagggtaaacgccgtggggggtcccttaggagtctccgtgtgtcggcctctggattctactttcagttaacgtggcgtggattaggtaggtttcggggtacccggtccgaaggggtccgttacccggaaggggggaaacgggggtcgttaggggacgggtttgggggttacgggtaacggttttaacgaaaaaagggttaaaaaacgtgggttaagtagggttacggaaaaggtaaaaagtaaggacgtttaaacgggtgaaccgacccgggtaaaggaaaacgggaaagtacgttaacgacctaaacgttactaacgaaaacgggtaagtaacttaaacgttaaaccgtaaaaacggtaccgggtttaagttaacgtttaacggaaactaaaaacgttcgtaaaaccggaacggttaacccgttaaagggaaaaaacccgggtaggaaaccgtaaaccgtaacggacccgtaacctttaacgttaacccgtaacgttaaacccctacgtaaaacggtacgttaacggggtaacggttacgaaccgtaagttaacccggtaaaacggggttaaaacgggtaaggtacccgttaaagtacccggttcgtttttaaagggaaactttaccggtttacggggttaccggggaacccccggttaaaggggtaaaccccgtaagggtttaccccggg

SEQ ID NO: 113550 - DNA, 813 bp, Homo sapiens
  misc_feature: GYAE6OF01B18A7.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctcacaggtctctgtgctctgcctgtgctgactcacgcccccgtctgcatctgccttgcgtgggacgcctcgatcaagcctcacctcgaccaaccctaaggtagtgagcataccgaacctacaccatacgaataggtactacaacgagaacgaccgacgggaaccgtcccccaagtataataagtagtaaaagttaagagtagagtcggacacgaccgaaccgaaccgggaaacggggggaaccgggtacccgtacccccggtaagtcccgtacgtttaccgaaggtccgggtaccttaccgtacgggtttccggtcggggtcccgtacggtaccccgtaccctacccgtacctaacccgtacctccctaaaccccgtaacccctcccgtaacgtacgttaaccggacgtagtcgggtacgtaccgtaggttaaccgtacttcgaaccgggttggtaacgggaacggtaacggtaacggtaaccctaactaaacgttacgtttaacggaacggttaccgggaacccgggtaaacgggtttacgggggttttacggggttacgggggttaccccggggtagggggaaaccccggggtaacggtaaaccgggtccccgggtttaacccgggtaacccgggttaccccggttaaacgggttccccggaaacccggg

SEQ ID NO: 113551 - DNA, 1010 bp, Homo sapiens
  misc_feature: GYAE6OF01CV5UY.15.86.H09.1.454.CMB.1.raw
  modified_base (310)..(310): a, c, t, g, unknown or other
  misc_feature (310)..(310): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggttttcctgctgactatacttaaaaggtgtccagtgtgtaagtgcgaggtggtggtagtcgtgggggagtccgttagggtaaagtccgggttcggggggttcccttaaggacgttccgtccgtggtggtcggtcctcgtaggtattctaccttttanaagtaagtggtcgtggtagtggtaggtttacggggtcccgccggacggtccgtaccgggtaagggggtaaacgggggtcgttaggggtaaggggtttcggggttaacgggttaacggttttaaaccgtaaaaaaaggttaaaaagttaggtaagttagggtaaggtaaaggtaaaaaccgtaaggtaaccggttaaggtaccggaaaccgtaaccccgggtaaaggtaaaacgggtaaacgtaacgtttaacccgaaccgttaaactacccgtaacgtaaaggttaaacgtaaacgtttaaaaccgttaaaccgtaaaaacgggttaacggtttaaggtttaacggttttaacggaaacgttaaaacgtaacggtaaaccgtaacccggtaacccgttaacgggtaaaaaacccgggacggtaaacccgtaaaccggtaacgttaacccggttaaccttttaaaccgttaaccgttaacccgttaaaccccaaacggttacggttaaccgggtttaacgggaaccggtttagggaacccgttaaacggttaaacccggggttaaaaggtaaaccggggtaaccgggttacgttaacggtttagtttaacccggtttttaagggtaaccgtttacggtacccgggggttaccgggtaaccccgggttaaacgggtaacggttaaaccggttttcccggggg

SEQ ID NO: 113552 - DNA, 625 bp, Homo sapiens
  misc_feature: GYAE6OF01BC8NB.15.86.H09.1.454.CMB.1.raw
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagccgttggtaaagccgtggggggtcccttagagtctcctgtgtggcctctggattcactttcagttaatggctggatggaggttggtccgccgaggctaccgaggggaaggggcgtggaggtgggttaggtaacgtttacgaaaaagtaaaagtgagtaggtagaagaaaatagaactacggtnaccgacccggtagaaaggaanattacacctatacacaagagaattaataacgaaaaacgtcggtagtagttagacaaatagaacagacctaagaaaccgaggaacacgagtccgtactaattaccgtacgaccacgtagtacgtacggtaagcgacagtacgaaacggtaaaggagacgttatgttctttagatagtccggtcgggaccaggtacaggttccgg

SEQ ID NO: 113553 - DNA, 836 bp, Homo sapiens
  misc_feature: GYAE6OF01BWSN5.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtcccgttaggtaaacgccggttcggggggttaccccttaggacggttccttcccgttggtcggtcggtcccttcgtgggtatttcctacgttttcaagttaagtcggtctggtagtggtaggttcggggtcccgccgacggtccgtccggaagggggaagggggtcgttaggggtagggttgggggtttggtaacggttttaacgtaaaaaaggttaaaaagtggtaagtagggtaaggaaagtaaaaagtaaggtaaccgtacgggtacgaccgtaacccggtaaggaaaacggtaaaggtaactttaccgaacctaacgttacctaaccgaaaggtaaagtaaacgttaaacttaaaccggtaaaaacgggtacggtttacgttaagtttacgaaacgtaaataacgaaacgaacgtaacccgtaaaggaaaacccgaggaaccacgtaacgtccttacttacttactacgtaaccaacgtacgtaacgttaggaagtcgaccgtacggtaacggtaaacggtaaagggtacggtacttaagttcgttacgtttaggtaacgttacggtccgggttaccgggggaaccccgtaagggtaaaccgtaggttaccgggg

SEQ ID NO: 113554 - DNA, 708 bp, Homo sapiens
  misc_feature: GYAE6OF01DLBMT.15.86.H09.1.454.CMB.1.raw
  modified_base (289)..(289): a, c, t, g, unknown or other
  misc_feature (289)..(289): n is a, c, g, or t
  modified_base (575)..(575): a, c, t, g, unknown or other
  misc_feature (575)..(575): n is a, c, g, or t
  modified_base (584)..(584): a, c, t, g, unknown or other
  misc_feature (584)..(584): n is a, c, g, or t
  modified_base (621)..(621): a, c, t, g, unknown or other
  misc_feature (621)..(621): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagtcgttgggttttcctgctgcttatacgttaaaggtgtccagtgtgaagtgcgagggtggtggagtcggtgggggagtccgttagggtaaacgtccggtcgggggttcccttagtacgtctccgtgtggtcggtcctgtggtnttcctactttacaagtagtggtcgtggtatggtaggttcgggcccgccgaggcctaccgggagggggaaggggtcgtggggtaggttggggtttacggtaacgtttaaacgtaaaaagtaaagtgtagtaggtaagaaagtaaatacggacgtacggtacaaccgtaccgtaagaaaggatacgtaccactatactaacgaaagtaataactaaacttaaaccggaaaacggttcggttaattaagttagaaactaaagtacaaacgtacgacgtaaagaaaccgngacctacgngtaccctaatcgtaacgctaacagtaggtattaacgngtactacacgtaacgaacgggtaaagccgtcttattcgttagttacgaggttacgtccgggaacgggaccaagggtaactcggttcg

SEQ ID NO: 113555 - DNA, 652 bp, Homo sapiens
  misc_feature: GYAE6OF01A1DIV.15.86.H09.1.454.CMB.1.raw
  modified_base (451)..(451): a, c, t, g, unknown or other
  misc_feature (451)..(451): n is a, c, g, or t
  modified_base (487)..(487): a, c, t, g, unknown or other
  misc_feature (487)..(487): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccttgggtaaagccgtggggggtcccttagaggtctcctgtgtcggcctctggattctactttcagtaatggctggatgagttggtccgcgaggctaccgaggggaacggggcgtgggaggtggggttgggtaacgttttacgaaaaaggttaaaaactgtaagtaggtagaagaaaagtagaacgtacggtgaccgtacccgtaggaaaggaagtataccactatctacaaganaataatacgaaaacgtagtgttaattcgactaaatnaaacagacctagaaaaccgagaacacagccgtataactactacgtaaccacgtaagtagttacggaagtcaacgacgtaacgacggtaaagggacggtcttagttagtcgttttaggaattacgtacgggtacggggacccgaagggaccgtaaggttacccggg

SEQ ID NO: 113556 - DNA, 928 bp, Homo sapiens
  misc_feature: GYAE6OF01DE09L.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagagactcaccatggagtcgggctggagtcttgggttttccttgctgtctatacttaaaggtctcagtgtgaagtgcgagggtgggtggaggtcggtgggggtacgtccgttagggtaaacggtccggttcggggggttacccttaggtcgttaccgttcgttggttcggtcggtccttcggttggtactttccgtaccgtttagacggtccgttaattttagttaggtacgttacggttaccggtttcggggacccggtccggacggtccggttaccgggaagggggtacgggggtcggtaggggtacggggtccggggttacggaacccaaccgtaaacgtaaaacgaaaaagggtagttaagggaaacggtacgaaccgtaaaactaaccgttattacggttaggtaactggtagtagtacggtcggtaccgtactttacccgaccgtttccgaccgtaacggaacgggaacccggaaccgaaaccgaaccggttaaaccctacccgttaacccgtaactaacgttaccgtaaccgtaacaaacgttaaccgaaaccgtaaccgtacggaaccgaacggaccggtaacggaaccgtaccgggtacgtttagggtacgttttaacgttacggttgggttaacgtaggtaaaggttacggtaagggttttcggttaccggggttacggggttacccggggttaccgggggtaaccggtaaccccccgggggtttaacgttaccccgggttaccccgttaacccccgggtttcccttacccccggaccggttccccccgtaaacccccggg

SEQ ID NO: 113557 - DNA, 710 bp, Homo sapiens
  misc_feature: GYAE6OF01AXYGE.15.86.H09.1.454.CMB.1.raw
  modified_base (246)..(246): a, c, t, g, unknown or other
  misc_feature (246)..(246): n is a, c, g, or t
  modified_base (469)..(469): a, c, t, g, unknown or other
  misc_feature (469)..(469): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtgggggagtccttggtaaagccgtgggggtcccttagngtctccgtgtgtggcctcgtggtatttcactttcagttaagtggtcgtggatggtaggtttcgggtcccgaccgaggtccgtccggaggggacgggggcgtgggtaggttgggttaggtacgtttaacgaaaagtaaaaagtgagtaggtagaagtaaaagtagaaccgtacggtcgaccgacccggtaagaaggtaagacttacacgtactcgtacaagganaattaactaacgaaacggtacggttagttattagaactaaatagaacaacgtaccgtaacgaaaaccgaggtaccaaccgtacgtccgttaaccttacgttaaccgtacgtaaccgaaccgtagtaacgttacgggtaagtacacgacgtaaccggtaaacggtaacggaggtacgttagtacgtttgttagacttacgtcgggtacgggtacccggaagggtaaccctaagggttccggg

SEQ ID NO: 113558 - DNA, 752 bp, Homo sapiens
  misc_feature: GYAE6OF01B6AWD.15.86.H09.1.454.CMB.1.raw
  modified_base (564)..(564): a, c, t, g, unknown or other
  misc_feature (564)..(564): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttcccttgctgctatacttaaaaggtgtccagtgtagagtgcgaggtggtggtagtcgtgggggagtccgttagggtaaacggccggtggggggttccccttaaggtacgttccgtccgttggtggtcggtcccttcgtggtattcctacttttacgaagttaagtcggcgtaggagttggtaggttcggggtcccgaccgacggtcccgtaccggaaggggtaagggggtcgtaggggtagggtttgggggttaccgggttaaacggttttaaacgaaaaaaggttaaaaacgtggtaagtaggtaagaaagtaaaaataaggaacgtacggtcgacgaacccgaaggaaaggaatactacaccatcacaagataataataacgaaacgtggttagtattacgaanaacgtagaaactaccgaacccgaaacggacgaacgacgacgtaccgttataattacgtactaaccagtaagtacggtagtatcgcgtaagtaccggaacgtaaaggtacgtcgttaagtcgttaagttttagagttacgttcgggtacgggaacccggaagggtaaccgtaaggttcgggttaacccg

SEQ ID NO: 113559 - DNA, 856 bp, Homo sapiens
  misc_feature: GYAE6OF01B3XEC.15.86.H09.1.454.CMB.1.raw
  modified_base (212)..(212): a, c, t, g, unknown or other
  misc_feature (212)..(212): n is a, c, g, or t
tcagtctacgtagccacgaccggtgctcgatttagtgctatagacttgggtttggggggagaggagccccagccttgggatccccaagtgttttcattcagtgatcgaggactgaactacagaggacctcaccatggagttcgggctgagtcgttgggttttcctgctgctaatacgtaaagtgtaccagtgtgaagtcgcgaggtggtggnggtcggggacgtccgttaggaacgccggttcggggtacccttagcgtctccgtgtgtcggcctgtggtacttcgtacttcgtagtaagtggcgttggagtggtaggttcggtccgcgtaggtccgtacggagggtagggcgtgggtagggttggttaggtaacgttaaagtaaaacggtaaagtgtaaggtacggtaagaaacgtaaaagtaacgtaaccgttacggtacgaccggtaaaccggtaaggtaaaaggtacgtaactaaccgtacctaacgttaccgtaaacgaaacgtaaacgttaaacgttaaaacgttaaaccggtaaaaacgggttaccggttaagtttaaacgtttaacggtaacttaaaacgtaaccgtaaacgtaaccgtaaccgttaaaccgggaaaaacccggtaggaaaccctaacggccgttaacccgttaactttaacgtttaaccgtaccggttaacaacgttaaaccggtacggttaaccgtaagttccgaacgtaacgggttaaaccgtaaagggtaaacggtcccgttaagttggttaaccgtttggtttaacgcgttttaaggtcccgggtaccggttaacccgggaagtaccccgggtttggtaaccggttttcccgg

SEQ ID NO: 113560 - DNA, 914 bp, Homo sapiens
  misc_feature: GYAE6OF01C6VNQ.15.86.H09.1.454.CMB.1.raw
  modified_base (449)..(449): a, c, t, g, unknown or other
  misc_feature (449)..(449): n is a, c, g, or t
tcagtctacgtagccacgaccggtgctcgatttagtgctatagactttgggtttgggggggagaggagccccagccttgggatccccaagtgttttcattcagtgatcaggactgaacacagagactcaccatggagtcgggctggagcttgggttttccttgctgctaatcttaaaaggtgtcagtgtgaagtgcgaggtggtaggacgtcggtgggggacgtccgttagggtaaacgtccggtaggggggtaccccttagacgtcttccgtgtggtcggacccttgtggtacttacgtaccttttacaaggttaatgggcgtaggaagtgtaacggttcgggcccgacgacggacgtaccggaagggggaacggggtcgtagggtaggttcggggttaggtaaaccgttttaagaaaaaaagttaaaatcggtaagtaggggtaaanaaaaggtaaaacgtaggtaacgtacggtacgaccgtaaaccggtaaggaaaaggtaaactactaacctaaccgtaagtacctaaggaaagtaaactaaagttaaaccgtaaaaccggtaaaaaccgggtacggttaaagtttaacttaaacgaaacgtaaaacgtaaaccgaaaccgtaaccggtaaacccggtaaaacggaaaaacccgggaaccggtaaacccgtaaccgtaaccgtttaacccggtttaacgttaaccgtttaaccgtaaccggttaaaccccgtaagtaacggttaacggttaacggtaagtaccgtaaacggtaaccgttaaacgggaaaacgggttaaaaggtaacggttaaccgttaacgtttacggttttaacgttaaacggttacgttaacgggtacccggggttaaccgggtaacccggtaacgggaaacgttaaccggtacggg

SEQ ID NO: 113561 - DNA, 891 bp, Homo sapiens
  misc_feature: GYAE6OF01A3EU3.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttagggtaaacgccgtggggggtcccttaggacgtctccgtgtggtcggcctcgtgggtattctactttcagttaatggctggatggtaggttcgggtccgccgagggcctccggaagggggaagggggtcgtagggtaggttggggtttacgggtaacggttttaacgaaaaaggttaaaaagtagtagtagggtagaaagtaaaagtagaacgtacggtacgaccgaacccggtaggaaaagggtaagtacttaccgaaccctaacttactaaccaaaggtacgtaaattaaacgttaaaccgtaaaaacgggtacggttaacgtttaagttttacggaaacctaaaagttacgaaaacctacggtaaccccggttaaacggaaaaacccgggaacgggtaaacccaacccggaacggttaaccccggtttacttaaacgtttaacccgtacgttaaccccgtaaagtaacgttaaccggtttacggggaaacgttacggaaccgtaacgggttaaccgggtaaacgggttaaaacggggtaccgggtaatttaaccgggttacggttttaccggtttttaaggtaaccttttaacgggttcccgggggttaacccgggggaaccccgggttaaaaggggaacccgtttaaacggggtttacccggggg

SEQ ID NO: 113562 - DNA, 1091 bp, Homo sapiens
  misc_feature: GYAE6OF01CKN5J.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaagccgtcgggggtacccttagacgtcgtcgtgtcgtcggtcctcgtggtacttcgtactttacgagtaagtggtcgtggtaagttggtaaggtttcggggtcccgaccgtacgggtccgttaccccgggaaagggggtaaacggggggtccggttaggggtaaggggtttacggggggtttacggggttaaaacccgggtttttaaaacggtaaaaaaaaacggtttaaaaaacggttacggtaaaggttaaggggttaaggtaaaaacgggttaaaaaacgttaacgggtaaaccggtttaaccgggtacggtaccccggtaaaaccccgggtaaagggaaaaacggggtaaacgttaacgttaacccgaaccgtaaacgtttccgtaaaccgtaaaaggtaacggtaaagtttaaaaccttaaaaccgggtaaaaaaccgggtcgggtttaacgtttaaacggttttacggaaacgttaaaaggtaccgtaaaaaccggtacgtaaccccgggtaaaaaggtaaaaacccccgggacggaaaccgtaacccgttaaccggggtaaccccgtttaaccgttttaaaacgttaaccccggtttaaccggtaaaacccccgtaaacggttaacgggttaaacgggttttaacccggggaaaacggtttcggtaaacccgttaaacgggttaaacccgggtaaaaacggggtttaaaacgggggacccgtttaaacggttaacggtttaacgggtttaccgttttttaacgggtaaacgttttaaccgggtttacccgggtaaacccggggggtcccccgggaaaaacggggttaaccgtttaaaaccgggggttttccccggggg

SEQ ID NO: 113563 - DNA, 761 bp, Homo sapiens
  misc_feature: GYAE6OF01D8F15.15.86.H09.1.454.CMB.1.raw
  modified_base (183)..(183): a, c, t, g, unknown or other
  misc_feature (183)..(183): n is a, c, g, or t
tcagtctacgtagccacgaccggtgctcgatttagtgctatagacttgggtttggggggagaggagcccccagccttgggatcccccaagtgttttcattcagtgatcaggactgaacacagaggactcaccatggagttcgggctgagcgttgggttttccttgctgctatacttaaaggtntcagtgtagaagtgcgagggtgggtggaggtcggtgggggacgtccgttagggtaaacggtcccggttcggggggttaccccttaggacgttccgttccgtggttcggtcggtccttcgtggtacttcttactttcgaagttagtggcgtaggtatggtacggttcgggccgccgacggtccgtaccgggaggggaacggggtcggtggggtagggttggggttacggtaacgtttaaacgaaaaagttaaaagttgaaggtaggtaagaaagtaaaagtacgtacgtacggtacaaccgtaccgtaagaaagtagaaagtacgtacacctatacgaacgaaagagtaataacgtaaccgaaaacggtcgttagttattacgaactaaagtgaaaccacgtaaccgaaacgggaaaccacggaaccacgtaaccgtccgttaagtaactttaaccgtactaaccaacgtagttacgtacggtaagcgtaactacggtaccgtaaaggtaaaggcgttagtagttcgttatttaagaccgttacggtcgggtacccgggaacccgtggtaaccgtcggg

SEQ ID NO: 113564 - DNA, 845 bp, Homo sapiens
  misc_feature: GYAE6OF01ETS25.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaggtgtccagtgtgaagtgcaggtggtggagtcgtggggagtccgttaggtaagccgtgggggtcccttagagtctcctgtgtggcctcgtggattctactttcagtaagtggcgtggatggtaggttcggggtcccgaccgtacggtccgtaccggaagggggaacgggggtcgtacggggtagggtttgggggtttacgggttaacggtttaaacgtaaaaaaggttaaaaagtaggtaagttagggtaggtaaaaggtaaaaagttaacggaacgttacggtacgaccggtaacccggtaaggtaaaacgggaacggtaacttaccgaacctaacgtacgtaacgtaaaaggaacgtaaattaaacgttaaaccgaaaaaacgggttacggtttaagttaacgttttacgaactaaaacgtagaaacgtaaccgacccgttaaacggaaaaaccccggtacggaaacccgaacgaaccggttcccgttaaaccgttaacgtttaaaccctaccgtaaccgtacgtaaaccggttattaaccggggaagtcgaaccgtaacggtaccgtaaaacgggtaaagggccggttaacttaggttcgttacgttttagaaccttacggttcccggtaacgggggaccctaaggggtacgtaacggtccgggg

SEQ ID NO: 113565 - DNA, 582 bp, Homo sapiens
  misc_feature: GYAE6OF01D18O1.15.86.H09.1.454.CMB.1.raw
  modified_base (371)..(371): a, c, t, g, unknown or other
  misc_feature (371)..(371): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaaggccgtggggggtcccttagacgtctcctgtgtggcctctggattcactttcagtaatggctggatggagttgggtccgccaggctccgaggggaaggggctgggtaggtgggttggacgtttacaaaagtaaaatgatggtnaagaaatagacgtaggagcaccgtagaaacggaanattcacatctcaaganaataatacaaaacgtcggtatattgacaaatgaacagcctaagaaaccgagacacagctactatctagtaccatagtatacggaagtcgcatacggaacgtaaggagtactagtcgtcgtttagattacgtcggtacgggaccgaggtacgagttccggg

SEQ ID NO: 113566 - DNA, 686 bp, Homo sapiens
  misc_feature: GYAE6OF01BMLDA.15.86.H09.1.454.CMB.1.raw
  modified_base (485)..(485): a, c, t, g, unknown or other
  misc_feature (485)..(485): n is a, c, g, or t
  modified_base (521)..(521): a, c, t, g, unknown or other
  misc_feature (521)..(521): n is a, c, g, or t
  modified_base (579)..(579): a, c, t, g, unknown or other
  misc_feature (579)..(579): n is a, c, g, or t
  modified_base (639)..(639): a, c, t, g, unknown or other
  misc_feature (639)..(639): n is a, c, g, or t
tcagtctacgtagccacgaccggtgctcgatttagtgctatagacttgggtttgggggggagaggagcccccagccttgggatccccaagttgttttcattcagtgatcaggactgaacacagaggactcaccatggagttcgggctgagtcgttgggtttttcccttgctgtcttattacgttaaaaggtgtccagtgtgaagtgcgagggtggtggtagtcggtgggggacgtccgttaggtaaacgtccggttcggggttcccttaggcgtcctccgtgtgtcggcctcgtggtattctacttcgaagttagtgtcgtgagtaggtggttcggtccgcgacggccgtaccggaggggacgggtgtaggtagggttgggtaggttaacgttaaacgaaaagtaaagtgtagtaggtagtaaagaaagtacgtacgtacggtacgacgtaacggtaaggaaaggtaacgtactacactatacanaacgtataataactaacgaaacggtgttatagttanaactaaagacgaacacgaccgtaacgaaaacgcgaacaacgtcgaccttatacgtacncgtaaccagtatacgttacgagtacaccgtaagttacgaacggtaaggtcgtaattggtntttacgtagttgtccgttacggcccggtaagacggtcttacggtcgg

SEQ ID NO: 113567 - DNA, 844 bp, Homo sapiens
  misc_feature: GYAE6OF01BGGHZ.15.86.H09.1.454.CMB.1.raw
  modified_base (754)..(754): a, c, t, g, unknown or other
  misc_feature (754)..(754): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatacttaaaaggtgtccagtgtgaagtgcgaggtggtggaggtcgtgggggagtccgttagggtaaacgccggtgggggtcccttaggagtctcctgtgtggcctcgtggacttcgactttcagtaatgggctggagtggtaggttcgggtccgcgaggccgtaccggaggggaagggcgtgggaggtgggtggtacgtttaacgaaaaagtaaaagtgagtacggtagaaagtaaaagtagtaacgtacggtagaccgtaaccggtaaggaaaggaacgtacgttaaccaaccgtaataccgtaacgaaacggtaagtaacttaaacgttaacgaaaaaacgggtcggtttaagttaacgtttacgaaaccgttaaagtaacgtaaaacccgtaacggtaaccccgtaaacgggaaaaaaacccgggtacggtaaacccgaacgtaaacccgggttacccctttaaacgttaacgttttaaacccggtaaccggtaaccccgtaaaggttaacggtaaaccggttttaacggggaaacgtttacggggaacctaaaggttaccgggaaaccggttaaaaaacggggngttaccgttaagttacggtttaccggttttagaacgtttacgttaccgggtaccggggaacccgttacggggaaacgttacgggtacggg

SEQ ID NO: 113568 - DNA, 725 bp, Homo sapiens
  misc_feature: GYAE6OF01ETSXR.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctggttttccttgctgctatcttaaaggtgtcagtgtgaagtgcagggtggtggagtcgtgggggagccgttggtaaagccgtggggggtcccttaggagtctccgtgtgtggcctcgtggattcactttcagtaatggctggatgtagttgggtccgcgaggctccggagggaacggggcgtgggaggttggggtggtacgttacgaaaaggttaaaatgagtggtagaagtaaaagtagtacgtacggtacgaccgacccggtaggaaaaggaacgtaacttaccgaaccaactcctacgaaagaagtaacttaaagttaaccgaaaaaaccgggtacgggttaacgttaagtttaggaactaaaagtaacgaaacgaacggaccgtaaaccggaaaaccggaagggaacccaacgacggttacccgtacttaacttaccgtaacgttaacccacgtaaggtaccgtttacggaacggtagacgtaacgtacggtaaccggtaaagggacgtacgttagttagtcgtttacggtattacgttacggcgggggtacccagggaaccgtagttcgggg

SEQ ID NO: 113569 - DNA, 610 bp, Homo sapiens
  misc_feature: GYAE6OF01APDIX.15.86.H09.1.454.CMB.1.raw
  modified_base (358)..(358): a, c, t, g, unknown or other
  misc_feature (358)..(358): n is a, c, g, or t
  modified_base (510)..(510): a, c, t, g, unknown or other
  misc_feature (510)..(510): n is a, c, g, or t
  modified_base (532)..(532): a, c, t, g, unknown or other
  misc_feature (532)..(532): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctattttagaaggtgtccagtgtgaggtgcaactggtggagtcgtgggggaggcctcgtccagggccgggggggtccctggagactctcctgtgaagcctctggattcaccttgagcacttattggatgacttgggtccgccaggcctccgagggggaaggggctgggagtgggtggccaccataacaaaaagntaggaagtgacacaacctatgtagaactcgtgtgacgtgggacctattccgaccgtctccaagacgaccgacgaccaagaacctcactacatactgaacaaatcgaaaccaacctgaacgagaccggaagacacggtctgtacgtattacgngtgtgagtagtattcggttcgngggtcgggttcggggacccaacgggggtaaccccttcggggtaccctaaccccggttcccgtccccgtcgtaccccgg

SEQ ID NO: 113570 - DNA, 793 bp, Homo sapiens
  misc_feature: GYAE6OF01CF6S3.15.86.H09.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (696)..(696): a, c, t, g, unknown or other
  misc_feature (696)..(696): n is a, c, g, or t
  modified_base (721)..(721): a, c, t, g, unknown or other
  misc_feature (721)..(721): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctggagctgggttttccttgctgctatacttaaaagtgtccagtgtagaagtgcaggtggtggngtcgtgggganccgttaggaacgccgtgggggtccttagagtctcctgtgtcggcctcgtggattcgtacttctagttaatggtcgtggtatggtaggttcgggtcccgtccgaggccgtccgaagggggaacgggtcgttagggaggttggggttacggaccgttttaacgtaaaaagtaaaaacgttggaagttagggtaacggtaaagtaaaaagtcggtaaccgtaacggttacgaacccgtaccggttaaaggaaacgggaaagtaacgttaccaaaccgtatcgttaacgaaaacggtaagtaaacttaaacgttaaacgaaaacgggttacggtttaggttaaacttttcgggaaaaacttaaaacgttcggaaaacaaccggttacccggtaaaggaaaaacccgggtcggtaaaccaccgtacgtaaccgttactaacgtttacgaaccgttacgaactaaggttcgttaagaacggttnacgtagaccggtaaacgttaagggngttccttaagtcggttaacttttgggaattagtaccgggttaccggggacctaaacggtgtacggttacggg

SEQ ID NO: 113571 - DNA, 746 bp, Homo sapiens
  misc_feature: GYAE6OF01C4Y0W.15.86.H09.1.454.CMB.1.raw
  modified_base (424)..(424): a, c, t, g, unknown or other
  misc_feature (424)..(424): n is a, c, g, or t
  modified_base (646)..(646): a, c, t, g, unknown or other
  misc_feature (646)..(646): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgaactgggttttccttgctgctatacttaaaaggtgtccagtgtgaagtgcgaggtggtggagtcggtgggggacgtccgttagggtaaacggccgttcgggggggttaccccttaggtacgttcctccgttggtggtcggtcctcgtggtacttctactttcagtaatggctggatggtagttgggtccgccgaggtctaccggagggaacggggcgtggaggtgggttggtacgttacgaaaagtaaatgagtggtagaagaaatagacgtacggtnaccgaccgtaggaaagaatactacacatctacaagataataacgtaacgaaacgtacggtagttaacgtagactaaagtagaaacgtacgaccgtaacgaaaccggaggtaaccacgacgtacccggttacttaacgttaccgtaacgtaaccctaacgtaggttaacggttacgggtaaacgtacggctaaaacggttaccggtaaaacgggtaaacgggnggtaccttaacggttcggttttaacgttttaacggatttaacggtcgggttacccgggggaacccctaaggggtaacccgtgggttaacgggtttccccg

SEQ ID NO: 113572 - DNA, 746 bp, Homo sapiens
  misc_feature: GYAE6OF01DC352.15.86.H09.1.454.CMB.1.raw
  modified_base (208)..(208): a, c, t, g, unknown or other
  misc_feature (208)..(208): n is a, c, g, or t
  modified_base (484)..(484): a, c, t, g, unknown or other
  misc_feature (484)..(484): n is a, c, g, or t
  modified_base (574)..(574): a, c, t, g, unknown or other
  misc_feature (574)..(574): n is a, c, g, or t
  modified_base (640)..(640): a, c, t, g, unknown or other
  misc_feature (640)..(640): n is a, c, g, or t
  modified_base (731)..(731): a, c, t, g, unknown or other
  misc_feature (731)..(731): n is a, c, g, or t
tcagtctacgtagccacgaccggtgctcgatttagtgctatagacttggggtttgggggggagaggacgccccagccgttgggactccccaagttgttttcattcagtgatcgaggactgaacacagagactcaccatggagttcgggctgagtcgttcggtttcctgacgtgctaattaagttaaaggtgtaccagtgtagaagtgngtaggtggtggagtcggtggggatccgttaggaacgtcggtagggggtccttaggctcgtctggtgtgtcctgtagcttctacttagagtagtgcgtagatcggtaggttcggtccgacgaggtccgtacggaaggggacgggtctagggtaggtgggtacgtaacgttaaagtaaaaagtaaaagtgaagttaggaaagaaacgaaaagttggaaccgttaaggtccgaaccgaaacggtaagaaaaggtaatactacgaacagttccaaagaanaagttaacttaaataaaccgaaaaacggtgttattaagttaagaaactaaagtaaacgaaacaacggtaacctaaaacgggaaaacccgngaaaccacgtaccgacctttataacccttaagaccgtaaccgaaaagtcggtaagttaaggaaggnaactaaacccggtacgaaaggttaaaggagttacttaggttaagtttcgttaagtagtacgttaccggggaaacgggcccgaaaagggtanaacgggttttccggg

SEQ ID NO: 113573 - DNA, 768 bp, Homo sapiens
  misc_feature: GYAE6OF01BOXCC.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggctgagcttgggtttttccttgctgctatacgttaaaaggtgtccagtgtgaagtgcaggtggtggagtcgtggggagtccgttggtaaagccgtgggggtcccttagagtcctcctgtgtcggcctcgtgattctactttcagtaatggtctggatgtaggttcgggccgcgacggtcctccggaggggaggggtcgtagggtggttgggtttaggtacggtttaacgaaaaagttaaaagtggaagtagggtagaaagtaaaagtagaacgtacggtacgaccgtaccggtaaggaaaggtaacgtaacttaccaacctactaccgtacgaaagtaagtaacgttaaacgtaaaccgtaaaaacgggttaccgggtttaattaacgtttagaactaaagtacgaaacgaacgaacccgtaaacggaaaacccggaggaaccaccgaacggtacccgtttacttaacgttttaacctaccggtacctaaacgtagttacgttaacgggaacgtcgtaaccgacgtaacgaacggttaaacgggcgtaacgttgttacggttttcgtttacgttacgttacggtacggtacccggggaacccgtaagggaccgttaagggttcccggg

SEQ ID NO: 113574 - DNA, 727 bp, Homo sapiens
  misc_feature: GYAE6OF01AO0CZ.15.86.H09.1.454.CMB.1.raw
  modified_base (680)..(680): a, c, t, g, unknown or other
  misc_feature (680)..(680): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttagggtaaacgcccggtggggggttccccttaggacgttcctccgttggtgtcggtcctcgtggtactttccactttcgagttaagtggtctggatggtaggttcgggtcccgaccgaggtcctaccggagggggaacggggccgtagggaggttggggttaggtaacgttttaacgaaaaaaggttaaaagtgtaagtagggtaagaaacgtaaatagtacgtacggtgacctacccggtagaaaggaacgtacttacaacctatacctaacgaaagagtaattaaacgtaacgtaaaacggacggttattaagttcgaactaaagtacgaactagaccgtaacggaaaccgtcgaacaccgacgtccctagttaacttcgtacgtaaccagtagttacgtaacggatcgaactagtaccggtaaagaaggtacggtactagttcgttacgtttanaacgtttacgtcggtaccggggacccaagggtaccctggttcccggg

SEQ ID NO: 113575 - DNA, 715 bp, Homo sapiens
  misc_feature: GYAE6OF01E0ZFC.15.86.H09.1.454.CMB.1.raw
  modified_base (312)..(312): a, c, t, g, unknown or other
  misc_feature (312)..(312): n is a, c, g, or t
  modified_base (465)..(465): a, c, t, g, unknown or other
  misc_feature (465)..(465): n is a, c, g, or t
  modified_base (515)..(515): a, c, t, g, unknown or other
  misc_feature (515)..(515): n is a, c, g, or t
  modified_base (696)..(696): a, c, t, g, unknown or other
  misc_feature (696)..(696): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcgttgggttttccttgctgtctattacgttaaaggtcgtcagtgtgaagtgcgaggtggtggaggtcggtgggggacgtccgttagggtaaacggccgggttcgggggttacccttagacgtcctccgttgtgtcgtcctgtgtattctactttcagtaagtggngtggagtggtaggttcgggccgacgcggccgtacggaggggagggtcgtgggtaggttggggttaggttacgtttaaagaaaaaggtaaagtgtagtaggtaagaagtaaagtagacgtacggcgaccgacgtagaaagtactactacactanactaacgaagtaataataaacgtaacgaaaacggttgttagttaagttanaaactaaagtacgaacgaccgaccgtaaaggaaaccgagtaccaacgtacgtcctataacgtactacgaaccctaggtaagttaccggttaagagtaccgataacgggtaacgtaaagggtaacggtacgtcttaagttcgtttacgtttagaacgtttccggaacgggttccggaaccgngggtaaactcgggttacgg

SEQ ID NO: 113576 - DNA, 824 bp, Homo sapiens
  misc_feature: GYAE6OF01EV4SZ.15.86.H09.1.454.CMB.1.raw
  modified_base (726)..(726): a, c, t, g, unknown or other
  misc_feature (726)..(726): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggttttccttgctgctatcttaaaaggtgtccagtgtgaagtgcgaggtggtggagtcgtggggagtccgttaggtaaacgccgtgggggtcccttagagtctcctgtgtcggcctctggattctactttcagtaagtggtcgtggagttggtaggttcgggtcccgccgaggtccgtaccggaaggggaacgggggtcgtagggtagggttggggttagggtaaccgttttaaacgaaaaaggttaaaaagtgtaagttaggtaggaaaagtaaaagtaggaacgttacggtacaccgtaaccggtaagaaaaggtaataacttacgaactactctaacgaaagtaataacttaaagttaaccgaaaaaacggtcggttagttaagtttacgaaactaaagttacgaaacgtacgtaacccgtaaacgggtaaaaacccgagggtaacccaaggtacccggtaccctttaacgttaacgtttaacccgtaacgtaacccaaggttaaaccgttacggttaacgggaacgttcgaaccgtaaggttaaacccgggtaaaccgtaaaaacggggnggttaacctttaggttacggttttacgttttaggaactttacgggtacccgggttaccgggggacccctaaaggggtaccctaagggttttccccggg

SEQ ID NO: 113577 - DNA, 823 bp, Homo sapiens
  misc_feature: GYAE6OF01BDLOE.15.86.H09.1.454.CMB.1.raw
  modified_base (286)..(286): a, c, t, g, unknown or other
  misc_feature (286)..(286): n is a, c, g, or t
  modified_base (769)..(769): a, c, t, g, unknown or other
  misc_feature (769)..(769): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatcttaaaaggtgtccagtgtgaagtgcgaggtggtgggagtcgtgggggacgccgttagggtaaacggccggtggggggtccccttaggacgtccttcccgttgggggggggggtcnccgtcgtggtacttcctactttcgaagttaagtcggtcgtgggatggtacggttcggggtcccgaccgtaggtccgtaccggaagggggtaacggggtcggtgggtacgggttggggtttagggtaaccgtttaaacgtaaaaaggtaaaagtcggtaagtagggtagaaaggtaaaacgtaaggtaccgtaacgggtcgaccgacccgggtaaggaaagggtaactacttaccgaccgtactacgtacgaaagtaacgtaacttaacgtaacgaaaaccgggttcggttagttaagtttacgaaacctaaagtacaaacgacggtacctaaacggaaacccggtaggaacccacggtacgtacccgttaattaacctccggttaactaacccgacttaagttaccggttaacgtaggtaccgtagtaaccgtaacgggtaaaccggttaaaggtacggttacttagttcggttgttttaagngttaaaccggttccgggaacgggtaccgggaacggtaacgtgggtttacccggg

SEQ ID NO: 113578 - DNA, 711 bp, Homo sapiens
  misc_feature: GYAE6OF01A4TP4.15.86.H09.1.454.CMB.1.raw
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggaggtcgtgggggagtccgttagggtaaacgccggtcgggggggttcccttaggacgttcctccgtggtgtcggcctcgtggtacttctactttcagtaatggctggatggtaggttcgggtccgccgaggcctaccggagggggaaggggtcgtgggaggtgggttaggtacgtttaacgaaaaagtaaaagtgagtggtagaagaaaagtacgacgtacggngacgaccggtaagaaagganactacacatactacaaganaataactaacgaaaacgtggtatattacgaactaaagtagaaacacgtaccgtaaagaaaaccggaggaaccaacgtacgtacccgttacttaacttacgtaaccgtaaccaacgtagttaaccgttacgggaaatcgaacctagtaaccgggaaacgtaaggggtacgtacttagttacggtttcgtttagaacttaccggtcgggtacggggtaacccaaggggtaacgtaacgggttccggg

SEQ ID NO: 113579 - DNA, 632 bp, Homo sapiens
  misc_feature: GYAE6OF01E2X1O.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggctggagtgggttggtacgtttacaaaagtaaaatgatggtagaagaaaatagacgtacggtgacacccgtaggaaaaggaagattcaaccatactcaaagagaataattacaaaaacgtacggtagtaatttagactaaagtcgaaacacgacctaaggaaaaacccgagggaaccaacaggtacccgtacttaattaaccgtagtaacccacgaagtagttacgggaagtgacctagtcggaaacgtaaaggcggcttatggtcttttagacttaagtcggtacgggacccaaggggacaaggttcgg

SEQ ID NO: 113580 - DNA, 785 bp, Homo sapiens
  misc_feature: GYAE6OF01D4UGS.15.86.H09.1.454.CMB.1.raw
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacttaaaaggtgtccagtgtgaagtgcaggtggtggagttcggngggcgtcgtaggaacgtcgggtcgggtactagtctctcgtgtgcgtctgngtntctactgatagngtgtgtatgtgtcggccgcgcgtccgtacgggagggacggtggtagggtggttcgggttagttaacgttaaaagtaaaagtaagtagtaggtaggtaagaaagtaaagtacggtaaccggttacgacgacccgtaacggtaaaggaaagtaacgtactaacctactacgtaccgtaagaagtaagtaaagttaaacgtaaacggaaaacggttcggtttaagtttaattacggaaactaaggtaacaacggtaaccgtaccgtaaaacgggaaacccggtacgaaacctacggacgttaaccttacgttaacttaccggaaaccgtacccgtaaggtaaccgttacggtaaggtcgaccgtacgtaacggtaaaaccggaaaccgggtaaagggtccgttaacttacggtttaacgtttccgttttaagggaaccgtttacggggttcccggggttaaacccgggggaacccgttaaacggggtgttaaaccggggtttcccgggg

SEQ ID NO: 113581 - DNA, 878 bp, Homo sapiens
  misc_feature: GYAE6OF01ANWXC.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacgttaaaaggtgtccagtgtgaagtgcaggtggtggaggtcgtgggggagtccgttagggtaaacgtccggtcggggggttaccccgttaggacggttccgttccgttggttcggttcgggtcccgttcgttacgggtactttccgtaacgttttaccgtaaggttaagttcgggtccgttagggtaacggttgggtacgggtttccgggggtccccggacccggtaggggtaccccgtacccggggtaaaggggggtaacggggggtcggttacgggggtaggggttacggggggtttaacggggttaaccggttttaaaacgaaaaaaaggtttaaaaggttaggtaaggtttaggggttaaggtaaaaggtaaaaacgttaacgggtaaccggtttaacgggtacggtacccgtaaacccgggtaaggaaaagggtaacgtaacttaaccgaaccgtactacgtaacgaaacgtaataacgttaacttaacgaaaacggtcggttagtattacgaactaaagtagaaacgacgacgtaaacgaaaaccggacgtacgacgtaacgtcctataacttacgtacgacccgtaagtacgtacttacgggagttcaacgtacgtacggtaaacgaaagggtgtactaaggttcgttcgtttaagacttacggttcgggacggtaccggtaacggtagtacggttccgg

SEQ ID NO: 113582 - DNA, 856 bp, Homo sapiens
  misc_feature: GYAE6OF01CMRA7.15.86.H09.1.454.CMB.1.raw
  modified_base (289)..(289): a, c, t, g, unknown or other
  misc_feature (289)..(289): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatcttaaaggtgtccagtgtgaagtgcaggtggtggagtcgtggggagtccgttggtaaagccggttaggggggtcccttaggagttcctcctgtgtcggtcctcgtggtattctactttnagtaagtggtctggatggtaggttcgggtacccgcgtaggccgtaccggaggggaaggggtcgtgggaggtggggtttacggtaacggtttaacgaaaaagtaaaagtgtaagtggtaagaaacgaaaagtaggaacgtacggagaccgaacccggtaaggaaaggtaagtacttacaaccgtataactacgaaagtaagaattaaacgtaaaccgaaaacggtagggttattaaggtttacgaaaccgtaaaattacgaaaaccgtggtaaccccgtaaaccggaaaaaccggaggtaaacccgaaccggaaacggttaccccggtttaactttaaacgttacccgttaaccgtaaaccccgtaaacgtacggttaacggtttaacggggaaacggttcgaaccgttaacggtaaacccgggtaaaacgggggttaaacggaacgggtttacctttaacggttacggtttacccgttttttaagggtaaccttaacgggtttacccccgggtaggggggtaaaccccccgaaacggggttaaccgttaaaggggtttccccggggg

SEQ ID NO: 113583 - DNA, 929 bp, Homo sapiens
  misc_feature: GYAE6OF01EC977.15.86.H09.1.454.CMB.1.raw
tcagtctacgtagccacgaccggtgctcgatttagtgctatagacttggggtttgggggggagaggagccccagccttgggatccccaagttgttttcattcagtgatcaggactgaacacagaggactcaccatggagttcgggctgagtcgttgggttttccttgctgactaatacttaaaaggtgtccagtgtagaagtgcgtaggtggtggtaggtcggtgggggacgtccgttagggtaaacggtccggttacggggggttacccttaggtacgttccttccgttggttcggtcggtacccgttgtaggtactttacctacgtttctaagttaacgtggtcgttaggagttggtaggttccggggtcccggaccgtacgggtccgtaccggggaagggggtaacgggggtccggtagggggtaggggttacgggggttacgggttaaccggttttaaaacgaaaaaaggttaaaagtaggtaaggtagggtaaggtaaaagtaaaagtaacggtaaccgtacggtacgaaccgtaaccggtaaggaaaggaacgtaacttaaccacctactacgtaaacgaagtacgtaaacttaaacgttaaaccggaaaacggtcggtttaacgttacgtttaacggaaactaaaagtaccggtaaacgtaacccggtaaccgtaaaccgggaaaaccggtaccgtaacccgtaaccgtacggttaacccgttactttaaacttaaccggttaaccgtaacccgagggttaaacgtaaccggtttaagggaacgttaccgtacgtaaacggtaaccgggtaaaaccgtaaagggtaccgtaacttaccggtttaggtttcgtttaacggtaccttaacggggttcccggggaaaccgggtacccggtaaagggtaacctggggtttacccgg

SEQ ID NO: 113584 - DNA, 791 bp, Homo sapiens
  misc_feature: GYAE6OF01CLGYV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacgttaaaaggtgtccagtgtgaagtgcgagggtggtgggagtcgtgggggagtccgttggtaaagccggtgggggtcccttagagtctcctgtgtcggcctcgtggtattctactttcagtaagtggtcgtggatggtaggttcgggtcccgccgaggtccgtccggaggggaacggggtcgtagggtggttggggttaggtacgtttaacgtaaaaagtaaaagtagaagtaggtaagaaagtaaaagtaagtaacgtacggtacgtaccgaacccggtaaggaaacggtaagtaactaccaacctactacgtacaaagtaacgtaattaacttaaaccgaaaaacgtacgggtaagtttaattaaggtaactaaaacgtacgaaaaccgacgtaacccgtaaacggaaaaccggacggaaacccaacggtaccgtacccggtttaacgttaacctttaacgtaaccgtaacccaacgttaacgtacggttaacgtaaacggtcgacgtaaacgttaccgggaaaacggttaagggtacgtacgttaaggttgttccgttttaagaagttaccggtacgggtaccggggacccgtaaacgggtaccgtaagggttccggg

SEQ ID NO: 113585 - DNA, 760 bp, Homo sapiens
  misc_feature: GYAE6OF01BSNFL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagtccgttggtaaagccgtgggggtcccttagagtctcctgtgtggcctctggattcactttcagtaatggctggatggtagttgggtccgccgaggcctccggaggggaaggggcgtagggtaggtggggttggtacggtttacaaaaaggtaaaatgaagtaggtagaaagaaaagtagacgtaggtcgaccgaaccggtagaaaggaacgtacttaccaaccatactacgaaaggtaacgtaattaaacttaacgaaaaacggtcggttagtttaacgtttagaactaaaagttcggaaaacctacggtaccccgtaaagggtaaaaaccccggagggaaacccaaccggaggttaacccccggttatttaacgtttaacccgtacgtaaaccccaaggtaaggtaacgtttaccgggaagtcgtaccgaacgttaccggaaacgggttaaaagggacgtcctttaaggttcggttacgttttacgaattacgttcccgggtacgggggaacccctaagggggtaaccttagggttaccgggg

SEQ ID NO: 113586 - DNA, 914 bp, Homo sapiens
  misc_feature: GYAE6OF01CBGJL.15.86.H09.1.454.CMB.1.raw
  modified_base (783)..(783): a, c, t, g, unknown or other
  misc_feature (783)..(783): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagtcgttggttttccttgctgactatacgttaaaaggtctcgtagtgtagaagtgacgaggttggtggacggtcggtggggacgtccgttagggtaaccggtccgggtcgggggttacccttaaggcgttccttccgtggtcggtcgtccctgtacggtacttctaccgtttagtaagttaagtcggtacgtagggtagttaggtcgggtttccggggtccccgacggtcggtaccgttaaccgggaagggggtaacggggtcgtaggggttagggttcggggttaggttaaccgtttaaaagaaaaaggttaaagtgtaggtaggtaagaaaagtaaaactaggtaaccgtacggtacgaccggtaaccgggtaaggtaaaaggtacgttaaaccttaaccgtaattacgtaaaacggagtaaacggttaaaacgtttaaaccgtaaaccggtaaaacgggttacggtttagttttaagtaaccggtaaactaaacggtaacgttaaaccgaacgtaaccggtaaaacgggaaaacccacgggtaaccaacggtccgtttaaccccgtaattttaacgtaacccgttaacgtaaacccgaaccgggttaggttaacgttaaacgggtacgtaacccgngttaaaccggtaacgggttaaaccgggaaaagttcggtttacctaggtttaccccgtttaggttacttaaaccgttgggacccggggttaccgggacccgttagggtaacccgttggtcgggtttaacccg

SEQ ID NO: 113587 - DNA, 674 bp, Homo sapiens
  misc_feature: GYAE6OF01EUNSU.15.86.H09.1.454.CMB.1.raw
  modified_base (520)..(520): a, c, t, g, unknown or other
  misc_feature (520)..(520): n is a, c, g, or t
  modified_base (630)..(630): a, c, t, g, unknown or other
  misc_feature (630)..(630): n is a, c, g, or t
  modified_base (669)..(669): a, c, t, g, unknown or other
  misc_feature (669)..(669): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggggctgagcgttgggttttccttgctgctatacttaaaaggtgtccagtgtgaagtgcgagggtggtggaggttcggtgggggacgtccgtttaggtaaacggtccggttcggggggttaccctttagacgttccgtccttggtgtcggtcctcgtggtatttcctacttttacgagttaagtcggtctggattaggtagttcgggccgacgacggctaccggaggggagggcgtgggtaggtgggtacggtaacgttaacgaaaaaggtaaatgagtaggtaagaaagtaaacgtagtacgtacggcgaccgtacggaagtaagaagtactcactatacgtacaagagaataataacgaaagtcgttagtatacgaanaagtacgaatacgactaaggaaaccgagacacgacgtactacttaactactacgtaacctagtaagtacgttaccggatacgactaggtaacgtaaacggaagtacggtntattcgttcttagattacggtggaccggacaagggtacnggtcg

SEQ ID NO: 113588 - DNA, 829 bp, Homo sapiens
  misc_feature: GYAE6OF01BP2KZ.15.86.H09.1.454.CMB.1.raw
  modified_base (412)..(412): a, c, t, g, unknown or other
  misc_feature (412)..(412): n is a, c, g, or t
tcagtctacgtagccacgaccggtgctcgatttagtgctatagacttggggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgagggtggtggagtcggtgggggagtccgttaggtaacgccggtggggggtcccttaggacgtctccgtgtcggtcggtcctcgtggtacttctactttcagttagtggcgtggagtggtacggttcgggtcccgccgaggtcctaccgggagggggaaggggtcgtggggagggttggggttacgggtaacgtttaacgaaaaaggttaaaacngggtaagttagggtagaaagtaaaagtagtaaccgtacggtcgaaccgtaacccggtaaggaaacgggtaagtacttacaccctaataccgtacgaaaggaagtaacttaaacgttaaaccggaaaaacggttacgggttaattacgtttacggaaactaaaggtaccgaaactacggtaacccgtaaacgggtaaaacccgacggaaccaaccggtacgtacccttacgtttaacgttaccgtaacccgttaaccgaaccggttaagttaccgtttaacgggaacgttcggaaccgttagtaacccgggtaaagggtaaacggtagggtactttaagttacggttacgttttagggaacttacgggttccgggtacccggggaacccggtaaagggtcccgtaagggtttcccggg

SEQ ID NO: 113589 - DNA, 754 bp, Homo sapiens
  misc_feature: GYAE6OF01C9A2T.15.86.H09.1.454.CMB.1.raw
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (275)..(275): a, c, t, g, unknown or other
  misc_feature (275)..(275): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactccacgcccccgtntgcatctcgccttgcgtacgggacncctcgactacaagcctcaccgtgaccaaccgtaagtagngagtcactacgaacctaccaccancgaagtaggtatacaacagacgtaccgacgggacctaccccgatactaatagaagaaagtaagagtagagtgacacgaccacgaacggaacggggacggacgtacccgtagtccgtactacacggtacggtcctaccgtacgttcggtcgggcgtacggacccgtacctaccgtaccaacctactacccctacccgtaacccttaccgtaccgttacgtacggaaccgtacggtacgggtacgtacccgtaggtaaacgttacgttacgaccgtttagggaacgggttacggaaccgggtaccgaacccggttaaacaaccggtttaaacggttaacggtaacgggtaccggtaaccggaaacggggtttacggggttacggggtacgggtttacccggggaacggggtaacgggaaccggtaaaccggtccggtaaccggttaacccggtaccggttacggtaaccggtaaccccggg

SEQ ID NO: 113590 - DNA, 715 bp, Homo sapiens
  misc_feature: GYAE6OF01D8F2G.15.86.H09.1.454.CMB.1.raw
  modified_base (653)..(653): a, c, t, g, unknown or other
  misc_feature (653)..(653): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagtcgttgggttttcctgctgtctattacgttaaaaggtcgtcctagtgtagaagtgcgagggtggtggagtcggtggggacgtccgttaggtaacggtccgggttcgggggtacccttagacgttctccgtgtcgtcgtcctgtgtacttctacttcgagtagtggtcgtggtatggtcggttcggtcccgccgtacggtccgtacggaaggggacggtcgtggggtaggttgggttacggtaacgtttaaagaaaaagtaagtgtaagtaggagaaagtaagtacgacgtacggtgaccgtaacggtaaggaagtactactaccactactacgtaacgaagtaactaagtaaactaaccgaaacggttgttacgttaatacgaaataacgtaacgtaaccgaagtacccgggtaaagaaaccgcgaccagaccggttacttactattaccgactaccgaagtcggtaattaggaacgtcaacgtacggtacggaaacggtaagggntaccttgttacgttacgtttagcgttccggtccgggacggaccgtaacggttgacggttcgg

SEQ ID NO: 113591 - DNA, 978 bp, Homo sapiens
  misc_feature: GYAE6OF01AITUF.15.86.H09.1.454.CMB.1.raw
  modified_base (444)..(444): a, c, t, g, unknown or other
  misc_feature (444)..(444): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatactaaaggtgtccagtgtagaagtgcgaggtggtggagtcgtggggatccgttaggtaagccggtgggggtcccttagacgtctccgtgtcggtcggtcctacgtgggtacttcgtacttttccgaaggttaacgtgggtcgtagggtacttggtacgggtttcgggtcccgaccgtagggtccttacccggaagggggtaacgggggcttaggggtaacgggttcggggtttacgggtaaccggtttttaacgaaaaaaaggttttaaaaacgngggttaagttacggggttaacggaaaaggtaaaaacgttacggtaaccggtaacgggttaccggaacccggtaaacccggttaagggaaaacgggtaagttaacgtttacccgaaaccgttaacgtaccgttaacgaaaagggtaacgtaaacgtttaaacgttaaacccggaaaaacggttacgggtttattaacgtttacgaaaacgtaaacggttacggaaaccgtaacggtacccgtaaacggaaaaacccgggtaggtaaccctaaccggttaacgttaccccgggtaactttaacggtttaaacccgtccggtaaaccgaaccgggttaacggttaacgtttaacccgggggaaacgtacttacccggtaaaggttaccgggtaaaacccggggtttaaagggaccggttaccgttttaaacggttccgtttagggttttttaaaccaacggtttaccgggtttacccccggggtaacggggacccggtttaaaaggggaaacccgtttgggttttaacccccggggg

SEQ ID NO: 113592 - DNA, 808 bp, Homo sapiens
  misc_feature: GYAE6OF01CSYGV.15.86.H09.1.454.CMB.1.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtcgtcagtgtgaagtgcgtaggtgggtggagtcggtggggagtccgttagggtaacgccggtgggggtcccttagcgtctcgtgtggtcgtcctcgtggtacttctacttnagtagnggcgtggatggtaggttcggtccgcgacggcgtaccggaggggaacgggtcgtgggtaggttggggttacgtaacgtttaaacgtaaaaaggtaaacgtggtaagtagggtaagtaaagtaaaataggacgttacggcgacgtaaccggtaagtaaaggaactactacaacgtactacgaagacgtaataacgtaattaaaccgaaaaggtcggttagttaacgttacgaacgtaaacgtacgtaaaccggtaacgtaccggtaaaacggaaaacccggtaacggaaaccctacggtaaccggtttcccgtaaagtttaaccgtttaacggttaacccgtaaaccgtaacggtaaacggttaacgggttaacccggttaaaggtgtaaacccgtaagggtaaccggtaaaacgggtaaacggtacggttactttaggtacggttttcgtttaaggagttaccggttaggggtaccccgggtaaccggtaaggtaccggttagttcccgggg

SEQ ID NO: 113593 - DNA, 766 bp, Homo sapiens
  misc_feature: GYAE6OF01D07JU.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactccacgcccccgtctgctatctgcccgttgcgtgggacgcctacgtataccgaacgcctcgaaccgtcgaccctaacccgttaaggtagtagacgcacgtaccgaaacctaaccaccatacgtataggtactacaacgagaacgaccgaacggaccgtaccccgtaagtaactaattaaacgtaagtaaacggttaaaggaggtagaggtcgagaaccgaccgaaaccggtaccgggaacgggggaaccggtacccgtacccgtacgtaccgtcgttacgtacggtcgggtacctaccggtacgggttacgggtcggggtacccgtaccggtaacccgtaccgttaccctacccgtaaccctacttacccgaccctacccgtacgtacggtctacggacgaggtcgacgtcgtacgtacgtagtacgtcggtaggaggaacgtacgaccacgaacgtacgtagttacgtaacggtccggtaaacgggtacggttacggggtttacgggttcggggtacggggaacgggaaccgggttaaccggacggttaccggtaccgggtacccggtttcggtacgtccggtaaccccggg

SEQ ID NO: 113594 - DNA, 796 bp, Homo sapiens
  misc_feature: GYAE6OF01BXDMO.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctggagtcgttgggttttcctgctgtctatacgttaaaggtgtcctagtgtgaagtgcgaggtggtggtagtcggtgggggacgtaccgttagggtaaacgtccgggttcggggggttacccttaggtacgttccgttccgttggttcggtcggtccgttcgtggtactttcctactttacgagttaagttcggacgttgggtaagttggtacggtttcggggcccgaccggacggtaccggtaccgggaagggggtaacgggtcggtaggggtagggttggggttaacggtaaccgtttaaacgaaaaagtaaaagtgtaaggttagggaagtaaacgtaaaagtagtacggtaacggtgaaccgtaaaccggtaaggaaacgagtacttaccgaactactacgtaacgaaagtaagtaattaaacgtaacgaaaaggttacgttagttaagttgaaacttaaagaccgaaagtaacgaccggtaaacgaaaccggtacggaactacgtacgaactttacacgttacaccgtaacacgttagtacgtaaggacgtagactaaggtaaccggtaaaggaacggtagtacgttacggtatttccgtagttacgtacggtacccggttacgggaaccaggtaccgttcggttccgg

SEQ ID NO: 113595 - DNA, 816 bp, Homo sapiens
  misc_feature: GYAE6OF01DCWXP.15.86.H09.1.454.CMB.1.raw
  modified_base (202)..(202): a, c, t, g, unknown or other
  misc_feature (202)..(202): n is a, c, g, or t
tcagtctacgtagccacgaccggtgctcgatttagtgctatagacttgggtttgggggggagaggacgccccagccttgggactccccaagttgttttcattcagtgatcaggactagaacacagaggactcaccatggtagttcgggctgagtcttcgggttttcctgctgctatacgttaaaggtcgtcagtgtgagtgngtaggtggtggagtcggtgggggacgtccgttagggtaacggtccggttcgggggtacccttagcgtcctcgtgtgtcgtctcgtgtcttctacttacgagtagtggtcgtaggtagtggtaggttcgggacccgacgtacggccgtacgggaggggacgggtcgtagggtaggttcgggttacggtaacggtttaaagaaaaaggttaaaagtggtaacgtaggtaagaaaagtaaacgtagtaacgtacggtacgaccgtaacggaaggaaacgtaatactacaactatacgaagaagtaagtaacttaaacgtaaccgaaaaggtgttacgttaattacggaaactaaagtacggaaccgttaggaacccgtaaacgggtaaaacggacgtaaccgtaccgtaacggttaccgttaacttaacgttacctaacggtaacccgtaacgttacggttaaccggttacggtaaactcggtaaccgtaagggtaaccggtaaaaccgggtaaggacggttaccttaggtttaccggtttaccgttttaaggacgtttaacccgggtccgggggtaaaccgggaccggtaaaccgggtaagtttcgggttacccgg

SEQ ID NO: 113596 - DNA, 828 bp, Homo sapiens
  misc_feature: GYAE6OF01ARV5B.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttaggtaaagccggtgggggtcccttagagtcctccgtgtgtcggcctcgtggtattcctactttacagtaagtggtcgtggtatggtaggttcgggtccgccgacggccgtaccggagggggaaggggcgtagggaggtggtagtttacggtaacgttttaacgaaaaaagttaaaagtggtaagttagggtaagaaaagtaaaaataggtaacgtacggtacgaccgtaacccggtaaggaaaaggaacgtaacttaccaacctactactacgaaagtaacgtaaattaaacgttaaacgaaaaacggtacggttagtttaagttaacgaacgtaaagtacgaaaacgtaccgtaaccgtaaacggaaaacccggtaacggaacccgtaacgaaccggtaacccgtttaacttaaccgtttactaccggtaaccgtaaccgaaggttaaccgttacggggaacgtcgtaacgtaaacgttaacgggtaaaacggggtaaagggacggttaacgttaggttccgttttaacgtttttaggaaacgtttaccggttacccggggtaacccgggggtaacccgtaaagggggtaaaccttaaacgggg

SEQ ID NO: 113597 - DNA, 782 bp, Homo sapiens
  misc_feature: GYAE6OF01EPOJU.15.86.H09.1.454.CMB.1.raw
  modified_base (180)..(180): a, c, t, g, unknown or other
  misc_feature (180)..(180): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagcttgggttttcctgctgctatacttaaaaggtntccagtgtgaagtgacaggtggtggagtcgtgggggatcccgttaggtaaacgccggtgggggtcccttagagtctcctgtcgtgcctcgtggtattctactttcgaagttaagtggtacttggaattggtaggtttccggggtacccgaccgtaacggtccgtaccggaagggggtaacggggtccgttaggggaaggtttggggttacggtaacggtttaacgaaaaaggttaaaagtgtaagttagggtaacgaaaagtaaaagtacgaaccgttacgggacaccggtaaccggtaaggaaaaggtactacttaccaacctagtactacaaaggacgtaataaacgttaacgaaaaccggttggttaacgttagttaagaaactaaacgtacgtaaacacggtaacgtaaccggaaaacggacaaacgaccgtaaccgtacccggttactttaaacgttcctaaccggtaaccgagttaacggtaaggttacggaaacgttcgaaccctaggtaacgggtaaacggtaaagtggtaacccttggttacgttagttacgattaggtacccgggtcgggaaaccctgggtaactcggtccg

SEQ ID NO: 113598 - DNA, 980 bp, Homo sapiens
  misc_feature: GYAE6OF01C865S.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctggttttccttgctgctatacttaaaaggtgtccgagtgtagaagtgcaggtggtggagtcgtggggagtaccgttgggtaaacgtccggttcggggggttccccgttaaggtacggttccttcccgtggttcggtcgggtcccttcgttgggtaactttccttaaccgttttacctaaaggttaacgtggggtccttagggtagttagggttaagggtttcggggttcccccggacccggaacgggtccccgttaccccggaaagggggggaaaggggggtccgtaggggggtaaggtttcgggggggtttaacggtaaccgggttttttaaaaccgaaaaaaaagggtttaaaaaacgttggtaaaggttgggttaaacggaaaaacgggtaaaaaagttagggaaaaccgtttacggggttacgaacccggtaaaaccccgggttaagggaaaaagggaacgttaaccttaccgaaccctacttactaaccgaaagtaaacgtaaactttaaacgttaaacccgtaaaaaaaccgggtcgggttaagtttaacggttttacgaaacttaaaacggttaagaaaacccgtaacggttaacccgtaaacgggaaaaacccggaaagggaaccctaaaccgggtaaccgtaccccgttaacgttttaacgtaaccgtttaccggtaaaccctaagacggtaagtttaacccgggaagtcgacctaaaggtaccgggaaacggttaaagggcgtaacttaggttagttacgttttacggtaattacgttcccggtacggggacccctaaggggtaacccgtaggttacccggg

SEQ ID NO: 113599 - DNA, 630 bp, Homo sapiens
  misc_feature: GYAE6OF01AWBFA.15.86.H09.1.454.CMB.1.raw
  modified_base (509)..(509): a, c, t, g, unknown or other
  misc_feature (509)..(509): n is a, c, g, or t
  modified_base (541)..(541): a, c, t, g, unknown or other
  misc_feature (541)..(541): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggggagccttggtaaagccgtgggggtcccttagagtctcctgtgtggcctctggattcactttcagtaatggctggatgaggttggggtccgccgaggcctccgaggggaaggggcgtggaggtgggttggacgtttacaaaagtaaaatgagtggtagaagaaaatagtactacggtagcaacccggtaggaaaaggaagacttcaaccatacacaagagaataattacgaaaacgtcggtagtatttagaacaaagtagaacacgacctaaggaaacccgagaccagacgtcctnttaactactagtaacccataagattacggaangtacaagtcggtaaacggtaaggaggtaccttagttaggtcttttagaattcgtccgggtacgggacccgaagggagtaagttccgggg

SEQ ID NO: 113600 - DNA, 666 bp, Homo sapiens
  misc_feature: GYAE6OF01AOH1G.15.86.H09.1.454.CMB.1.raw
  modified_base (392)..(392): a, c, t, g, unknown or other
  misc_feature (392)..(392): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcacttttcagtaatggctggatggaggttgggtccgccgaggcctccgaggggaaggggcgtggaggtgggttggtacgtttacaaaagtaaaatgagtggtagaagaaaatagacgtacggngacacccgtagaaaggaagactacaccatctacaagagataatacgaaaagtcggtagtatttagactaaagtcgaaacagaccgtaaggaaaacccgaggaaccaacgacgtaccgtacttaacgtttacctacgtaacccacgtaagtacgttacggaagtcgaccgacgtacggtaaaccggtaaagggacggtaccttagttacgttcgtttttagactttaacggtccgggtacggggtaaccccgaagggtacgtaaggtttccgggg

SEQ ID NO: 113601 - DNA, 787 bp, Homo sapiens
  misc_feature: GYAE6OF01AT5EG.15.86.H09.1.454.CMB.1.raw
  modified_base (704)..(704): a, c, t, g, unknown or other
  misc_feature (704)..(704): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatacgttaaaggtgtccagtgtagaagtgcgaggtggtggagtcggtggggacgtccgttagggtaaacggtccggtcggggggttacccttaggtacgtccgttccgtgttggtcggtcctgtggtattctactttacgagtaagtggtcgtaggagtggtaggttcggccgacgacggccgtaccggaaggggacgggcgttagggaggtgggttaggtaaccgtttaagaaaaagtaaagtgtagtaggtaagaaagtaaagtacggaacgtacggtcgaccgtaaccggtaagaaacggtaagtactaccaactactactaacgaagaacgtaaataaacttaaccggtaaaacgttcggtttattaacgtttacgaaacgtaaagtacgaaaaccgtacgtaacccgtaaaggaaaacccggagtaccacgtacgtacccttaataacctgtaaccgacaacgtaggtcttaacggagttacgaccgtaaggtaacccggtaaagggttaaacggcgttaacccggtttnttaccgggtttaactttaaggtaaacgtccggttaccggggtaaccgggaacccggtacggttaaaggtcccgtttaccgggg

SEQ ID NO: 113602 - DNA, 826 bp, Homo sapiens
  misc_feature: GYAE6OF01A970W.15.86.H09.1.454.CMB.1.raw
  modified_base (762)..(762): a, c, t, g, unknown or other
  misc_feature (762)..(762): n is a, c, g, or t
  modified_base (777)..(777): a, c, t, g, unknown or other
  misc_feature (777)..(777): n is a, c, g, or t
  modified_base (785)..(785): a, c, t, g, unknown or other
  misc_feature (785)..(785): n is a, c, g, or t
  modified_base (793)..(793): a, c, t, g, unknown or other
  misc_feature (793)..(793): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtgggggagtccgttagggtaaacgccggtggggggttacccttaggtagtcctccgtggtggtcggtccttcgtgggtattcctactttcgaagttaatggtcgtggtagttggtaggtttcggggacccgaccgacgggtccgtaccgggaaggggggtaacggggtccggttaggggtacgggttcgggggtttacggggttaaccggttttaaacgtaaaaaaggttaaaaagtggtaaaggttaggggtaaggtaaaagtaaaaagttacggtaaccgttaacgggtacgaacccgtaaacccgggtaaggaaaaacgggtaagtaactttaccgaacccgtaaacgttacctaaacgaaaggtaacgttaaagttaaaacttaaaccggaaaaacgggtaccgggtttagtttaagtttacggaaactaaaaggttaacggaaactacgtaacccgttaaaggaaaaacccggtggaaccctaacgtacgtacccgtttaatacgtttaccgaacgttaacccaagtagtacgtcggaatcgacngtacgaaggtaaagngtacttangttcttanacgtagtccggcgggaaccaggtgtcggttcgg

SEQ ID NO: 113603 - DNA, 783 bp, Homo sapiens
  misc_feature: GYAE6OF01AI0ZM.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaaggccgtgggggtcccttagagtctccgtgtgtggcctctggattcacttttcagtaatggctggatggtagttggggtcccgccgacggtcgtccgaagggggaagggggcgtgggagggtgggtttacgggtaacgttttaacgaaaaaagttaaaaagtagtagtagggtaggaaagtaaaagtaagtaacgttacggtacgtaccgaacccggtaggaaaacggaagtattaccgaacctactacgtacgaaagacgtaattaaacttaacgaaaaaccggtcggttaagttaagtttacgaactaaaacggtcgaaaaccacggtaaccgtaacggaaaaaacccggaggtaaaccaaccggtacgtacccgttaaccgttaacgtttaacccgtaccggtaaacccaacgtacggttaaacgttacggaagttccggaactagtaaccgggtaaacggtaaagggacggtacttaggtacgtttcgttttagaagttaccgggttacgggtacccggggtaaccgaacggggtaacgttaacgggtcggg

SEQ ID NO: 113604 - DNA, 854 bp, Homo sapiens
  misc_feature: GYAE6OF01ENWCP.15.86.H09.1.454.CMB.1.raw
  modified_base (199)..(199): a, c, t, g, unknown or other
  misc_feature (199)..(199): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcgttgggttttccttgctgctatacttaaaggtgtaccagtgtgaagtgngaggtggtggagtcggtggggagtccgttagggtaaacggtccgggttcggggggttcccttaggacgttcctccgtggtgtcggcctacgtggtacttcctacgtttcaaggttaatggtcgtggtagtggtaggtttccggggtcccgtaccgacgggtccgtccggaagggggtaacggggtcggtggggtagggttggggttacggttaacggtttaacgaaaaaggttaaaagtgtaagttagggtaagaaaaggtaaaacgtacgtacggtacggtacggaccgtaacccggtaaggaaaagggtaactacgtaccgtaactataccgtaacgaaagtaacgtaacttaaacgttaaccgaaaaacggttcgtttaaggttaacttttacggaaactaaagttaacgaacgtaacccgtaacgtaaaccgtaaaaccggacgtaacccacgtaaccggtacccttagtaaccgtttcgtaaacgtcccaaggttacgtaaccggttaaggaacgtacgtaccgtaacggttaccggaaaacgggttaaagggtacctcggttttaagttacgttacgggtttttaagaacggtttaccgttaccggggacccggggtaaacccgaagggttagtaaccgggtttccggg

SEQ ID NO: 113605 - DNA, 772 bp, Homo sapiens
  misc_feature: GYAE6OF01AKF84.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttcctgctgctatcttaaaaggtgtccagtgtgaagtgcaggtggtggagtcgtggggagccgttggtaaacgccgtggggggttcccttaggacgtctccgtgtgtcggccttcgtggtacttctactttcagtaatggctggatggaggttcggggtcccgcgaggtccgtaccggaggggaacgggggtcgtgggtaggttggggtttacggtaacggtttttaacgaaaaaaggttaaaaacgtggtaacgttagggttaaggaaaggtaaaaagtacggtaacgtaacgggtacgaccgtaacccgggtaaggaaaacgggaaacgtacttaccgaaccctacttacctacgaaaggtacgtaaattaaacgtttaacgaaaaaccggttacgggttagttaaactttacggaaactaaaagtacgtaaactaaccggtaccgtaaacggaaaacccggacggaaccaccgtaacgtaccgttacgttaactttaccgtacgtaaccacgtaacgtacgttacggaactacgactagtaccggaaacgtaagggcgtacgtagtgttccttttagacttacgtcggtacgggaccgtagggtacgtaggttcgg

SEQ ID NO: 113606 - DNA, 733 bp, Homo sapiens
  misc_feature: GYAE6OF01C24JB.15.86.H09.1.454.CMB.1.raw
  modified_base (501)..(501): a, c, t, g, unknown or other
  misc_feature (501)..(501): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttcctgctgctatcttaaaggtgtccagtgtgagtgcaggtggtggagtcgtgggggatccgttaggaagtccggtaggggggtcccttaggacgtcctccgtggtgtcggccttcgtggattctactttcaagttagtggactggatggtaggttgggtcccgccgaggctaccgaggggacggggtcgtggaggttcgggttggtaaccgtttaactaaaaaggtaaaatggtaagttggagaaacgtaaaataggaaccgtggtacgtaccaacccggtagaaaacggaagtacttaccaacctactactacgaaacgagtaacttaaactacgaaaaaccggngttagtattacgaaactaatagaaacacgtaccgtaacggaaaacgcgaacaacggtaccgtaccgttactacttaaccgtacgtaaccaacgtagtaaccggttacggaagtcgtacgtaactaccgggtaaacgggtaaaagcgggttcctaagggttcgttaagttttacgaaatttccggtacccgggtaccggggtacccgaaaggggtacgtaaccggtttcgggg

SEQ ID NO: 113607 - DNA, 886 bp, Homo sapiens
  misc_feature: GYAE6OF01CO2FV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttagggtaaacggccggttcgggggggtccccttaaggcggttcctccgttggtggttcgggccttcgtggtactttctaccttttgaagttaagtggtcgtggagttggtaaggttcggggtcccgaccgagggtcccgttacccggaagggggtaaacggggggtccgtaggggtaacgggttgggggttacgggtaaaccggtttaacgtaaaaaaggttaaaataggtacgtagggtaagaaagtaaaagtaggaacgtacggtgaccgtaaacccggtaaggaaaagggtaacgtacttaaccgaaccctagttacctaaacgtaaaggaacgttaaattaaacgttaaaccgtaaaaaaccgggttacggtttaaacggttaacgtttaaacgtaacgtaaaaacgttacggaaaaccgtaggtaacccctaaacggggaaaacccgaacgggtaacccaaccggtaaccgtaccgttaaccgttaacttaaaccccgtacgttaacccgtaaacggtaacgtaacgttaccgggtaaacgtcgtaccgtaacggttaaccgaaaccgggttaagggacggttaacttagttacggtttaccgtttagtacgttacgtcgggtaccggtaccggaagggtacgtaagggttacccgg

SEQ ID NO: 113608 - DNA, 809 bp, Homo sapiens
  misc_feature: GYAE6OF01ANK6B.15.86.H09.1.454.CMB.1.raw
  modified_base (213)..(213): a, c, t, g, unknown or other
  misc_feature (213)..(213): n is a, c, g, or t
tcagtctacgtagccacgaccggtgctcgatttagtgctatagacttgggtttgggggagaggagccccagccttgggatccccaagtgtttcattcagtgatcaggactgaacacagaggactcaccatggagttcgggctgagctgggttttcctgctgctatacttaaaaggtgtccagtgtgaagtgcaggtggtggagtcgtgggganccgttaggtaagtccgtgggggtcccttagacgtctcctgtgtcggcctcgtggtacttcgactttcgagttaagtggtcgtaggatggtaggttcgggtcccgaccgtaggtcccgtaccggaagggggaagggggtccgtggggtagggttcggggtttacgggtaaccgttttaacgaaaaaacggttaaaagtggtaagttagggtagtaaagtaaaacgtagtaacgtaacggtcgaaccgtaacccggaaggaaaggtaacgtacttaccaaccacgtacgtaacgaagtaacgtaacttaaacgttaacgaaaaacggtcggttaagttagtttacgaaactaaaaggtcaaaccgtacgtaacccgtaaaggaaaacccggtggaaaccaccgtaacggtaccctagtttaaacgttccgtaaacgtaacccgaagtacggtaacggttacggtaactacgtagaaccggttaccggaaacgggtaaacgggcgttaacgttacggttacggttaccgttttagtaacggttacggtttacgggacccgggggttaacccaaagggttaaccgtacggttacccgggg

SEQ ID NO: 113609 - DNA, 817 bp, Homo sapiens
  misc_feature: GYAE6OF01EFA52.15.86.H09.1.454.CMB.1.raw
  modified_base (182)..(182): a, c, t, g, unknown or other
  misc_feature (182)..(182): n is a, c, g, or t
tcagtctacgtagccacgaccggtgctcgatttagtgctatagacttgggtttggggggagaggagcccccagccttgggatcccccaagtgttttcattcagtgatcaggactgaacacagaggactcaccatggagttcgggctgagcgttgggttttccttgctgctatcttaaaggtntcagtgtgagtgcaggtggtggagtcggtggggacgtccgttaggtaaacgtccggttcgggggttaccctttagacgttccgttccgttggtcgtcggtccttcgtggtatttcctacttttcgtaagttaagtggtcgtggtagttggtaggtttccggggtcccgtaccggacgggtcccgtacccgggaaggggggtaacgggggtcggtagggggtaggggtttaggggggtttacgggtaaccggtttttaaaacgaaaaaagggttaaaaagtggtaaggttagggtaaggtaaaggtaaaaattacggaacgttacggtacgaccgtaacccggtaaggaaaacggtaagtacttaccgaactacgtacacgaaagtaagtaacttaaacgttaaccgaaaacgggtacggttagttacgtttaagaactaaagtaacgaacgtacgaaccgtaaacggaaaaccgagtaaccacgaccgttaccgttacgttaacgttaccgtacgacctacgtaagttacgtacggtagtacgacgtaacgtacggtaacgtaaaggcgtacgttagtcgtttagttagtaacttacggttacgggacgggaaccgtaggtaacgtggttacggg

SEQ ID NO: 113610 - DNA, 798 bp, Homo sapiens
  misc_feature: GYAE6OF01CB1KC.15.86.H09.1.454.CMB.1.raw
  modified_base (617)..(617): a, c, t, g, unknown or other
  misc_feature (617)..(617): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtggggagtccttaggtaaagccgtgggggtcccttaggagtctcctgtgtggcctcgtggtattctactttcaagttaagtggtcgtaggagtggtaggttcgggtcccgaccgtacggctaccggaaggggtaaggggcgtgggtaggttcggggttaggtaacgttttaacgaaaaaaggttaaaaagtggtaagtgggttagaaaaggtaaaaaccgtaggtaaccgtaacgggtcgaaccgtaaaccccggtaaggaaaagggtaactaacgttaccaaaccgtataccgtaaacgaaaggtaaacgtaaacttaaacgttaaccgaaaaaacggttcggttaagttaacgtttacgaaactaaaagtacgaaaaccgtggaaccctaaaggaaaaacccggnggaaaccaaccgaacggtacccgttaacttaacgttacccgtaacggtaacccaacgtaggtaacgttacggaagtcgtaacaagttaccgggaaacggtaaaggacggttactaggttagttccgttttagacgtttacggttcggacggggtaacccgagggtaactaagggttccggg

SEQ ID NO: 113611 - DNA, 813 bp, Homo sapiens
  misc_feature: GYAE6OF01ALWOI.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcggctgagcgttggttttccttgctgctatacgttaaaggtgtcagtgtgaagtgcgaggtggtggagtcggtggggacgtccgttagggtaaacgtccggtcgggggttacccttaggtacggttcttccgtggttggtcggtccttcgtaggtactttacgtacctttagaacgttaagtcggtcgtggagttggtacggttcggggtccgcgacggtccgtacggtaggggacggggtcgtagggtagggtcgggttaggtaaccgttttaaacgtaaaaagttaaaagtgtagtaggtaagaagtaaaagtacgtacgtacggtagaccgtaaccgtaggaaaagagtataccgactatacgtacgaagtaataagttaactaaacggaaaacgtacggtttattaacgtttacaaacttaaagaacgtaaacgaccgtaacccgtaaagggaaaacgtccgtaactaccgaaccgtcgtttacctaagttacccgtaacgaaccgaacgggtacttaaggttacccgaagtactaccggtaacgtacgggttaaaacgtaacggacgttaaacggtttacttccggtttaaacgtttaggtaacgtttaccggtcggggtacccccggtaaccgggtaaggggttaaccgttaacgggtttccccggg

SEQ ID NO: 113612 - DNA, 727 bp, Homo sapiens
  misc_feature: GYAE6OF01EW1AY.15.86.H09.1.454.CMB.1.raw
tcagtctacgtagccacgaccggtgctcgatttagtgctatagacttgggtttgggggggagaggagcccccagccttgggatccccaagttgttttcattcagtgatcaggactgaacacagaggactcaccatggagttcgggctgagcgttgggttttccttgctgctatacttaaaggtgtccagtgtgaagtgcgagggtggtggagtcggtgggggacgtccgttagggtaaacggccggttcgggggttcccttaggacgttcgtccgttggtggtcggcctcgtggtacttctactttcaagtaagtggcgtggtagtggtaggttcgggtccgccgtacggccgtaccggaggggacgggtcgtgggtaggtgggttaggtacgttaaagaaaagtaaaatgagtaggtagaaagaaagtacgacgtacggtacgaccgaacggtaagaaagagtaactacactatactacaagaagtaagttaacgtaacgaaaacggtcgtttaagtatttacgaataaacgtacgaacgtacgaaccgtaaacggaaaccgtacgaacgacgtacgtacccgttaatacttaccgaacgtacccaagtaagttacgtacgtaagtcgtacgaacgtaccggaaaggtaaaggcgttacgttagttcgtttagtttacagttacggtccgggtacgggtaccggaagggtaccgttaggtcccggg

SEQ ID NO: 113613 - DNA, 857 bp, Homo sapiens
  misc_feature: GYAE6OF01BT2N4.15.86.H09.1.454.CMB.1.raw
tcagtctacgtagccacgaccggtgctcgatttagtgctatagacttgggtttgggggggagaggagccccagccttgggatcccccaagtgttttcattcagtgatcaggactgaacacagaggactcaccatggagttcgggctgagcttgggttttccttgctgctatacttaaaaggtgtccagtgtgaagtgcgaggtggtggagtcgtgggggagccgttagggtaaacgccggttggggggtcccttagacgttctccgttggtggtcggcctcgtggtattctacttcagttaagtggcgtggatggtaggttcgggtcccgccgacggtccgtacccggaagggggaacggggcgtaggggtagggttcggggttagggtaacggttttaaacgtaaaaaggtaaaagtagtaagttaggtaaggaaagtaaaagtacggtaaccgtacggtacgaccgtaaacccgggtaaggaaaacgggaagtacgtaccgaaccgtacttaccgtaacgaaagtaagtaaacttaaacgtttaaaccgaaaaaaccgggttacggtttaagtttaagtttaacgaaaccgtaaaagttacgaaaaccgtaaccggtaccgtaaaaccggaaaaccggaaccgaaccgaacgaaccggttaccccgtttaattaaccgttaaccgtaccgttaaacccgaagttaacggtaacgtttaaccgggagttacggaaccgtaaacggttaaccgggtaaaacggtaaaagggcggttactaggttacggttacgttttagaacgtttaccgttcgggaacccggggtaccgtaacggggtaacctaagggttcccggg

SEQ ID NO: 113614 - DNA, 980 bp, Homo sapiens
  misc_feature: GYAE6OF01BO5D3.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcggctgagcttggttttccttgctgctatacgttaaaagtgtccagtgtgaagtgcgaggtggtggagtcgtggggacgtcgttaggtaaacgccgtcgggggttcccttaaggacgttccgtccgtggttcgtcggtccttcgtggtattcctacgttttcaagttaagtcggtcgtaggtagttcggtaagggtttccggggtaccccggaccgtacgggtacccgttcccggaaaggggggtaacgggggtccggttagggggtaacggggtttaggggtttacggggttaaaccggtttttaaaaccggtaaaaaaaggtttaaaaacggttaggtaaaggttagggttaaaggtaaaaggtaaaaaagttacggtaaccgttaacgggtacgtacccgaaacccggttaaggaaaacggtaacgtaacttaccaaccgtagtacctaacggaagtaaacgaatttaaacgttaaccggaaaaaccggttgggtttaatttaacgtttaacgaaacgttaaaacgtaacggtaaaccgtaacggtaacccgtaaacggaaaaccccggtaaaggaacccgtaacgtaaccggttacccgtttaacgttaaacgtttaccgtaaccgggtaacccctaagtaaaccggttacgtttaaaaccgggtacgtttaacggaaccccgttaagtaacccggggttaaaaaccggttaaaaggggaccggttaacctttaagggtttacgtttttacggttttaacggttaaacgttaccgggttacccggggttaccggggaaaccccggtaacgggttaaacccgttaagggttaccccgggg

SEQ ID NO: 113615 - DNA, 976 bp, Homo sapiens
  misc_feature: GYAE6OF01ACFJ6.15.86.H09.1.454.CMB.1.raw
  modified_base (885)..(885): a, c, t, g, unknown or other
  misc_feature (885)..(885): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggttttcctgctgcttatacgttaaaggtgtccagtgtagaagtgcgagggtggtggagtcggtgggggtactccgttaggtaaacggtccggtcggggggttcccttaggacgttcctccgttggtcggtcggtccttcgtggtactttcctacttttacgaaggttaagtcgggtacgttagggtaagttggttacgggtttccggggtaccccgaccggtacgggtccccgttaccgggaaggggggtaacgggggtccgtaggggtagggtttcgggggtttacgggttaaaccggtttttaaaccgaaaaaaggtttaaaaagtcggtaagttaacgggtaaggtaaaacggtaaaaagttacggtaaccggttaaccgggtaccgaaccccgtaaacccgggtaagggtaaaaacggtaacgttaccgttaacccgacccgtaaaccgttacgtaaaccgtaaagtaaacgttaacgtttaaaacgttaaccggtaaaaacgggttcggtttagtttaaacgtttaacggaaacttaaaacggtaaccggtaaaacgaccggtaaaccccgtaaacgggaaaacccggttacggaaacccaaccgggtaccgtaccccggtttaactttaacgtttacccgtaaccgtaacccccgtaagtaaccgggttaccgttaaccgggtacgtcgtaaccggaacgttacgggtaaaaccgggttaaacggngttaccgttaggtaccggttttacttaacggtaacgttaccggtcccggggttaaccgggaaccttacgggtaacgtttaccgggtccggg

SEQ ID NO: 113616 - DNA, 754 bp, Homo sapiens
  misc_feature: GYAE6OF01B14FV.15.86.H09.1.454.CMB.1.raw
  modified_base (286)..(286): a, c, t, g, unknown or other
  misc_feature (286)..(286): n is a, c, g, or t
  modified_base (576)..(576): a, c, t, g, unknown or other
  misc_feature (576)..(576): n is a, c, g, or t
  modified_base (646)..(646): a, c, t, g, unknown or other
  misc_feature (646)..(646): n is a, c, g, or t
tcagtctacgtagccacgaccggtgctcgatttagtgctatagacttgggtttggggggagaggagccccagccttgggactccccaagtgttttcattcagtgatcaggactgaacacagagactcaccagtgggagttcgggctgagcgttgggttttccttggctgcttattacgttaaaggtcgtcctagtgtgaagtgcgaggtggtggagtcggtgggggcgcgtttagggaagtccggtcgggggttccttaggacgtcttccgtggtcggtcggcctntgtcttcacgttctagtaagtcggtctaggtattcggtaggttggtcccgaccgtaggcccgtacgggaaggggtacgggtcgtaggggtaggttcggggtttacggtaaccgttaaaggtaaaaagttaaacggtaggtaacggttaggggtaagaaacggtaaaacgttagtaacggtacggttagacccgtaaaccgggtagaaaacggtaggtactaaccacgtaatccgactaaaggataacttaacgtaacgaaacggtcggtttagtaagttacaaagtaaanagaaaccgtcaacgtaacgaaaccggtcgaacacggtccgtatacgtaactaccggatacccgtaaggtnaaccgttgtaacgtcaacggtacgacggttaaaggtacggtaggttacctagttgtacgtttaggaacttcggtaccgggacgggacgtaaggacccgttggttccgg

SEQ ID NO: 113617 - DNA, 956 bp, Homo sapiens
  misc_feature: GYAE6OF01DTIA8.15.86.H09.1.454.CMB.1.raw
  modified_base (146)..(146): a, c, t, g, unknown or other
  misc_feature (146)..(146): n is a, c, g, or t
tcagtctacgtagccacgaccggtgctcgatttagtgctatagacttgggtttgggggggagaggagccccagccttgggactccccaagttgttttcattcagtgatcaggactgaacacagaggactcaccatggagttcgggntgagtcgttcgggttttcctgtctcgtcttaacttaacgttaaacgtgtccgtaggtgtagagtgcgtagggtggtggtaggtcgggtggggacgtacggttagggtaacggtccgggtcggggttaccttaggtacgtccgttcgtcggtcgtcgtccttacgtgtactttactacgtttcgaaggttagtacggtcggtaggtaggttgggttaccgggttaccggggcccgaccggtacggggtaccccggtaacgggggaaggggggtacgggtcgggttacggggttaacgggggttttcggggttaaacggttaaaccggttttaaaaaagtaaaaaaacgggttaaaggttacgggtaaagggtttaacgggtaaaagtaaaaacggtaaaacgttacggtaaaccggtaaccggttaacggaaaccccgtaaacggggtaaaaggaaaacgggtaacttaaccggtaaacctaccgttaactaaccgttaaaacggtaaaggtaaaactttaaaccttaaaacggtttaaaccgtaaaaccgggttagtttaacgtttaacgttaagaaacgttaaacgtagtaaacccgaagtacccgaaaaccggaaacgaccgaccgtaacgtacgttaccttaatacctaacgtaacctacgaacgttacggtaacgttacggaagattaaccggtaagtaacgggttaaacgtaaagggtctaacggtttacgttacttttaggttactacggttaccggtacgggttacccgggacgttaacgggtaacgttcccggttaacccgg

SEQ ID NO: 113618 - DNA, 838 bp, Homo sapiens
  misc_feature: GYAE6OF01B5RAU.15.86.H09.1.454.CMB.1.raw
  modified_base (250)..(250): a, c, t, g, unknown or other
  misc_feature (250)..(250): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcgagggtgggtggagtcgtggggagccgttaggtaagccggtgggggtcccttagngtctctgtgtcggctctggtattctactttcagttaagtggtcgtggatggtaggttcgggtcccgaccgacggtccgtacccggaagggggaacgggggtcggtaggggtagggttagggggtttacgggtaacggttttaaaccgtaaaaaaggttaaaaaagttaggtaaggttagggtaaggaaaaggtaaaaagtaacggtaaccgttaacggtaccggacccgtaacccgggtaacgggaaaaaggtaaacgtaacgttaccaaccgtactactaacgaaacgaagtaaacgttaaacgttaaaccgaaaaaacgggttacggttagttaaacgttttacgaaaacgtaaaacgttaaggaaacccgtaacggtaacccgtaaaacggaaaaacccgggtacgtaaccaaccgtacggtaccccgttattaacgtttaacgtaccgttaaccgaacgttaagtaacgttacgggaaagtcgaacgtaagtaccggtaaaggtaaaggccgttacgtagttcgtttactttaggaacgtttagtccgggtacggggaacccgagggtaacgtaggttaccggg

SEQ ID NO: 113619 - DNA, 764 bp, Homo sapiens
  misc_feature: GYAE6OF01C5JNX.15.86.H09.1.454.CMB.1.raw
  modified_base (144)..(144): a, c, t, g, unknown or other
  misc_feature (144)..(144): n is a, c, g, or t
  modified_base (444)..(444): a, c, t, g, unknown or other
  misc_feature (444)..(444): n is a, c, g, or t
  modified_base (464)..(464): a, c, t, g, unknown or other
  misc_feature (464)..(464): n is a, c, g, or t
tcagtctacgtagccacgaccggtgctcgatttagtgctatagacttgggtttgggggggagaggagccccagccttgggatccccaagttgttttcattcagtgatcaggactgaacacagagactcaccagtggagttcggntgagtcgttgggttttccttgctgtctaagttacgttaaaggtcgtccgagtgtagtagtgcgtagggtgggtggacggtcggtagggggacgtaccggtttagggtaaacggtccgggttacgggggttacccttaaggtcgttcctccgttggtggtcggtccttcgtggtacttactacctttagaagtagtggcgtggtagtacggtggttccggcccgacgacggtccgtacggagggggtaacgggtgtacgggtgggttacgggttagtaacgtttaaacgaaaaagttaagngtagtaggaagaaagtaaangtacgtacggacgaccgtaacggtaaggaaagtacgtaaccgtacaacgtactacgtaagaaagtactaataaacgtaaccgaaagttcgggttattaaggttaacgactaaaaggtctaaaaagcgtaacccgaaaggtaaacccggagacacgttacccagtttaccacttaacgtacaccgaagtaggtacgttaacggagtaccgacttaaacgggtacggaaagtaaggccgtaggtttactaggttacctttaggctaccggtcggtaccgggaccttaagggcacgggtttcg

SEQ ID NO: 113620 - DNA, 745 bp, Homo sapiens
  misc_feature: GYAE6OF01D9N7T.15.86.H09.1.454.CMB.1.raw
  modified_base (215)..(215): a, c, t, g, unknown or other
  misc_feature (215)..(215): n is a, c, g, or t
  modified_base (645)..(645): a, c, t, g, unknown or other
  misc_feature (645)..(645): n is a, c, g, or t
  modified_base (678)..(678): a, c, t, g, unknown or other
  misc_feature (678)..(678): n is a, c, g, or t
tcagtctacgtagccacgaccggtgctcgattttagtgctatagacttgggtttgggggagaggagccccagccttgggatccccaagttgttttcattcagtgatcagactgaacacagagactcaccagtggagttcgggctgagtcgttggttttcctgctgctaattacgttaaaagtgtacagtgtagagtgcgaggtggtggagtcggngggactcgttaggaacgtccggtggggtccttagagtctcgtgtgtcgctgtgtacttctacttacagtaagtcggacgtaggtagtggtacggttcggcccgacgtacggtcgtaccgggtaaggggtaacgggtcggtaggggtacgggtttacgggttaacggttaaaccgtttaaaagaaaaaacggttaaagtcggtaaaggtacggtaagtaaaaaggtaaacgttacggtaacggtacgtaccgaacgtaacggtaagaagtaactactacaacgtagtacaagtaaagtaactaacgttaaacgaacgtaaagtcgttacgtagtaaacgataaagacaaaccgtacgtaaccgaaacggaaccgcgaacgacgtacttaaccgtattaacgtacgtacccaagtagttaagtacggttaanacgtacggactaaacggttaaggacgtaaacgngtttaaccgttagttaggttacgttaagacgttaccgtcggaccggtacgtaagtccgtacggttcg

SEQ ID NO: 113621 - DNA, 1196 bp, Homo sapiens
  misc_feature: GYAE6OF01DYO2O.15.86.H09.1.454.CMB.1.raw
tcagtctacgtagccacgaccggtgctcgattttagtgctatagacttgggtttgggggggagaggagccccagccttgggatccccaagtgttttcattcagtgatcaggactgaacacagagactcacatggagttcgggctgagcgttggttttcctgctgctattacgttaaaggtgtccagtgtagagtgcgagggtggtggagttcggtgggggacgtccgttagggtaacggtccgggttcggggggttacccttaggacgttcctccgttggttggtacggtcccttggtcggttacgttccttacctttcgtaaggttaacgtcggacgttggtagttcgggttacgggttcggggtcccgaccggtacgggtccgtacccgggggtaagggggaaccgggggtccggttagggggttaacgggttttacggggggtttaacgggtttaaacccggttttttaaaaaggtaaaaaaaagggttaaaaaagttttgggtaaaagtttacggggttaaaaggaaaaaggttaaaaacgttaaccgggtaaaccggtttaaccgggtacgtaaaccccgggtaaaacccggggttaaaggtaaaaaaccggggtaaacgttaaacctttaaccgtaaaacccgttaacttaacccggtaaaaacggtaaacggttaaaacgttaaaccgggtttaaaaaaccgtttaaaaacccggggttaaaaaaaccgggttcgggtttttaaacgttttaaaccggtttttaaacgggaaaaaccgtttaaaacggttaacccggaaaaacttaaccccggggttaaacccggttaaaacccggggaaaaaaccccggtaaaacgggtaaaccctaacccgggttaaaccggtttaccccgtttaaaccgttttaaacgtttaaccccggtaaacggttaaaacccccgtaaccgggtttaaagttaaaccgggtttaaacccgggtaaacgggttaccgtaaccggggttaaaaaccggtttaaccccggggaaaaacggggtttaaaccggggtaaaccgttttaaccgggttaagtttttacccgggttttacggtttttaaagggtaaccgtttttacccgggggaccccggggtttaaaccccggggggaacccggggtttaacgggtaaaacccggttttagggggtttta

SEQ ID NO: 113622 - DNA, 1024 bp, Homo sapiens
  misc_feature: GYAE6OF01DQQCK.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttagggtaaacgtccggttggggggtcccttaggacgttcctccgttggtcggtcggtcctcgtggtattcctacgttttcaggttaaatgggtccgttgggaagttggtaagggtttcgggggttaccccgggccccgaaggggtccccgttaccccgggaagggggggtaaaacggggggggtccgttaggggggtaagggggtttggggggttttagggggttaaaccggttttttaaaccggtaaaaaaaaagggttttaaaaaaaagtttgggtaaaaggtttaggggttaaggaaaaaggtaaaaaaacgttaaacgggtaaaccggtttaaaccggggttacggaacccgtaaacccccggggttaaagggaaaaacgggtaaaaggttaacgttttaccaaacccctaacgttaccctaaccgaaaaggtaaaggtaaagttttaaaacttaacccgtaaaaaaaacggtaccgggtttaagtttaaacgtttttagaaaccgttaaaaattaacggtaaaaccaacggtaacccgtaaacggaaaaaccccggagggaaacccaacggtaaccggtacccggttacctttaacgtttaaccttacggttaaaccccaacgtaacggtaacgtttaaccggggaaagttcgaaccgttaacgtacccgggtaaaacggtaaaaggggacgtaacgttaagttcggtttacgtttttacggaaacgtttaacgggttccgggttacccggggggtaaccccgttaacggggtaacttaaacgggtttcccgggg

SEQ ID NO: 113623 - DNA, 699 bp, Homo sapiens
  misc_feature: GYAE6OF01BTIY0.15.86.H09.1.454.CMB.1.raw
  modified_base (322)..(322): a, c, t, g, unknown or other
  misc_feature (322)..(322): n is a, c, g, or t
  modified_base (424)..(424): a, c, t, g, unknown or other
  misc_feature (424)..(424): n is a, c, g, or t
  modified_base (456)..(456): a, c, t, g, unknown or other
  misc_feature (456)..(456): n is a, c, g, or t
  modified_base (542)..(542): a, c, t, g, unknown or other
  misc_feature (542)..(542): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttcctgctgctatacttaaaggtgtcagtgtgagtgacgagggtggtggagtcggtgggggacgtccgttaggtaacgccggttcgggggttcccttagacgtctccgtggtgtcgcctgtggtattcctatttcagtaacgtggcgtggatggtagttcgggccnccgaggcctccggagggacgggcgtgggtaggtgggttaggtaacgtttaacgaaaaaggttaaagtgtaagttggtagaaagtaaagtacgacgtacggtnaccgaaccggtaaggaaacgagtatacactanactagaagataacgtaacgtaacgaaaacggttcgtattacgttacgaataaacgtagtaaccgaggtacctaaacggaaaaccgngaacccacgtaacgtccgttaccttagttacctacgtaaccgagtacgtaagtacggaatacgagtaacgtacgtaaagggtaagtacggtacttagtcgttacgttagaacgtacggttccgggacggtaacccggtaaggtccgttagggttccg

SEQ ID NO: 113624 - DNA, 812 bp, Homo sapiens
  misc_feature: GYAE6OF01A6LSW.15.86.H09.1.454.CMB.1.raw
  modified_base (753)..(753): a, c, t, g, unknown or other
  misc_feature (753)..(753): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtagaagtgcagggtggtggagtcgtgggggagtccgttaggtaaacgccggtggggggtcccttaggagtctcctgtgtcggcctgtggattctactttcagttagtggcgtggtatggtaggttcggggtcccgaccgacgggcctaccggagggggaacggggtcggtgggtagggttggggttacgggtaacgttttaacgaaaaaggttaaaaagtgtaaggtaggtaagaaagtaaaagtacggtacgtaacggtgtaccgtaaccggtaaggaaaaggtaacgtacgttaccaaccgtactacgtaacgaaagtagtaacgttaaactaacgaaaaccggttacggttagtttaacgttacggaaactaaaacgtacggggaaacctacggaaccgttaaacggaaaccggaaggtaaccaccgtaacgttacccgttaacttaacgtaaccgttacgaacccgtaacgtaacggtaacgtttacggaacggttacgaaccgtaagttacgggaaaccgggttaaaggacggttacttagtacggtttacggttttanaacgtttaccggtccgggttacggggaaccccttaagggaaccgttaggggttacccgg

SEQ ID NO: 113625 - DNA, 786 bp, Homo sapiens
  misc_feature: GYAE6OF01DVN82.15.86.H09.1.454.CMB.1.raw
  modified_base (486)..(486): a, c, t, g, unknown or other
  misc_feature (486)..(486): n is a, c, g, or t
  modified_base (565)..(565): a, c, t, g, unknown or other
  misc_feature (565)..(565): n is a, c, g, or t
tcagtctacgtagccacgaccggtgctcgatttagtgctatagacttggggtttgggggggagaggagccccagccttgggatccccaagtgttttcattcagtgatcagactgaacacagaggactcaccatggagttcgggctggagcgtgggttttcctgctgctatcgttaaaggtgtccagtgtagagtgcaggtggtgagttcgtgggggatccgttaggaagtccgtgggggtccttagacgtctcctgtgtcgcctgtggtattccactttcaagttaagttggacgtggagttcggtacggtttcgggtcccgccgtacggtctccggaagggggaaggggccgttaggggtagggttgggggttacgggtaaccgttttaacgaaaaaaggtaaaattggaacgttgggtaagaaaagaaaacgttagaaccgttacggtacgaccgtaaccggtagaaagggtatactacgaacnctactacgaagataatactaacgaaacgtcggttatatttacgaactaataacggaacacgtaccgtaaggaaaccggngtaaccaccgaagtaccgtaactttaacgtaacccgtagtaaaccccgtaattaacgggtacgtttaacgggaaccgttgtaacccgttaaggtaaacccgggtaaacggtaaaacggggtacgtaccgtttaagttcccggtttaagtttaccgtaacgttaaccggttccgggttaccggggggaccccctaaaggggttaccctagggtttacccggg

SEQ ID NO: 113626 - DNA, 654 bp, Homo sapiens
  misc_feature: GYAE6OF01CP5CB.15.86.H09.1.454.CMB.1.raw
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (502)..(502): a, c, t, g, unknown or other
  misc_feature (502)..(502): n is a, c, g, or t
  modified_base (531)..(531): a, c, t, g, unknown or other
  misc_feature (531)..(531): n is a, c, g, or t
  modified_base (580)..(580): a, c, t, g, unknown or other
  misc_feature (580)..(580): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (620)..(620): a, c, t, g, unknown or other
  misc_feature (620)..(620): n is a, c, g, or t
tcagtctacgtagccacgaccggtgctcgatttagtgctatagacttgggtttggggggagaggagccccagccttgggatccccaagtgttttcattcagtgatcaggactgacacagaggactcaccatgggagttcgggctgagcgtgggttttccttgctgctatacttaaaaggtgtccagtgtgaagtgcgaggtggtggagtcgtggggagtccgttaggtaaacgccgtcgggggtccctaagngtctccgtgtgtcggcctntggatctactttcagtatggctggatggtagttcgggtaccgcgtaggtctccggaagggggacgggtcgtaggtcggtgggttacggacgtttaacgaaaaagtaaatgaagtggaagaaggtaaaataggacttacggtgaccgaaccggtaagaaaggtacgtacttacacctatcctaacgtaagtaactaagtaagtaaccgaaaaggtggtaagttagtacgaanaaagtacgaacgacgaccgaagtaaacgnggaaccagtacgtccgtatactagacgtacacgagttacgtacgtaganacgttacacggtaaaggtacggngtntagtacgtgtttanacgtttacgcggaccggtagacgtacgtaggtcg

SEQ ID NO: 113627 - DNA, 687 bp, Homo sapiens
  misc_feature: GYAE6OF01EB2E5.15.86.H09.1.454.CMB.1.raw
  modified_base (180)..(180): a, c, t, g, unknown or other
  misc_feature (180)..(180): n is a, c, g, or t
  modified_base (392)..(392): a, c, t, g, unknown or other
  misc_feature (392)..(392): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtntccagtgtgaagtgcaggtggtggagtcgtggggagccttggtaagccgtgggggtcctagagtctctgtgtggcctctggattctactttcagtaatggctggatggtagttgggtccgcaggctccgagggaaggggcgtgggaggtggggttggtacgtttacgaaaagtaaaagtgagtaggtagaaagtaaaatagacgttaacggngacgacccggtagaaaggaatatacacatctacaagagtaataataacaaaacggtacgttagttaatttagaaccctaaagtacgaaacacgacccgtaaaggaaaaacccggaggaaccaacgtacggtacccgttacttaacgttacctacggtaaccctacgaaacgttacgttaacgggtaagttccggactaacggtacggaaaggtaaaacgggcggtaacttagtacggttactttaggaacttacggtcggttaccggggaccctaagggaccgtaggttaccggg

SEQ ID NO: 113628 - DNA, 970 bp, Homo sapiens
  misc_feature: GYAE6OF01DHOO5.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatacttaaaaggtcgtcagtgtgaagtgcgaggtggtggaggtcgtgggggacgtccgttagggtaaacggtcccggttcggggggttccccttaaggtacggttccgttcccgttggttcggtccgggtcccttcgttcgggtactttccgtaccgttttacgaagttaagttcggtccgtagggtaagttgggtaacggtttcggggtcccgacccgtacgggccgttacccggaagggggaagggggtccgttaggggtagggtttggggttacgggtaacgttttaaacgaaaaaaggttaaaaaagttagtaaggttaagggtagtaaaagtaaaaagttaacgtacgtaaccgggtagaacccggtaaacccggtaaaggaaaacgggtaagtaaccgttaccgaaaccgtacttaccgtaacgaaaaggtaagtaaatttaaaccgttaaaacgtaaaaacccggtacggtttaagtttaagtttaaccgaaaacgttaaacgttaaacgggaaaacctacccggttaaacccgtaaaacggaaaaaaccccgggcgttaaacccgaaaccgttacccgggtaacccggttttacttaaacgtttttaaccgaccggttaaaccccgaaccgttaagggtaaccgtttacgggaaaacgtttcgaaccgtaaacgggttccgaaaaacggggttaaaggaaccgtaacgttaaccgttggttttacgtttttacgaagtttaaccggtcccgggttaaccgggggtccccaaaaggggtcttaaacgggtttccggg

SEQ ID NO: 113629 - DNA, 832 bp, Homo sapiens
  misc_feature: GYAE6OF01BM7RN.15.86.H09.1.454.CMB.1.raw
  modified_base (550)..(550): a, c, t, g, unknown or other
  misc_feature (550)..(550): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagtcttgggttttcctgctgctatacgttaaaggtgtccagtgtagagtgcgaggtggtgaggtcggtggggtacgtaccgttagggtaaacgtccggtacgggggttacccttaggacgttccgtaccgtggtgtccggtccttcgtggtacttaccgtactttacgtaagttaagtggtctaggagttggtacggttcggcccgacgacggtccgtacggaaggggtaacggggtcgtagggtagggttcgggttacggtaacgtttaacgaaaaaggtaaaagtgtaagtagggtaacgaaagtaaaagtacggtaacgtaacggtagtacccgaaccggttaaaggaaaacggtaacgtaaccttaaccgaaccgttactacgtaacgtaaaacgggtaanaaagtttaaacgttaaaccggaaaaacggttccggtttaaagttagtttaaccgaacgtaaaagtaccgaaaacgtacgtaacccgaacggaaaaaccgtcgggaaactaccgaacggttcccttaagtaacttaacgtaaccgaacctacggtaattaccggttacggaatccggaactaaacggaaccgggtaacggtaaaagggcgtaacgttaacggtgttaacgttcgtaaacgttcgggttacggacccggtaaggtataaacggttcggttacgg

SEQ ID NO: 113630 - DNA, 840 bp, Homo sapiens
  misc_feature: GYAE6OF01EBVOL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcgttgggtttttccttgctgcttatacgttaaaaggtgtccagtgtagaagtgcgtaggtgggtggagtcggtgggggagtccgttagggtaaacgtccggtcgggggtacccttagtacgtctccgtggtggtcggcctcgtggtactttcctactttacgaagttaacgtggtcgttagggtagttaggtacgggttccggggtcccgaccgtacgggtccgttaccggggaagggggtaacgggggtccggttaggggtaggggtttcgggggtttaacgggttaaaccggttttaaacgtaaaaaaggttaaaagttaggtaaggttagggtaaagtaaaaggtaaaagttaacggtaacgttaacggacgaaccggtaacccggtaaaggaaaacggaacgtaactaccgaactactactaagaaagtaacgtaaattaaacgtaaacggtaaaaacgggtggtttaattagttaacgaagtaaaacgcgtaaacgacggaacccgtaaggaaaaccgacgaacgtaccgtaggtaccttacttaacgttaccgaccgtacaagtagtacggttacgaacgtactacgaacgtacggaaaacggtaaggtccgtaagtacgtttagtccttttaaggactacggttacccgggtagggaacccgtaagggtatacgggttcccggg

SEQ ID NO: 113631 - DNA, 812 bp, Homo sapiens
  misc_feature: GYAE6OF01ARQWC.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttcctgctgctatcttaaaaggtgtccagtgtgaagtgcaggtggtggagtcgtggggagtccgttggtaaagccgtgggggtcccttagagtctccgtgtgtcggcctctggattcacttttcagttaatggtcgtggagtggtaggttcgggtcccgccgaggccgtccggaggggaacggggtcgtgggtacggtggggttaggtacggttttaacgaaaaaggtaaaagtggagttaggtagaaaggtaaaagtacggtacgtaacggtacgaccgaacccggtaaggaaaaggtaaagtactttaccaacctaactaccgtacgaaaggtacgtaattaaacgttaacgaaaaaccgggtaggttacgttaatttaggaactaaaagttaggaaacctacggtacccgtaaacgaaaacccggacgggtaaccaaccgacggtaccgttaccttaaacgtttaccgtaaccgtaaacccaaccgtacggttaagtttaaccggggtaaacgttcggaaccttaaccggttaaccgggaaaaccgggtaaaacgggtcggtaaccctttaaggttacggtttcgttttaagttaacgttccggtacgggttccgggggaaccccccgtaaagggggaaccttagggttaccgggg

SEQ ID NO: 113632 - DNA, 827 bp, Homo sapiens
  misc_feature: GYAE6OF01CWHU3.15.86.H09.1.454.CMB.1.raw
tcagtctacgtagccacgaccggtgctcgatttagtgctatagacttgggttgggtacgatttgatgttacctgatgcttagaggcttttcctggaagcagggcatttgttgcttcagcaccgtagtgcctcgtcatcacgcctcagccttgtattttccggatttcgacctaggaaaaccagcctacccgcttaaaccgggacaaccgtccgccgaccaacatacgtccttcctcccgtccccctgcagtaacaccaagtacaggatattaacctcgtttccatcgactaccgtcctttcggcctcgccgttaggggtccactccacctcgccccgtaattaacgttggactacggtaacccttggtcctcggcgagtcgggtcctttacgacccgtctttacgtcgttacttatcgtcacgctacgttccgctacgttctcgaaacttcccacgtacgactaacgttccgcccttaacgactaaccgtaccctaaacctacccctttacgaaccgttacgggttaaccctttaaaccgtaaccgggaaaccctacccccgtttaaaccccctaaacccccgtaaaaccctaaaccgacccgtttaaacgttaaacccggtcccgttacccggtaacccgttccgggacccccgtacgttaacccgggtccgttttaacccgggtcggtacccgttaaaaccggttttccgggggttttaaccctcccccccgggttttaatacccgttttcccccggttaccccgtacccttacgttaccccgttgggtaaacccgttcccgttaaacgggttaaccgaaccggg

SEQ ID NO: 113633 - DNA, 879 bp, Homo sapiens
  misc_feature: GYAE6OF01EVFRD.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttcctgctgctatcgttaaaggtgtcagtgtgaagtgcgtaggtggtggaggtcggtgggggacgtccgttagggtaaacggccggttcggggggtacccttaggacgttccttccgttggtcggtcggtcctcgtggtattcctactttacagtaagttggctaggatggtacggttcggcccgtccggacggtccgtaccggagggggaacggggtcgtggggtacgggtgggggtttacggtaaccggttttaaagaaaaaacggttaaagtggtaaggttagggtaaaggaaaagtaaaagttacggtaacgttaaccgggtacgtaacccgaacccgggttaaagaaaaggataaaccggttacaaccgttaactacgtaaacgaaacggtaattaaaacgtaaacttaaaccggtaaaaaccggttcggttaagtttaacgtttacggaaactaaaaggtaacgtaaaccgtaaccgtaaccgtaaacgtaaaaaccgggaccgtaacgaacccgaacgtttaaccccgttagtaaacctttaaccggtaccgaaacccgtacgaaggtttacggttaggtaacggtacaccgtaaccggtaagggtaaaccggtaaagggacgttacccgttaagtttacggttactttaaggtacgtttaccggtaaccggggttacgggaacccgggtaaccggttaagtaggggtttacccggg

SEQ ID NO: 113634 - DNA, 827 bp, Homo sapiens
  misc_feature: GYAE6OF01EC7YG.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtggtggagtcgtggggggagtccgttaggtaaaacgtcccggttggggggtttccccttaaggacgttccttcccgttgttggttcggccctcgtggtaatttcctacttttcaagttaagtggcgttgggatggtaggtttcggggcccgtaccgacgggtccgtaccggaaggggggtaacgggggtcgtaggggtagggttgggggtttcggtaaaccggtttttaacgaaaaaaggttaaaaagtggtaagttaggggtaacgaaaggtaaaaagtacggtaacgttacggtacgacccgtaacccggtaaggaaaacgggtaacggtaacttacccaaccgtaacctaccgtaacgtaaaacgtaagtaacttaaaacgtttaaccgaaaaaaacggttcgggttaagtttaacgtttacgaaataaaacgtacgaaacacggtaccctaaaggaaacccgagaccacgacgtccgtataacgttacagtaaccctagaagttaacgtacggtaacgtagaccgtagaccggtaaacgggtaaaggtccgtacgtttaagttggttacgttttaagacgttttacgtcgggaccgggtacccgaaggtaccgtgtttaccgggg

SEQ ID NO: 113635 - DNA, 777 bp, Homo sapiens
  misc_feature: GYAE6OF01AVTAB.15.86.H09.1.454.CMB.1.raw
  modified_base (725)..(725): a, c, t, g, unknown or other
  misc_feature (725)..(725): n is a, c, g, or t
  modified_base (742)..(742): a, c, t, g, unknown or other
  misc_feature (742)..(742): n is a, c, g, or t
tcagtctacgtagccacgaccggtgctcgatttagtgctatagacttgggtttgggggggaggaggagccccagccttgggatccccaagtgttttcattcagtgatcaggactgaacacagaggactcaccatggacgttcgggctggagcgtgggttttccttgctgctatacttaaaaggtcgtccagtgtgaagtgcgaggtggtggaggtcgtgggggacgtccgttaggtaaacgccggtacggggggtcccttaggtacgttccgtcctggtgtcggcctcgtaggtacttcgtacctttgagttaacgtggtcgtaggagttggtaagggttccgggtcccgaccgtacggacccgtaccgggaacgggggaacgggggtccgtaggggtaggttgggggttacggtaaccggttttaaacgaaaaacggttaaaaacgttggtaagtagggtaacgtaaaggtaaaagtacggtaaccggtaacggtaccgaccgtaacccggtaggaaaagggaacgtacgttaccgaacctataccgtaacgaaagacgttaacttaaacgttaaacccgaaaacgggttcggttagtttaacggttacgtaaataaacggtacgaaaacgtcccgaacgtaaaccggaaacgtacgtaaccgactacgggtacttacgttaacgtcgttaacgaaccgtacgtagtaacgttcggaatcgtanacgtacggacgtaaggngtctagtctgtgactagcgtacgacgagtctgtcg

SEQ ID NO: 113636 - DNA, 789 bp, Homo sapiens
  misc_feature: GYAE6OF01AG6T9.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagtctgggttttcctgctgctatacttaaaaggtgtccagtgtgaagtgcgtaggtggtggagtcggtgggggacgtcgttaggtaagtccggttcgggggttacccttaggacgttcctccgtggtgtcggccttcgtggtactttctacttttccgaagttaagtgggtaccgttagggagttggtacgggtttcggggtcccggtccgacgggtccgttaccggaaggggggtaacgggggcgtaggggtaggttggggtttacggtaacgttttaaacaaaaaggttaaaaagtggtaagtagggtagaaaggtaaaagtacggaaccgttacggtaccgaccgtaaacccggtaaggaaagggtaactacgttaccgaacctacttaccgtaacaaaggtagtaaagttaacgttaaaccgaaaacggtacgggttgttaacttaggaactaaagtacgaaacgtacgaccgtaaacggaaaccggacgacaacgtacgtaccgtattaacttacgtaacgtacctaagtaaggttacgtaggtaacgcgacgagtaccggtaaacggtagggtacgtacgtagttagtcgtttatacgttacgtaccggtcgggaacccaaggtacgtaggttccggg

SEQ ID NO: 113637 - DNA, 870 bp, Homo sapiens
  misc_feature: GYAE6OF01B29BZ.15.86.H09.1.454.CMB.1.raw
  modified_base (198)..(198): a, c, t, g, unknown or other
  misc_feature (198)..(198): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagcttgggttttcctgctgctatacgttaaaaggtgtcaggtgtgaagtgngtagggtggtgggaggtcggtggggggacgtccgttaagggtaaacggtccggttcggggggttacccttaaggtagttccttccgttggtcggtcggtccttcgtggtactttcctacgtttacaagttaagtcgggtcgttaggagtcgggttagggttccgggtcccgccgtacgggtcccgtaccggggaaggggggtaacggggtcgtgggggtacggttaggggtttacggtaacggtttaaacgtaaaaaaggttaaaagtgggaagttagggtaaaggaaagtaaaaagttacggaaaccgttaacgggtacgtacccgaaaccggtaaggaaaacggtaagtacctacaaacccgtattaccgaacggtaaaagtaacgtaaacgtttaaaacgtaaccgtaaaaaacgggtcggtttaactttagttaacgaaactaaagaccggtaaaacgacgtaaccgtaacggaaaaccggtacggaaacacgtcgtaacccgttactaacggtttaccacgtaacccgaacgtaggtaaccgtggtaacgtcgaacgttaagaaccggtaagttaaacgggcgttacgttattaggttacttttacggacgtttacggttaccggggacccggtaacccggaggggttaaacccgtggtttcccggg

SEQ ID NO: 113638 - DNA, 969 bp, Homo sapiens
  misc_feature: GYAE6OF01EALPH.15.86.H09.1.454.CMB.1.raw
  modified_base (186)..(186): a, c, t, g, unknown or other
  misc_feature (186)..(186): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtntgcatctgccttgcgtggggacgcctcgatacaacgcctccacctcgacctaacccgttaagtacggtgacgacaacgttaccgaaacccttaaccaaccctaagtaccgtaaagttacggttaactacaaacgacggaacgaacccggaacggggtaaccccgttaccccccgaagttaacttaagttaaagtaaggtaaaaacggtttaaaggaggttaggaagttacgggaccaacggacccgaaaccgaacccggggaaacggggggaaccgggtaccgtacccccggtaagtccgtccttacgtaggttcgggtacccttacccggtacggtttccggtcgggggtaccgtaccgggtacccgtacccgttaaccctacctaaccccgtaccttaccccgtaaccccctaaaccccgttccgtaacggttaccgtacggtaaccggtaacgttacgggtaaccgggtacgttacgggtaaacgtttaccgttaccgtacggttacggggtaacggggaaacgggtaaccgggtaaccgtaaccccgtaaacgtaaacccggttaaagtttaccgggtaaacgggttccggggtaaacccggttaaaaggggggtttccccgggggggtttttaacgggggttacccggggggtttaacccgggggaacccggggggtaaaaccgggggtaaaccccgttaaaccggggttcccggtttaaccccggggtacccccgggtttaaccggttaacccggggtcccggtaaacccccggggg

SEQ ID NO: 113639 - DNA, 860 bp, Homo sapiens
  misc_feature: GYAE6OF01D40CV.15.86.H09.1.454.CMB.1.raw
  modified_base (656)..(656): a, c, t, g, unknown or other
  misc_feature (656)..(656): n is a, c, g, or t
tcagtctacgtagccacgaccggtgctcgatttagtgctatagacttgggttggggggggagaggagccccagccttgggactccccaagttgttttcattcagtgatcaggactgaacacaggagactcaccatgggagttcgggctgacgtcgttcggttttcctgcgtgactagttacgttaaaaggtcgtaccgtagtgtagtaacggtgacggtaggttgggtggtacggtcgggtgggggacgttaccggttaggtaacggtccgggtcggggttacctaggtacgtcgtcgtgtcgtaccggcctgtggtacttcgtactttacgagttagtcggtagtaggtagttggttacggttccggggccctacggtacggcccgtacggggaagggggtacgggtcgggtagggtacgggtttacggggtacggttaaacgttaaacgaaaaaaggttaacgtaggtacggttaaggtaacgtaaaaagggtaacttaacgggtaaccggttaacccggacggtaaacccgaacccggtaaagggaaaacgtacgttaactacccaacgtacgtagaaagagggtaaactaagttaaaccgtaacggaaaccgtttaggacgtttaacttagtaaacgtaaagtaaccgtaanaaccggtaaccgtaaacggaaaccgcggtaactacgaacgttacctaacttacgttaccgacctaacgtacggtacgttagtacgggtaactacggtaaccgtaacggtaacggaaaggtaccggtagtacggtttatcgtttaaccggtagtaccgttacgggttaccggaccggggaacgttacgtacggttcggttaccgg

SEQ ID NO: 113640 - DNA, 784 bp, Homo sapiens
  misc_feature: GYAE6OF01A8DK6.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatcttaaaggtgtccagtgtgaagtgcaggtggtggagtcgtgggggagtccgttaggtaaagccgtggggggtcccttaggagtctccgtgtgtcggcctcgtggtattctactttcgaagttaagtggtcgtaggtatggtaggttcgggtaccgccgaggtcctccggaggggagggcgtgggtaggtgggttaggtacgtttacaaaaaggttaaaagtgaagtaggtagaaagtaaaagtacggacgtacgggtcgaccgaccggtaagaaacggaatacttacaacctatcaacgaaagacgtaataaacgtaacgaaaacggtacggttgtaagtttcgaaactaaagtacgaaacgtaacgtaacccgtaaaggaaaaacccggacggtaacaacggtacccgtaccggttaacttaacgttaacccgtacgttaaacccaaggtaacggttaaacggtttaccggaagttacgggaacctaagggtttaacccggaaacggttaaaaggggtcgggttaaccttagttcgggttttactttacgggtaaattaccgggttcgggttaccccgggggaaccgtaagggttaaacggtaggttaccgggg

SEQ ID NO: 113641 - DNA, 787 bp, Homo sapiens
  misc_feature: GYAE6OF01D71V2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaggtgtccagtgtagagtgcgaggtggtggagtcgtggggagccgttaggtaacggccgtcgggggtccttagacgtctcctgtgtcgtcctcgtggtacttctacttcgaagttaagtcggtactggtagttacggtaggttccggtcccgccgtacggccgtacccggagggggaacgggtcggtagggtaggttggggttaggtaacgtttaaagaaaagttaaaagtagtagtaggtaagtaaacgaaaatacggtaacggtacggtacgaccgtaacggtaaggaaaggaacgtacttaccaaccgtacgtacgtacgaaagtacgtaaattaacgttaaaccgaaaacggtttcgttaacgttacgtttacgaaataactaagaaacgtacggaaccgtaaacgaaaccggacgaacctaacgacgttcctaacttacgttacgtaacgtaaccgtaagtagtaacgtaccggtaagtcgaactaaggtaaccgtaaagggtaacggaacgggttacttaacggttcgttttacgttaacggtacgtttaaacgggtcccgggttaacccgggtacccggttaaagggacctaacggggtttcccggg

SEQ ID NO: 113642 - DNA, 740 bp, Homo sapiens
  misc_feature: GYAE6OF01AFX7S.15.86.H09.1.454.CMB.1.raw
  modified_base (247)..(247): a, c, t, g, unknown or other
  misc_feature (247)..(247): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtggggagtccgttggtaagccgtgggggtccttagngtctcctgtgtcgcctcgtggtacttctactttcagtaagtggctggatggtaggttcgggtcccgccgaggccgtaccggagggggaacggggtcgtgggtaggttggggttaggtaacggtttaacgaaaaaggttaaaagtgtaagttaggtagaaagtaaaagtacgtaacgtacggtacgaccgtaacccggtaaggaaaagggtaacgtacttaccaaccgtataccgtaacgaaggtaagtaacttaaacgttaaccgaaaaacggtcggttagttaagtttacgaactaaagtacaacgacgtaccgtaacggaaaccgcgaacacgtacgtccttaacttacttaccgtacgacccaacgtagtacgttaccgggaagttcgacgtacgtacggtaaacggtaagggtacgttactagttacgtttcgtttaagaccgttacggtcccgggtacgggaacccgtaggaaccggttgttccgggg

SEQ ID NO: 113643 - DNA, 708 bp, Homo sapiens
  misc_feature: GYAE6OF01DTJOS.15.86.H09.1.454.CMB.1.raw
  modified_base (249)..(249): a, c, t, g, unknown or other
  misc_feature (249)..(249): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagtccttggtaaaggccgtgggggtcccttagngtctcctggtgtggcctcgtggattcctactttcagttaatggtctggatggtaggttgggtcccgcgaggcctccggaggggaggggcgtgggaggttggggtgtacgttaanaaaagtaaaatgagtggtanaaagaaatagaactaggtcgccaaccggtagaaacgagacttcaacatctacgaaagaagtaattaataacgtaaaacgtacggttagttaatttagactaaagtacgaaaccaggaacccgtaacggaaaacccggaacggtaaccgaacgtacgtacccgttacttaattaaccgtacgtaacccaacgtaacgtaacgtttacgggaacgtacgacgtaacgttaccggaaacggttaaagggacgttaacgttaattcggttctttttagacgttagttaccgggtaccggggaccgtaacggggtaacgtaggttacggg

SEQ ID NO: 113644 - DNA, 862 bp, Homo sapiens
  misc_feature: GYAE6OF01CSM46.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttcctgctgctatacttaaaggtgtcctagtgtgaagtgcgaggtggtggtagtcggtggggacgtcgttaggtaaacggccggttcggggtacccttaggtacgtccgtccgttggtggtcggccgttacgtcggtactttcgtacctttacgtaacgttaagtcggtcgtaggtagttgggtacgttcgggtacccgaccgtacggtccgtaaccgggagggggaacggggtccgttaggggtagggtttcgggttaacggtaacggtttaaaacggtaaaaaaggttaaaagtcggtaaggtaggtaagaaacgtaaaagtacggtaaccgtacggtacgaacccgtaaccgggtaagaaaacggtaacgtaacgtaccgtaaccgtaactacgtaacgtaagtaaacgtaattaaacgtaaccggtaaaaccggtggtttaagttaacgttacgaaagttaaacgtaaccgaaaccgtacgtaaccgttaaacggaaaaccgagtaacctacgtaaccgtacgtttacctaaggttaccacgtaaccgtagtacgttaccgtaggtaatccgaacgtaaaggtcggtaaaacggtagtacccgtatttaacggtcggtttaaccttaaggggaccctttacggggttacccgggaaaacccggggtcccgttaaaagggtccctttagggggtttcccggg

SEQ ID NO: 113645 - DNA, 901 bp, Homo sapiens
  misc_feature: GYAE6OF01CF3HC.15.86.H09.1.454.CMB.1.raw
  modified_base (178)..(178): a, c, t, g, unknown or other
  misc_feature (178)..(178): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccatggagttcggctgagcttgggttttcctgctgctatactaaaagntcgtcagtgtagagtgcgaggtggtggagtcggtgggagtccgttaggtaacgtccggtcggggtacccttagacgtccgtccgtggtcggttcgtccttcgtggtacttcctactttacgaagttaagtcggagtaggtacgttagggtacgggtttccggaccccgaccgtacgggtacccggtaccgggaaaggggggtacggggtaccggttaggggtacgggtttacggggggtttaccgttaaaccggttttaaaaaggaaaaaaggtttaaaaacgtggtaaaggttacgggttaaaaggtaaaagtaaaacggttaacggtaaccgtaacggtacggtaacccggtaaaccggtaaaggaaaacggtaacgtaactaaccaaccgtaaatccgtaaacgtaaagagttaaaacgtaaacgttaaaccggaaaacgttggttattacgttaaagaactaaagtaaccgaacgtacgtaaacgtaaccggtaaaagaccaacgaccgtaacgaacccgttatttaaaccgtaaccgttacgtaaaccccgtaggtaaacgttaacggttaacggtaacgtaacgtaccgtaaacgggttaaaccgaaaacggggttaacggtacgttaaggttaacgttacgtttaaacgttaggttaaaccgttccggtaaccgggttaaccgggaaccccgggttaaagaccccggtttaaaggg

SEQ ID NO: 113646 - DNA, 712 bp, Homo sapiens
  misc_feature: GYAE6OF01EABLT.15.86.H09.1.454.CMB.1.raw
  modified_base (430)..(430): a, c, t, g, unknown or other
  misc_feature (430)..(430): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcagggtggtggagtcgtgggggagccgttggtaaagccgtgggggtcccttagagtctcctgtgtggcctctggattcactttcagtaagtggctggatggtaggttcggggtcccgccgaggcctaccggaagggggaagggggcgtggggtagggttgggggttgggtaaccggttttaacgaaaaaggttaaaaagtggaagttgggtagaaagaaaagtagaacgtacggngaccaacccggtaggaaaaggaagtacttccacatctacaaagacgaattaattaacgaaaaacgtcggtagttatttagaactaaatagaaacacgacctaacgaaaaccggagaaccacgacgtaccgtacttaacgttacctacgtaacccgataagtagttacggaagtacgactaagtaccggaaacggtaaagggacgtaccgttaagtcggtttaccttttagtattaccgttcgggtaccgggggaaccccggaaggggtaactaagggttcgg

SEQ ID NO: 113647 - DNA, 827 bp, Homo sapiens
  misc_feature: GYAE6OF01AV0WN.15.86.H09.1.454.CMB.1.raw
  modified_base (727)..(727): a, c, t, g, unknown or other
  misc_feature (727)..(727): n is a, c, g, or t
  modified_base (765)..(765): a, c, t, g, unknown or other
  misc_feature (765)..(765): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcggctagagcttgggttttccttgctgctatacgttaaaaggtcgtccagtgtgaagtgcgaggtggtggagtcgtaggggacgccgttagggtaaacgtccggttcgggggttaccccgttaaggtacgttccgttcccgttggttcggttcggtccccttcgtcggtactttcctaacttttacgtaacgttaagtggacgttgggattggtacggttccgggttacccggcccgtaacggtccgttacccggagggggtaacgggtcgttagggtagggttgggttacggttaacggttttaaacggaaaaaagttaaaaaggttggaagttaggtaaggtaaagtaaaaagtacgtaacgtaacggtacgaccgtaacccggtaagaaaaggtacgtaattaccaaccgtactactaacgtaaagaacgtaaacgtaaacgttaaccgaaaacgggttcggttagtttaagtaacgaactaaacgtacaaaccgtacgtaaccgaaaacggtaaacgacgaactaccgaacggtttaccctaagttacttaccggacctaacgaacgtaacgttaaggacgaatanccgtaaacgtacggaagtaaacggtgtactttcggttnttaccgttagtaacctacgggtacggccgggtaaaccccgtaaggtaagttcccggttacgg

SEQ ID NO: 113648 - DNA, 751 bp, Homo sapiens
  misc_feature: GYAE6OF01DC3UA.15.86.H09.1.454.CMB.1.raw
  modified_base (522)..(522): a, c, t, g, unknown or other
  misc_feature (522)..(522): n is a, c, g, or t
  modified_base (580)..(580): a, c, t, g, unknown or other
  misc_feature (580)..(580): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtccagtgtgagtgcgaggtggtggagtcgtggggggagtccgttaggtaaacggtcccggtggggggtcccttaggacgttccgtccgtggtgtcggtccttcgtggtatttccttacttttcaaggtaattggcgtggattggtaggtttcggggcccgccgagggtcctaccggaagggggtaacgggggctaggggtagggttggggtttacgggtaaccggttttaaacgaaaaaaaggttaaaaagttggtaaggttagggtagaaaaggtaaaaagtaggacgtaacgggtcgaaccgtaccgggtaagaaaggaaagtctacgaacctataccanaagtaacgattaaataacgaaaacggtggttattagttagaaactaaagtacgaaacncggtaacctaagggaaaaccgcgtaacaacgacgtaccgttatattactaacgtaccaagtagtacgttagaagtggaccttaaagcgggtaaacgtaaaggacggtcttaagtcggttctttaggacttacggtccgggtagggaccccgtaagggtcgtacgttcgggg

SEQ ID NO: 113649 - DNA, 818 bp, Homo sapiens
  misc_feature: GYAE6OF01D9GRU.15.86.H09.1.454.CMB.1.raw
tcagtctacgtagccacgaccggtgctcgatttagtgctatagacttggggtttgggggggagaggagcaccagccttgggatccccaagtgttttcattcagtgatcaggactgaacacagaggactcaccatggagttcgggctgagcttgggttttccttgctgtctaatacttaaaaggtcgtaccagtgtgaagtgcgagggttggtggaggtcgtggggggagtccgttagggtaaaaggtccggtcggggggttacccttaggacggtctccgtgtggtggccctgtggattcctactttcgaagtaatggctaggagttgtaggttcgggtcccggacgtacggccttaccggaagggggaggggtcgtaggggtaggttcggggttggaacgttttaacgaaaaaggtaaaagtggtagtaggtagaaagtaaaagtacggtaacgttacggcgtaaccgaacccggtaaggaaaaggtaagtacttaacccgacctaacgtactaacgaaagtaacgtaattaactaaacgaaaacggtacgtagttaactttaggaaactaaaatgaaaccctaggtaaccaaacggaaaaccgagtaccgaacctaacggcccttaactaagtttaacccgtaggtaaccctaactaagggttaaccgtttaccgggactaggttaccgaacggttaaacccgaaaggggtaaaagaacgggttaccttaagttacgggtttacctttttaagaacgtttacgggtacccggggtaccgggggaaaccccggtaaagggtaaccgttaaaccgggg

SEQ ID NO: 113650 - DNA, 799 bp, Homo sapiens
  misc_feature: GYAE6OF01EOMBL.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagtccttagggtaaacgccgtcggggggttcccctttaggacggttccttccgtggttggtcggcccttcgtggtatttccacttttcagttaagtggctggactggtaggttgggcccgccgacggcctaccggaggggaacgggggcgtgggtaggttggggttggtaacgtttaacgaaaaaggtaaaatggtaatgggtagaaacgtaaaatacgtacgtacggtagaccgtaccggtaaggaaaaggtaagtaacttaccaacctaacgtacgtaacaaaggaagtaaataaacgttaaacgaaaaacggtacgggttattaatttagaactaaaagtagaaacctacgaaccgtaaaggaaaacccgagaacctaacgacggtacccgttattaacttacttacggaaacccagtaacgtacggttaggaagtcgtaactacggttaaccggtaaaacgggtaaaacgggttaggtacctttaaggttacgtttacgttttaacgtaacgtttaaccggttccgggttacccgggggaacccctaaacgggggttaaccgtaacgggttacccggggg

SEQ ID NO: 113651 - DNA, 729 bp, Homo sapiens
  misc_feature: GYAE6OF01CGDYS.15.86.H09.1.454.CMB.1.raw
  modified_base (341)..(341): a, c, t, g, unknown or other
  misc_feature (341)..(341): n is a, c, g, or t
  modified_base (532)..(532): a, c, t, g, unknown or other
  misc_feature (532)..(532): n is a, c, g, or t
  modified_base (557)..(557): a, c, t, g, unknown or other
  misc_feature (557)..(557): n is a, c, g, or t
  modified_base (651)..(651): a, c, t, g, unknown or other
  misc_feature (651)..(651): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttcctgctgctatcttaaaaggtgtccagtgtgaagtgcagggtggtggaggtcgtgggggagtccttgggtaaacgccgttggggggtcccttaggagtctccgtgtgtggccttcgtggattcactttcagtaatggctggatgtaggttgggtccgcgagccgtaccgaggggagggcgtgggngtgggttggtacgtttagaaaagtaaatgaagtggtagaagtaaaagtgaacgttacggactaccgaacccgtaggaaaagggtacgtacgttaccaacccgtattaccgtaacgaaagaagttaactaaacgtttaaccgaaaaaaacggtcgggttaattacgtttaacgactaaaagtcggaaaaccncggtaccgtaaacggaaaaacccgnggaacctacacggtacccgttactaatttaccgacgttaacccgagttacggacgtttacggaagtcggtactacgtacggaacgggtaaaggngtcccgtttaagtcgtttagtttaccgaagttttcggaccggttacggggaccctaaagggtacgtacggttccgggg

SEQ ID NO: 113652 - DNA, 905 bp, Homo sapiens
  misc_feature: GYAE6OF01BBQUT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcgaggtggtggagtcgtgggggagtccgttaggtaaagccgtgggggtcccttagagtctcctgtgtcggcctctggtattcactttcagtaatggctggatggtaggttcgggccgccgacggcctaccggagggggaacggggcgtgggtagggtggggtttaggtaaccgtttaacgaaaaaaggttaaaaagtggtaagttagggtaacgaaagtaaaaacgtaggtaaccgtaacggtacgaccgtaacccggtaaggaaaacggtaacgtaacttaccgaacctaattacccgtaacgaaaacggtaaggttaaacttaaaacgtttaaacccggaaaaaaaccgggttacgggtttaagtttaaacgttttaacggaaaacgttaaaacgtaacggaaaaccgtaaccggtaaccccggttaaaaacgggaaaaaaccccgggaacggggtaaaccctaacccggtaaccgggttacccctttaaacgttttaaaccgttaaccgtttaaccggtaaaccccgtaacgtaaacggtttaacggttaaccggggtaacgttaccggaaccgttaaacggtaacccgggtaaaacgggtaaaacgggtagggtaccctttaggttacgggtttacttttaaggaacgtttaccgggttaccgggtccgggggtaacccgtaaggggtaaacccgttggttacccggg

SEQ ID NO: 113653 - DNA, 992 bp, Homo sapiens
  misc_feature: GYAE6OF01CFDWG.15.86.H09.1.454.CMB.1.raw
  modified_base (511)..(511): a, c, t, g, unknown or other
  misc_feature (511)..(511): n is a, c, g, or t
  modified_base (604)..(604): a, c, t, g, unknown or other
  misc_feature (604)..(604): n is a, c, g, or t
tcagtctacgtagccacgaccggtgctcgatttagtgctatagacttgggtttggggggagaggagccccagccttgggatcccgaagtgtttcattcagtgatcaggactgaacacagaggactcaccagtggacgttcgggctggagcttgggttttcctgactgtctatacgttaaaggtgtaccgagttcgtgtaaggtgtactagggttggtggtacgtcggtaggggggtactacgtttaggtaaacggtcccgggtcgggggttaccccttaaggtaccgttcgtaccggtttggtcggttccggtaccccgttaggttcgggtaaactttccgttaccggttttacgtaaggttaacgttcgggtaaccttgggtaagttcggttaaccgggttcgggtaccccgccgttaacgggcccgttaccgggaaaggggtccgggtacgttacgggtagggtttcgggtttaacggtaaccgttttaaacgaaaaaaggttaaaacnggtaacggtaggtaacggtaaagtaaaacgtcgtaacgtaacggttaccgaccgtaaccgggtaagtaaaacggtagtacttaaccaaccgtntaccgtaaacgttaaggaaacttaacgtttaaacgtaaccgggtaaaacggtaccgttaaggtttaacgtttaacgaaacgttaaaacggtacggtaaaaccgttccggtaaccgaaaccgggtaaacccgaacggaccgtaaacccgtcgtacccgtttaacgtttaaacgttacccggttaacctttaacccggaccgtaacggttaacggtttaaccccggtaaggtacccggttaactaaccggggttaaccggtaaaacggtttaaacggaaccgggtttaccgttaaagtttccgggtttaaccgtttaacgggttaccgtacgttttacccggggacggggttaacccccgtttaagggaaccgtttaccgggttaccggg

SEQ ID NO: 113654 - DNA, 783 bp, Homo sapiens
  misc_feature: GYAE6OF01BAD35.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacaagaggactcaccatggagttcgggctggagctttgggttttccttgctgctattacgttaaaaggtgtccaggtgtagaagtgcgagggtggtggagtcggtgggggtacgtccgttaggggtaaacggtccgggttcggggggttacccttaggtacgttccttccgttggtcggtcggtccgttcgtggtactttctactttcgaagttagtcggtcgtggtatcggtaggttcgggcccgtccggacggtccgtaccgggagggggaacgggtcggtgggtagggttggggttcggtaaccgtttaaagaaaaagttaaaggtgtaaggtaggtagaaagtaagtacgtacgtacggcaaccgacgtaagaagactactaccaacgtatacacaagactaataacgtaacgaaagtcgtgttaacgttagaactaaagacgtaaacgacgtacccgtaaaaggaacccggtagaacccgtaacgaccgtttaccgtacgtttaattaacccgactaaaccgtaacgtaagggttacggttaacggaacgtcggaccttaagggaaaccgggtaaagtaaggtacgtgtttattggttacctttaggacggtaacgtttcccggggaacggtaacgggacgttaacggtagggttcccggg

SEQ ID NO: 113655 - DNA, 723 bp, Homo sapiens
  misc_feature: GYAE6OF01DSBB0.15.86.H09.1.454.CMB.1.raw
  modified_base (216)..(216): a, c, t, g, unknown or other
  misc_feature (216)..(216): n is a, c, g, or t
  modified_base (410)..(410): a, c, t, g, unknown or other
  misc_feature (410)..(410): n is a, c, g, or t
  modified_base (552)..(552): a, c, t, g, unknown or other
  misc_feature (552)..(552): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgagtgcaggtggtggagtcgtggggganccgttgggaaagccgtggggggtccctaggacgtctcctgtgtcggcctctggattcgactttcaagttaatggctggatggtaggttcggggtccgaccgaggcctccggaaggggaaggggctagggacggttggggttaggacgttttacgaaaagtaaaatgagtaggtagaagaaaatagacgtacggngacacccggtagaaaggaacgtattaccgaaccctagtacctaacgaaagtaagaattaacttaaccgaaaaaccggtacggttagttaagtttacgaaactaaagttacggaaactacggtacctaacggtaaaaaccggngtaaccacggacgtacccgtacttaacttaccgtaacggtacccagtaacgtacgttacgggaaacgtcgaacctacgtaaccggaacggttaaacgggaagtcgttaattcggttacctttaagtactaacgttcggacggggttacccaaggggtactaaggttccggg

SEQ ID NO: 113656 - DNA, 777 bp, Homo sapiens
  misc_feature: GYAE6OF01BVWD5.15.86.H09.1.454.CMB.1.raw
  modified_base (179)..(179): a, c, t, g, unknown or other
  misc_feature (179)..(179): n is a, c, g, or t
  modified_base (289)..(289): a, c, t, g, unknown or other
  misc_feature (289)..(289): n is a, c, g, or t
  modified_base (501)..(501): a, c, t, g, unknown or other
  misc_feature (501)..(501): n is a, c, g, or t
  modified_base (618)..(618): a, c, t, g, unknown or other
  misc_feature (618)..(618): n is a, c, g, or t
  modified_base (718)..(718): a, c, t, g, unknown or other
  misc_feature (718)..(718): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttggtttcctgctgctatacgttaaagtntcagtgtgagtgcgaggtggtggagtcggtggggactccgttagggtaacgccggtgggggttcccttaggcgttctccgtgtgtggtcctgtggtattcctaccgtttnaaggttaatggtctaggtagtggtaggttccggggtccaccgtagggtcctacgggagggggtaacggggtcgttaggggtagggttacggggttacggttaaaccgtttaaacggaaaaaaggttaaaaagtggtaacgttaagggtagaaaaggtaaaaactcgggtaaccgtaacgggtcacccggtaaacgggtaagaaaacgggtanaaccttccaacctatacgtaacaaaggtaataacgtaaacttaacggaaaacggttcggttaatttattaggaaactaaacgtacggaaaactgggaacctaacgggaaaaaccggngaaccacggtacgttaccgtaattaacgttacgtaacctaaccgagtaagttaggtcggtaaagcctaacggacgtaaccggtaaaggtaaggaaccgtnttaaggtcgtttatttaagactcgttaccggggaccggtacgaaggttcgaggttccgg

SEQ ID NO: 113657 - DNA, 751 bp, Homo sapiens
  misc_feature: GYAE6OF01BFVOS.15.86.H09.1.454.CMB.1.raw
  modified_base (179)..(179): a, c, t, g, unknown or other
  misc_feature (179)..(179): n is a, c, g, or t
  modified_base (703)..(703): a, c, t, g, unknown or other
  misc_feature (703)..(703): n is a, c, g, or t
  modified_base (709)..(709): a, c, t, g, unknown or other
  misc_feature (709)..(709): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtgggttttccttgctgctatacttaaaggtntcagtgtgagtgcaggtggtggagtcgtggggacgtccgttagggtaaacgccggttcggggggttaccccttaggacgtccgttcccgttggtcggtcggtcccttcgtgggtactttcctaccgttttcgagttaagtggctggatggtaggttcgggccgacgaggtccgtaccggaggggacggggcgtggggtaggtgggttggtaacgtttaacaaaaagttaaagtggaattagggtagaaaggtaaaagtaggtaccgtacggtcgaccgtaacccggtaaggaaaaggtacgtaacttaccgaacctactactaacgaaaggaactaagttaaacgtaaacgaaaaaccgggttggttaagttaacgtttacgaactaaaacgtcgaaacgtacggaccgtaaaacggaaaccggtacggaactaccgtacggtacccttattaacgttacgtaaccgtaacgacgtaaggttattaccgggatacgcgtaacgtacgaaacggtaggaaccgtnttagtnttcgttatacgtcggtcggacggtacgaggtactggttccgg

SEQ ID NO: 113658 - DNA, 798 bp, Homo sapiens
  misc_feature: GYAE6OF01D8BIF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggtactcacatggagttcggctgagcgttggttttcctgctgctatacttaaaggtgtccagtgtagaagtgcgaggtggtggagtcgtggggacgtccgttaggaaacgtccggtcgggggttcccttaggacgttccgtccgttggtcggtcggtcccttacgtggtactttccgtacttttacgtaagttaagttcggtccgttaggtagttagggttacgggtttccgggggtacccccggaccggtaaccgggtaccggttacccgggtaacgggggggtaacgggggtccggttgggggttaacgggggtttcgggggttttaacgggttaaaccggttttaaacgaaaaaaaggtttaaaagtgtaaggttagggtaagtaaagtaaaagtacgtaacggtacggtacgaccgtaaccggtaaggaaagaagtactacgaacctatacagaaagactaataacgttaaacgaaacggtcgtagttaagttagtaactaagtagaacgtacgaccgtaaacgaaaccgacgaacgacgtacgtacctattaacgtacgtacgtaaccagtagtacgtacgaacgtgaacgtacgtacgtaacgtaaggacgtcgtagttgttacgttactaggtacgtcgggtaccgggtacgaacgggtatggtaccgg

SEQ ID NO: 113659 - DNA, 644 bp, Homo sapiens
  misc_feature: GYAE6OF01EVNRE.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtgggagtcgtggggggagccgttggtaaagccgtggggggtcccttagagtctcctgtgtcggcctctggattcactttcagtaatggctggatgagttgggtccgcaggctccgaggggaaggggcgtgggaggtggggttggacgtttacgaaaaggttaaaatgaatggtagaagaaaatagactacggtgccgacccgtagaaaggagacttacaccatctacaagacgaataattaacgaaaaccgtacggttagtatttacgactaaagtagaaacagacctacgaaaaccgaggaaccacgacgcccgttactaacttactacgtaacccagtacgtagttacggaagtacgactaagtccgaaaggtaaaggaggtctaagtcgtcttttacgattacgtcgggtacgggacccgtagggaactaggttaccggg

SEQ ID NO: 113660 - DNA, 841 bp, Homo sapiens
  misc_feature: GYAE6OF01CCUYF.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagtcttgggttttcccttgctgtctatacttaaaaggtgtccagtgtgaagtgcgtaggtggtggagtcggtgggggtacgtccgttagggtaaacggtccggttcgggggggttacccttaggacgttccttccgtggtggtcggtcccgtcgtcggtattcctactttcgtaacgttaagtggtcgtagggtatcggtaggttcgggtcccgaccggacggtccgtacggaggggtaacgggggtctaggggtggttaggggttggtaacggtttaacgaaaaagtaaaacgtagtaggtagggtaagaaagtaaaagtacgtaacgtacggtacggtacgaacccgggtaaggaaacgtaagtactacctaactaacgtactagaaagtagtaaacgttaaataaaaccgtaaaaacggtacggttaagttaacgttaacggtaactaaaagtaacgtaaaccacggtaaccgtaaacggaaaacccggtaacgaaccgtaaccgtacgtacccttaacgttaacttacgttaacggtaacctaacgtacgtaacgttacggtaactcggtaactaaacggtaacggtaaaccggtaaaggtaacggtcgtaagttcggttacgtttacggtaattacgggttaccgggtaccggggtacccggtaacgggtaacgttagggttacccggg

SEQ ID NO: 113661 - DNA, 833 bp, Homo sapiens
  misc_feature: GYAE6OF01A5DZQ.15.86.H09.1.454.CMB.1.raw
  modified_base (790)..(790): a, c, t, g, unknown or other
  misc_feature (790)..(790): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttcctgctgctatctaaaggtgtcagtgtgaagtgacgaggtggtggagtcgtgggggacgtccgttagggtaaacggtccgtcggggggttcccctttaaggacgttccgttccgtggttggttcgggtcccttcgttgggtactttctaaccgttttcgtaagttaagttcggtacgtggtagttggtaacggttcggggtacccgccgacgggtccgtacccgggagggggaaacgggggtccgtaggggtacgggttacgggggtttacggtaacggttttaaaccgaaaaaaaggttaaaaagttggtaaagttagggtagtaaaagtaaaagtacgtaacgtacggtacgaaccgaacccgtaggaaaacggtaacgtacttaccgaaccctataccgtaacgaacgtaagtaacttaaacgttaaccgaaaaacgggttacggttagtttaacgtttacgaaacgttaaaagtacgtaaaacgtacggtaacccgttaaaaggaaaaccccggaggtaacccaaccggcgttaccgtaaccttaacgttacaccggttaaccactaaggttacgtacgtagggactaccgaagtacggtaaacggtaaaggcgttagttaccgtagttntttacgatccggttacggcgggaaccacgggaattacggtcgg

SEQ ID NO: 113662 - DNA, 901 bp, Homo sapiens
  misc_feature: GYAE6OF01DHT41.15.86.H09.1.454.CMB.1.raw
tcagtctacgtagccacgaccggtgctcgatttagtgctatagacttgggtttggggggagaggagccccagccttgggatccccaagttgttttcattcagtgatcaggactgaacacagagactcaccagtggagttcggctgagtcgttgggttttcctgctgtacttatacgttaaaggtcgtacagtgtagaagtgcgtaggtggtggtagtcggtggggacgtccgttagggtaacgtccgggtcgggggttaccttaggtacgtcctccgtggtgtcggtccttgtggtactttctacgtttacgagttagtggtacgtaggtagttcggttacggttccgggtcccgaccggtacggtccggtaaccggggaagggggtacgggtcggtaggggttagggtttaggggttacggtaacggttttaaaacgtaaaaaggttaaaagttggtaacgttagggtaaagtaaaacggtaaaacgttacgtaaccggtaaccggtacgtaaccccggtaaccggtaaaggtaaaacggtaacgttaccgtaacctaaacgtactaaccgtaacgtaaacgggtaaattaaactttaaacggtaaacccgtaaaacgggtttacggtttaattaacgtttaagaaaccgttaaagtaccgaaacgtacgtaacccgtaaagggaaaccgacggaccgtaacgtaccgtccgttaacgttacgtttaccgaacgttaaccgaacgtaacgttaccggttacggtaacgtacgaacgttaaacgggtaccggtaaaagggtaacggtacgttactttacggtttacggtttcgtttaacggaccgttttaaccggaccggggtaccccgggaacgtaaacggtacgtttcgggttacccgg

SEQ ID NO: 113663 - DNA, 748 bp, Homo sapiens
  misc_feature: GYAE6OF01DA7ER.15.86.H09.1.454.CMB.1.raw
  modified_base (303)..(303): a, c, t, g, unknown or other
  misc_feature (303)..(303): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcaggtgggtggagtcgtgggggagccttaggtaaagccgtggggggtcccttagagtctcctgtgtggcctctggattctactttcagtatggctggatgagttggtccncaggctccgaggggaacggggctgggaggtggggttggaacgtttacgaaaaagtaaaatgagtaggtagaagaaaagtggaactacggtcaccgtaacccggtaggaaaagggtaaagtcttaccaacccgattacctacgaaaaggtataattaaactttaacgaaaaaccggtcggtttagttaagtttagactaaatacgtaaagaccgtaccgtaacggaaaaccccggacggaaccgaaccgtacggaccccgtttaacgtaacttaacccgttacggtaaaccctaaacgtacgtaaggtttaccgggaaattccggaacgttaacggtaaccggtaaaacgggttaagggacggtaccgttaagttcgttaacgtttttagaaactttcggttacccggtacggggacccgtaaacgggtacgtaaagggttccggg

SEQ ID NO: 113664 - DNA, 832 bp, Homo sapiens
  misc_feature: GYAE6OF01EUOVU.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatacttaaaaggtgtccagtgtgagtgcaggtggtggagtcgtgggggagtccgttagggtaaacgccggttggggggttccccttaggacgttccgtcccgttggtggttcggccctcgtggtatttcctacttttcgagttaaagtggtcgtgggaatggtaggttcggggtcccgccgaggcctccggaggggaaggggcgtggggtaggttgggggttaggtaacggttttaacgaaaaagttaaaagtgaagttggtagaagaaaatagacgtacggtcgacgaccggtagaaaagggaacgtacttaccaaccctaatcctaacgaaaggtaagtaaacttaaaacgtttaaccgaaaaaaaccgggttacgggtttaacgttaacgttttacggtaaactaaaaagtacggtaaaaccaacggtaaccccgtaaacgggaaaaaacccgtagggaaacccaaccggtaaccgtaccccggttacttaacgtttaaccgtacgttaaacccacgtaaacgtaacgttacgggtaaagtcgacgtaacgtaccgggtaaaacgtaaaggggtacgtacttaaggtcggttacgttttacgaagttaaccgttccgggttaccggggtaacccccggaaggggtaacctaaagggttccgggg

SEQ ID NO: 113665 - DNA, 765 bp, Homo sapiens
  misc_feature: GYAE6OF01A6ZSA.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccttgggtaaacgccgtgggggtcccttagacgttctccgtgtgtcggcctcgtggattcctactttcgagtaagtggctggatggaggttcgggtcccgccgaggtctaccggaggggaaggggtcgtgggtaggtggggttacgggtaacgtttaacgaaaaaggttaaaaacgtggaagttagggtagaaacggtaaaaagtaaggtaaccgtacggtacgaccgtaacccggtaaggaaaacggtaacgtaacttaccgaacctatactacgaaaagtacgtaagttaaaaccttaacggaaaaaccggtacggttagttaatttacgaacgtaaataggaaaccctagtaaccccgtaaaggaaaacccgtagggaacccacgaacgtaccttataacgtttaccacgtaaccagtacgtagtaccgggaagtcgacgaagttaccggaaacgtaaacgggagttaccgtagttacgttacgtttacgaattccggttacggacgggtaaccccggaaggtaaccgtaagggttcccggg

SEQ ID NO: 113666 - DNA, 683 bp, Homo sapiens
  misc_feature: GYAE6OF01AT677.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttggtaaacgccgtgggggtcccttagacgtctcctgtgtcggcctctggattcactttcagtatggcgtggatggtaggttcgggtccgccgaggccgtaccgaggggaggggtcgtagggaggtgggttaggtacgtttaacgaaaaagtaaaatagtagtaggtagaagaaaagtagacgtacggtcgacgaacccgtagaaaggatactacaaccgtactactacgaaagagtaataacgttaacgaaaacggtacggttagttaatttagaataaaacgcggaaaacctaggacccgtaaaggaaaaccgagacctaacgacgtcctactaacttaactaccgtaacgtaacgtaagttacgttaaggaacgttgacgtacgtacgaaacggtaaggcgtactagtggttactttgaaactttggtaccggtcgggaaccctagggaacgttgtcgg

SEQ ID NO: 113667 - DNA, 801 bp, Homo sapiens
  misc_feature: GYAE6OF01EBPRS.15.86.H09.1.454.CMB.1.raw
  modified_base (446)..(446): a, c, t, g, unknown or other
  misc_feature (446)..(446): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctgggtttccttgctgctatcttaaaggtgtccagtgtgaagtgcaggtggtggagtcgtgggggacgtccgttagggtaaagtccgtggggggttccccttaggacgttcctcctggttcggtcggtccctacgtggtactttcctacttttccgaagttaagtgggtcttgggaatggtaggtttcgggtcccgacccgaggcctaccggaaggggaacggggcgtgggtaggttgggggttaggtacgtttaacgaaaagtaaaaagtgagtggtagaacgtaaaatagactacggnaccgaacccgtaggaaaggtagtaagttaccaacctactactaacgaaagaagtaattaaacgttaaccaaaaacggttccgggttagttaacttttggaaacctaaagtagtaaaccacggtaacctaaacgggaaaaccgtacggaaccctaacgaacggtaccgtttacttaacgttaacctacggttaacccataacggtacttaacgggtagtaccgaacgtaggtacccggtaaaaggttaaacgggaacggtccgttaaagttcggttttacccgttttaaggaccgtttaaacgtccggggttaccggggaccccggtaaggggtaaacctaacggtttacccgggg

SEQ ID NO: 113668 - DNA, 806 bp, Homo sapiens
  misc_feature: GYAE6OF01BH567.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgttgggttttccttgctgctattacgttaaaaggtgtccagtgtgagtgcgaggtggtggagtcgtgggggagtcgttaggtaaacgtccggtcgggggtacccttaggacgttctccgttggtggtcggtccttcgtggtacttacctactttcgagttaagtggcgtggtagtggtaggttcggggtacccgccggaacggcccggtacgggaaggggtcgggtacgggtgggtaggggttcgggttaggtttaaacgttaaaacgtaaaaacggtaaagtagtaagggtaggtaagtaaaacgtaaagtacgtaacgtacggtacgaaccggtaacgtaaggaaagtaacgtctaccgtactactataaagaacgtaagttaaactaacgtaaacggtaacgtaggtttataagttacgaaacgtaagaacgtaacaccggaaccgtaaacggaaaccggacaacgtacgaccgtactttaacctacgttaaccgtaactaacgaacgttacgtttaaggaaccggttagaccgttaaacggtcccgggtaaaacggtaaacgggtaaggtaaccgttactttaggtttactttcggttagtaaccgtcgggttaccgggaccgggtaagaacgggttacgtagggtttcccg

SEQ ID NO: 113669 - DNA, 638 bp, Homo sapiens
  misc_feature: GYAE6OF01DGJIN.15.86.H09.1.454.CMB.1.raw
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (417)..(417): a, c, t, g, unknown or other
  misc_feature (417)..(417): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctgggtttttccttgctgctatacgttaaaaggtgtccagtgtgaagtgcaggtggtggagtcgtggggagccgttggtaaacggccgtggggggtcccttagacgttctcctgtgtggcctntggattcactttcagtatggctggatgtagttcggccncgaggctccgagggagggctggaggtgggtgacgtttacaaaagtaaatgatgganaagaaatagactacggtnacaccggtagaaaggtacgattacaacatcacgaanagaattaataaccgaaaaacgtcggttagtatttacgaactaaagtaacgaaacacgaaccgttaagaaaacccgtaggaaccacgtacgtaccgttacttaacgttactacgtaaccagtagtacgttacggaatcgacacgtacggaaacggtaaggcggtactagttgttctttaggtataggttccgtacggggccctaaagggcctaggttacggg

SEQ ID NO: 113670 - DNA, 926 bp, Homo sapiens
  misc_feature: GYAE6OF01EGXSI.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcttgggttttccttgctgctatacgttaaaggtcgtacggtgtgaagtgcgaggtggtggagtcggtggggagtccgttaggtaacggtccggtcgggggtacccttaggtacgttcttccgtggttggtcggtcctgtaggtacttctactttacaagtaagtggcgttggtagtcggttaggttcgggccgaccgacggtccgtaccggaaggggaagacgggtcgtgggtaggttgggtaggtacgtttaaacgtaaaaagtaaagtggtagttaggtaaggaaagtaaaacgtaggtaacgttacggtaccgtaacgtacccgggtaaaggaaaacggtaataaccgtaccgtaacctaacgttaccgtaacgtaaaaggtaacgtaaactttaaaaccggtaaccgtaaaaaccgggttcgggtttaaacgtttaagtttaacgaaaccgtaaagtaaccggtaacgtaaaccggtaccccgttaaaaacgggaaaacccggtaaccggaaccgtaacccgtaaccggttaaccccggtttacttaaacgtttaccggtaaaccccgttaacgaaccggttaaacgttaacggttaaacccgggtaaaggtaccgtaaacccggtaaccggttaaccggtaaaaaccggggttaaacgggtacgttaccgtttaaggtcccggtttaaactttaccgggtaaatttccccggtaaacgggggtacccgggttaacccgtaaacggggttaaaccttacggggtttaacccgg

SEQ ID NO: 113671 - DNA, 776 bp, Homo sapiens
  misc_feature: GYAE6OF01AVZQC.15.86.H09.1.454.CMB.1.raw
  modified_base (195)..(195): a, c, t, g, unknown or other
  misc_feature (195)..(195): n is a, c, g, or t
  modified_base (567)..(567): a, c, t, g, unknown or other
  misc_feature (567)..(567): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggttttccttgctgctatacgttaaagtgtccagtgtgagtgngaggtggtggaggtcggtggggacgtccgttagggtaacggtccggttcgggggttacccttaggacgttcctccgttgtcgtcggtccgttcgtagtacttctactttacaagttaagtggtcgtggtagtggtacggttcgggtcccgtaccgacggtccgtaccgggaggggacggggtcggttagggtagggttaggggttacggttaacgttaaacggtaaaaaggttaaaaagtggtaagttacgggtaagaaaaggtaaaagacgtacggttacggtcgaaccgtaaccgtaaggaaacggaacgtactaccaacgtactacaacgaaagagtaataacgtaacgaaaacgtggttattacgtanaactaagacgaactagaccctaaggaaaccgagtaccacgtacggtaccttaacgtatttaaccgacgtaaccctagtaaaggttccgtaggaacgtcgaacgtaacggtaggaaaccgggtaagacggttactttgttacggttacgtttataacggtcccgggttaggggaccccgggaaaccgggagttacccggtggttcccggg

SEQ ID NO: 113672 - DNA, 869 bp, Homo sapiens
  misc_feature: GYAE6OF01CU0KZ.15.86.H09.1.454.CMB.1.raw
  modified_base (303)..(303): a, c, t, g, unknown or other
  misc_feature (303)..(303): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacttaaaaggtgtccagtgtgagtgcaggtggtggagtcgtggggacgtccgtaggtaaagccgtgggggtcccttaggacgttctccgtgtcgtcggtcctcgtggtattctactttcgagttaagtcggtntggtatgtaggttcgggtccgccgaggtctacggagggaaggggctgggaggttgggttaggtacgttttaacgaaaaagttaaaagtgtaagtggtagaaagtaaaagtagacgtacggtgaccgtaccggaggtaaaacggaagtacttcaacctatacctaacgaaaggtaagtaacgttaaacgttaaccgaaaaacgggttaccggttaaagtttacgtttaacggaaactaaaaagttacggtaaaacccgtaacggtaaccccgttaaagggtaaaaaacccgggaacggaaacccgtaaaccggtaaccggttaacccggtttaacgttttaacggtttaaacccgttaacggtaaccccgtttaaacgaacggtttaacgttaaccggggaacgtttcgaaacccgttaaaccgggttaacccggaaaacggggttaaaaccggtaacgggttaccctttaaaggttacccggtttaccgttttaaggtaacgttaaccggtttacccggggaaccggggtacccgtaaaaccggggtattaaaccgggtttcgggg

SEQ ID NO: 113673 - DNA, 937 bp, Homo sapiens
  misc_feature: GYAE6OF01COW31.15.86.H09.1.454.CMB.1.raw
  modified_base (201)..(201): a, c, t, g, unknown or other
  misc_feature (201)..(201): n is a, c, g, or t
  modified_base (872)..(872): a, c, t, g, unknown or other
  misc_feature (872)..(872): n is a, c, g, or t
tcagtctacgtagccacgaccggtgctcgatttagtgctatagacttgggtttgggggggagaggagccccagccttgggatccccaagtgtttttcattcagtgatcaggactgaacacagaggactcaccatggagttcgggctggagcttgggtttttccttgctgtctatacttaaaaggtgtctagtgtgaagtgngaggtggtgggagtcggtgggggacgtccgttaggtaaacggtccggttcgggggtcccttaggacgttccttccgtgtgtcggtcctcgtcggtacttcgtacttacagttaagtggcgtaggtagtggtacgggttcgggtcccgaccgacgggtccgtaccggaacggggggtacggggtcgtaggggtagggttaggggttacggtaacggttttaaacgtaaaaaaggtaaaagttggtaaggttagggtaaggtaaaaagtaaaaacgtaacggtaaccggttaaacggtacgtaacccggtaaaccggtaaaggtaaaaaggaacgttaacgttaacccgaaccctaacttaaccaacgtaaacggtaaagtaaacttaaaccggttaaaaccgtaaaaaacgggttccgggtttaagttaaacgtttacggaaaccttaaaaaggtaccgaaacgtaaccgtaccccgtaaaacgggaaaacccggtaaggaacccgttaacgaccgttacccgttaaacttaacgttaccgttaaccgtaacctaaccgtaaggttaacctttaaggggtaaacggtacctaaggtaacccgggttaaaaggtaaacccggtaaaacggaccgggtttaatttacccggtttaggtttccgttttaaaaggntttttaaaccgggcccggggtttaacggggaaccccgttaacggggtacgttaacgggttcccgg

SEQ ID NO: 113674 - DNA, 764 bp, Homo sapiens
  misc_feature: GYAE6OF01ARA61.15.86.H09.1.454.CMB.1.raw
  modified_base (203)..(203): a, c, t, g, unknown or other
  misc_feature (203)..(203): n is a, c, g, or t
  modified_base (659)..(659): a, c, t, g, unknown or other
  misc_feature (659)..(659): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttctgacgtgctatacgtaaagtgtccagtgtgaagtgcgaggtggtgngtcgtggggagtccgttggtaaagtccgtggggggtcccttagagtctccgtgtcggtggtcctgtggtacttcgacttttcgagttaatggtctggtatggtaggtttcggggcccgcgaggtcctaccggaggggaacggggtcgttagggtaggttcgggttacggtacgttttaaacgaaaaagttaaaacgtagtacgtaggtacgaaagtaaaacgtacgtaccgtacggtgaccgtacccgaaggtaaacgtagacgttacaacccgtatacccgtaagaacgaacgttaattaacttaacgaaaaccggttggtacttaggtttacaaacgtaaagttacgaacgtaaccgtaaccctaaagggtaaacccgaaggtccaacggtaccgtcttaaccgttacgttaccgtaacgtccctaagtcggttaacttcgggaagttacccgntaacggtaaccggttaaacggaacggtcggtcttaacgtgtttacgtttaaacggattaccgggtccggttacccggggacctacgggtaaagtggttacccggg

SEQ ID NO: 113675 - DNA, 789 bp, Homo sapiens
  misc_feature: GYAE6OF01B5P4S.15.86.H09.1.454.CMB.1.raw
  modified_base (320)..(320): a, c, t, g, unknown or other
  misc_feature (320)..(320): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtgggggacgtccgttagggtaaacgccggttcggggggttacccttaggacgttccgttccgtggttggtcgggtccttcgtggtatttcgtactttcagtaagtcggngtgggatggtaggttcggggtcccgaccgagggtccgtaccgggaagggggtaagggggcgttagggtagggttggggtttacggtaacgttttaacgaaaaaagttaaaagtgaagtagggtaagaaagtaaaagtacgtaacgtacggtcgacgaaccggtaggaaaagacgacttaccgaactactacgtaacgaagtaagtaaattaaacgttaacgaaaaacggtcggtttaattaacgtttacgaaactaaaagtaccggaaacgtaccgtaacccgtaaaggaaaacccgcggaaaccgacgtaacggttaccgttaacttaacgttacgtacgtaaccgaacgtaagtaccgttacggaagttcgacaagtaccggtaaacggaaagggtagtaccttagttacggtttcgttaagtaattccggtcggtacgggaacccgaggtaacgtaggtttccggg

SEQ ID NO: 113676 - DNA, 875 bp, Homo sapiens
  misc_feature: GYAE6OF01B6GKT.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtcgtccagtgtgaagtgcgaggtggtggagtcggtgggggacgtccgttaggtaaacggtccggtcggggggttaccccttaggtacgttccttcccgttggttcggtcggtcccttcgtgggtactttcctacttttcgaagttaagtggtctggtagtggtaggttcggggtccgaccgacggtcctaccggaagggggacgggggtaccgttggggtagggttaggggttacgggtaacggtttaacgtaaaaaagttaaaaagtgtaaggtaggtaggaaaagtaaaacgtaaggtaacgttacggtacgaccgtaaccccggtaagaaaagggaataacgtacgaacctagtacgtaacgaagtaaagtaattaaacgttaaaccgaaaaacggttacggttaagttaacttagaaactaaaagtacgaaacgtaagacccgtaaaggaaacccgaaggaccaacgtaccggtaccttaacttacgttaaccgtacgtaaccgacgttaacgtacggttaaaccggaacggtactaaccggtactaaccggggtaaaacgggtaaaagggtaccggtaaccgtttaaggttacggttttaaccgtttttagaaacgttttaaccgggtacccggggttaccgggtaaaccccccgggaaggggtaaaccccgttaagggtttaccccgggg

SEQ ID NO: 113677 - DNA, 850 bp, Homo sapiens
  misc_feature: GYAE6OF01CFGGJ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagtcgttgggttttcctgctagctatacgtaaaggtgtctagtgtagagtgcgagggtggtggagtcggtggggactcgttaggtaacggccggtcgggggtaccttaggcgttcctcgtggtgtcggtcttcgtggtactctacttacgaggtaagtggtcgtaggagtggtacggttcgggtcccgacggacggtccgtaccggaagggggtaacggggtcgtagggtaggttacggggttacgttaaccggtttaaagaaaaaggttaaagtaggtaggttagggtaacgtaaaagggtaaacggtaacggtaaccggtacgggttaccggaacccggtaaccgggtaaagggaaaacggtaacggaacctttaccgaacttaacgtacctaaacggaaagtaacgttaaagttaaaaccttaaaacggaaaaccgggttcggtttaagttaacggtttaccgaaagtaaacggtccgaaaaacggtcgtaaacccgggaaaggtaaaaacccggcgaaaccgtacccgtaacggtcgtaaacctttacgtaacgtaacccggtacgaaacgttacgggtaactaaccgggtactacgacctaagggtacccggtaaaacgggttaggagtaccttacgggttattcgtttacgaagttacccggtacgggttcccgggaaagtcgtaacgttggtcccggg

SEQ ID NO: 113678 - DNA, 853 bp, Homo sapiens
  misc_feature: GYAE6OF01C3LW0.15.86.H09.1.454.CMB.1.raw
  modified_base (205)..(205): a, c, t, g, unknown or other
  misc_feature (205)..(205): n is a, c, g, or t
  modified_base (804)..(804): a, c, t, g, unknown or other
  misc_feature (804)..(804): n is a, c, g, or t
  modified_base (842)..(842): a, c, t, g, unknown or other
  misc_feature (842)..(842): n is a, c, g, or t
tcagtctacgtagccacgaccggtgctcgatttagtgctatagacttggggtttggggggggagaggagccccagccttgggactccccaagttgttttcattcagtgatcgaggactgaacacagaggactcaccagtggtagttcgggctgagtcgttgggttttcctgctgtctatacgttaaggtgtctagtgtagagtgngtaggtgggtggaggtcggtggggacgtaccggttagggtaacggtccgggttcgggggttaccttaggtacgttcctcgtggtcggtcgtcctcgtgtacttacttacgttacgagttagtggtcgtaggtagttagggttacgggttccggggtacccggacggtaccggtaccggtaccgggggaagggggtacggggtcggtaggggttagggtttacggggtttacggttaaaccgtttaaaaggtaaaaaggttaaaacgtggttaaggtagggtaagaaaagtaaacgtacggtacgtacggaccgtaaccgaaacggtaaggaaggacgtactaccaacgtactacgtaagaaagtaactaacgttaaacggttaaaccgaaacgggttggttactttaagttacggaaactaaagtaacgaaaccgtacgggtaacctaaacgggaaacccgacggtaacctacgtacccggtttattaacccgttagttaacccgactaacgaacgtacgtttaacggtacgtacggtacaaccgtaagggtaccggtaaacggttaaggcggtttactaggttttactacgggtttanaacggttaccggtcggggtaaaccggtccgaagggttntacggggttcg

SEQ ID NO: 113679 - DNA, 820 bp, Homo sapiens
  misc_feature: GYAE6OF01A0RXU.15.86.H09.1.454.CMB.1.raw
  modified_base (741)..(741): a, c, t, g, unknown or other
  misc_feature (741)..(741): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtgggtggagtcggtgggggagtccgttaggtaaacggccggttcggggggttacccgttaggtacgttcgtccgttggtcggtcggtcctcgtggtacttctacttttacgagtaagtggcgtggagtgtacggttcgggtccgccgacggccgtaccggagggggtaagggggcggtagggtacgggttaggggttagggtaaccggttttaaacgtaaaaaagttaaaagtaggtaagttgggtaaggaaagtaaaagtacggtaacgttacggtacgaccgtaaccgggtaaggaaaacggaagtactaccgaactacgtacgtaacgaaagtagtaacttaaacgtaaccgtaaaacggttcggttaagttaagtttacgtaaacaaagttaacgaaaccgtaacgtaacccgtaaccggaaaacggtaccgaacgacccgacggtacccgttaccgttaataccgttacgtaaccgtaacgaagtttaacggtaacgtacgtacgtactaggtaaccggaaacgggtaaaagggngttaacgtaggttcgtttacgttagtaacttacggtacgggttaccggggaccggaggttaaaccggtggttacccggg

SEQ ID NO: 113680 - DNA, 650 bp, Homo sapiens
  misc_feature: GYAE6OF01D9YX5.15.86.H09.1.454.CMB.1.raw
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttggggggggaggaggagccccagccttgggatccccaagtgtttcattcagtgatcgacggactgaaacacagagggactccaccatggagttcgggctgacgcgtgggtttcctgctgctatcttaaaaggtgtccagtgtgaagtgcagggtgtggagtcgtgggggatccgttggaaacgccgtgggggtcctagacgtctcctgtgtcggtctcgtggacttcacttnagtatgctgatggagtcggccncgagcgtcgaggggacgggctgggaggtggttggtacttaagaaagtaaatgagtcgganaagtaancgagtacggtcacgaccgaggaagagtctacactntcgtaacaagtagtaactaaacttaacgaaaaacggtcggttattaagttacgaataagtaacgaacacggtacctaaaggaaaccgtaggactagaccgtacttacgtaattaccgtatacccagtacgtaggtaccggaagtccgtaagtaccgtaagggaaaggtaacggaccggtattacggggtcttaggtttcgaattccgtaccgggacgggtaccgaggtctacgggttaccgg

SEQ ID NO: 113681 - DNA, 861 bp, Homo sapiens
  misc_feature: GYAE6OF01EDDCG.15.86.H09.1.454.CMB.1.raw
  modified_base (809)..(809): a, c, t, g, unknown or other
  misc_feature (809)..(809): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcgttgggttttccttgctgactatacgttaaaaggtgtcctagtgtgaagtgcgtaggtggtggagtcggtgggggacgtaccgttaggtaacgccggttgggggtcccttagacgtctcctgtgtcgtcctgtgtacttctactttacagttaatggtctggtagttggtacggtttcggggtccgaccgacggtccgtaccgggagggggtaacggggtcggtaggggttacgggtttgggggtttacgggtaaacgttttaaacgaaaaaaggttaaaacgttggtaagttagggtaaagtaaaacgtaaaaagttacggaaccgttaccgggtagaacccggtaacccggaaaggtaaaacggtaacgtaaccttaccgtaacctacgttacgttaaacgaaagtaagtaaacttaaaacgttaaacgtaaaaaccgggtacggtttaagttaacgtttaaaccgtaaataaaacggtaacgtaaaccgaaccggtaacccgttaaaacgggaaaaccgtaccgggtaaacaaccggtaccggttaaccttaaccgttaactttaaccggtaaccgtaacctaacgtaagttaaccggtttaagaacggttcaaacgtacgttaaacggaaacggtaaggtaacggtcttacgttnttacgttttagattcggtaacggcccgggtaacgaagggtccttaggtccgg

SEQ ID NO: 113682 - DNA, 762 bp, Homo sapiens
  misc_feature: GYAE6OF01AELOA.15.86.H09.1.454.CMB.1.raw
  modified_base (180)..(180): a, c, t, g, unknown or other
  misc_feature (180)..(180): n is a, c, g, or t
  modified_base (216)..(216): a, c, t, g, unknown or other
  misc_feature (216)..(216): n is a, c, g, or t
  modified_base (298)..(298): a, c, t, g, unknown or other
  misc_feature (298)..(298): n is a, c, g, or t
  modified_base (574)..(574): a, c, t, g, unknown or other
  misc_feature (574)..(574): n is a, c, g, or t
tcagtctacgtagccacgaccggtgctcgatttagtgctatagacttgggtttgggggggaggaggagccccagccttggatccccaagtgttttcattcagtgatcaggactgaacacaagaggactcaccatggagttcgggctgagctgggttttccttgctgctatcttaaaggtntcagtgtgaagtgcgaggtggtggagtcgtgggganccgttaggtaagcgtcggggtccttagagtcctctgtgtggcctctggtattctctttgagttagtggtcgttgagttaggngtttcgggcccgtacgacggtcgtacccggagggggtaaggggtccgtaggggtacgtgggggtttacggtacggttttaacgaaaaacgggttaaaaattggtaaggttacgggtaagtaaaaggtaaaaaccgtacgtaacgttaaccgggtacgaaccgtaacccgggtaaggaaacggtaaagtcgttaaccgacctactacgtaacgaacgtagtaaactaaagttaaccggaaaaccgttaggttagtaactttcgaaacgttaaagaanaaccggtagtaacccgttaagggaaaaccgtaacgggaacccaacgtacggtaccttaacgtactaccgtacgtaaccacgtagttactacggagttacgcgtctaacggacgtaaggcgtacgtatcgggttactttagactttaacggtcggccggggtaacctagggtaacctaggttacccggg

SEQ ID NO: 113683 - DNA, 872 bp, Homo sapiens
  misc_feature: GYAE6OF01D21WD.15.86.H09.1.454.CMB.1.raw
  modified_base (800)..(800): a, c, t, g, unknown or other
  misc_feature (800)..(800): n is a, c, g, or t
tcagtctacgtagccacgaccggtgctcgatttagtgctatagacttgggtttggggggagaggagccccagccttgggatccccaagttgttttcattcagtgatcaggactgaacacagagactcacatggagttcgggctgagcgttggttttcctgctgctatacttaaaggtcgtccagtgtagagtgcgaggtggtggagtcggtggggatccgttagggtaaacggccggttacggggggttccccttagacgttccgttccgttggtggtacggtcccttcgtaggtacttaccttacctttcgtaaagtaagttggcgttaggtagttggtagggtttccggggtcccggaccgtaacggccgtacccggtagggggaaacggggtccgtaggggtaagggtttggggttacggttaaacgtttaacgtaaaaaaggttaaaagtgaagtaagggtaagaaaaggaaaagttaacggaacgttaacggtagaacccgtaaacccggtaaggaaaacgggtaacgtacttaccaaccgtataccgtaacgaaaagtaagtaaacttaagtaaaaccgtaaaacgggtaggtttaagtttaacgttaacgtaaacgtaaaagttaaccggaaaaccctaacgggaccctaaaaaacggggaaaccccggtaaaccgggaaactaacccggaaacccggttcccttaagtttaacccttaacgtaccgtaaaccaaacggttacgttaaacggttacggaagtactacgaaacgttaaccggaaaggtaaacgnggtaacttaagttcggttaactttaggaccttaacggtcggtaaccgggacctaacgggaactacggtacgg

SEQ ID NO: 113684 - DNA, 821 bp, Homo sapiens
  misc_feature: GYAE6OF01E5SJP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcgttgggttttccttgctgcttatacgttaaaaggtcgtccgagtgtgaagtggacgagggtggtggtaggtcggtgggggtacgtccgttagggtaaacggcccggttcgggggtacccttagacgttcctccgtgtcggtcggtcctcgtaggtactttcctactttacgaagtaagtcggtccgtggtaagttggtacggttccggggtcccgaccgtacggcccgtaccggaagggggaacggggtccgtagggtaggtggggtacggttaacgttaacgtaaaaagtaaagtgtaaggtaggtagaaagtaagtacgacgtacggcgaccgtaaccggtaaggaagtacgtactaccgaactacgtacctaacgaaggtaactaagttaaacgtaaaccggaaaacccggttggttaagttaagtttacgaaataaacgttaggaaccgtaacggtaacccgtaaagggaaacccgacggaaccctagtaaccggtcccgttaaattacgttacctaacggtaacctaacgtaacggttacgttaacgggaagtcaaccggttagtaccgggtaaaacggtaaggtacccgtagttagttaccgttttgttaagttacgaccgggtttcgggacccgggaacgaacgggttccaacgggttttcggg

SEQ ID NO: 113685 - DNA, 953 bp, Homo sapiens
  misc_feature: GYAE6OF01CS6BF.15.86.H09.1.454.CMB.1.raw
tcagtctacgtagccacgaccggtgctcgatttagtgctatagacttgggtttgggggggagaggagccccagccttgggatccccaagttgttttcattcagtgatcaggactgaacacaggagactcaccatggagttcgggctgagtcgttgggttttccttgctgtcttattaacgttaaaaggtcgtccagttgtaggaagtcgacggtagggttgggttagggtcggttcgggtaggggggtacgtacccgttagggtaaacgtccgggttacgggggttccttaaggtcgttcgtttccggtggttcggtccggttccgttcgtcggttacttttaccgttaccttacgtaaggtagtcgggtacgtggtaggttcgggttagggtttccgggcccggtccgtaacgggtccgtacgggggtaaggggtacgggggtccggttagggttaggggttgggtttaacgggttaaccgttttaaaaggtaaaaaaggttaagtaggttaacggttaagggtaacgtaaaaggaaaacgtggttaaaccggttacggacggtaacccgtaaaccgggtaaggtaaaacggtaaccgtaacgttaccgtaaaccgtaccgtaacgttaaagtaaaagtactaaacggtttaaaccgtaaaaccggttaaacggtagttttaacgggtttaaattacgaaaccgttaaaggtaacaaacggacgtaaccgtaaaccgggaaacggtacaaccgtaccgtaccttacggtaactttaccgttaacgttaaccctaccggtaagttaccggtacggtttaacggtaaccgtgaaccgttaagtaaccgggtaaacggtaaagtcgggttattgttaacggtttcggtttaactaaggtttccgggtacccgggtacgggtacccgggtaacttaagggttcggtttaacccggg

SEQ ID NO: 113686 - DNA, 816 bp, Homo sapiens
  misc_feature: GYAE6OF01DJ46U.15.86.H09.1.454.CMB.1.raw
  modified_base (204)..(204): a, c, t, g, unknown or other
  misc_feature (204)..(204): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttgggggagaggagccccagccttgggactccccaagtgttttcattcagtgatcaggactgaacacagagactcacatggagtcggctgagtcgttgggttttccttgctgctattacgttaaagtgtcagtgtagagtgcgaggtggtggngtcggtaggggacgtcgttaggtaacgtccggtcgggggttacccttaggtacgttccttccgttagttcggtcggtcctcgtaggtactttcctacgtttacgagttaagtcggtacgtggtagttggtacggttcggggtcccgaccgtacggccgtaccgggaaggggtaacggggtcgtggggtacggggtttgggttaacgggttaaccgtttaaacgaaaaaaggtaaaagtggtaaagtaggtaagaaaacgtaaagtaacggtaccgtacggtacgaaccgtacggtaagaaaggtaactactacaacctntaccaagtaagaactaaattaaacgtaaacgaaaacgggttcgtttaagttaagttacgaaaccgtaaataacggtaaaccaaccggttaaccgaaaacgggaaaacccggcgtaaccaccgtaaccggttccttaaacgttacttaacgtacctaacgacgtagttacggttaacgtaagcgtaagtaacccggtaagtaacgggtaaacggcgttactttaggttacgttttacgtttagaacttccgggttcgggaacccgggaccgtaaggacccgtttggtacccggg

SEQ ID NO: 113687 - DNA, 697 bp, Homo sapiens
  misc_feature: GYAE6OF01B3CU1.15.86.H09.1.454.CMB.1.raw
  modified_base (435)..(435): a, c, t, g, unknown or other
  misc_feature (435)..(435): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagcttgggttttccttgctgctatacgttaaaaggtgtccagtgtgaagtgcaggtggtggagtcgtgggggacgtccgttagggtaaacggccggttagggggttccccttaggagtcctcctggtcgtgtcctcgtggattcactttcagttaatggctggatggtacggttcggtccgaccgtaggcctcggagggaacgggtcgtcgggtaggttcgggttacggtacgtttacgaaaaagtaaaagtggtaagtaggtagaagtaaagtaggacgtacggtanaccgaccgtagtaaaggagtacttcaacctatacctagtaaagagtaataacgtaaacgaaacgtcggttatacttagaacgaaagtnaaacgtacgaccgtaaacgaaacggtacgacacgtacgtaccgttattaacgttacctactaaccccgagtaccgtaacgtttaccgaagtcgaactaagtccggaaacggtaagcgggtctagttcgttatttacgattaccggtcgacgggtaccagggtaactcggtacgg

SEQ ID NO: 113688 - DNA, 630 bp, Homo sapiens
  misc_feature: GYAE6OF01CRCV4.15.86.H09.1.454.CMB.1.raw
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcccttagagtctcctgtgtggcctctggattcactttcagtaatggctggatgagttggtccgccaggctcgagggaggggcgtggaggtgggttggacgtttacaaaagtaaaatgataggtagaagaaaagtagacgtacggtcgacgacccgtagaaaggaagattacgaaccatactacaagagaataataacgaaaaacggtgttagttaatttacggaactaaatagaaacncgtacctaaaggaaaacccgnggaacacgacgcccttataatttacacggttaccaacgtagagttacgaagtcgacagtaccggaaaggtaagaggtactagttgtcgttttagacttagtacggtacggggaccaagggactaaggttccggg

SEQ ID NO: 113689 - DNA, 682 bp, Homo sapiens
  misc_feature: GYAE6OF01C5NYS.15.86.H09.1.454.CMB.1.raw
  modified_base (328)..(328): a, c, t, g, unknown or other
  misc_feature (328)..(328): n is a, c, g, or t
  modified_base (417)..(417): a, c, t, g, unknown or other
  misc_feature (417)..(417): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtccagtgtgaagtgcgaggtggtggagtcgtgggggagtccttaggtaaagccgtgggggtcccttaggagtcctccgtgtgtggcctctggattctactttcagtatggctggatgtagtcggtcgccagctcgaggaagggctggngtggtgacgttacaaataaatgagtagtgaagaaatagactacgtgacaacccgtagaaagaagagttacaaccgtatctaacaagganaacttaattaacgaaaacggtacggttagttaagttacgaataaacgtagtaaactacgaccgtaacgaaaaaccgtaacggaaccgaaccgtacgaccgttacttaacgttaactaccgttaaccaacgtaagtaagttacggaagttacgaccgtaacgtaacggaaaccggtaaaggtacgggtcgttaacgttcggttacttttaggtacgttagttccggttacgggggacccgtaagggtaaccgtaacggttacgggg

SEQ ID NO: 113690 - DNA, 730 bp, Homo sapiens
  misc_feature: GYAE6OF01AP95V.15.86.H09.1.454.CMB.1.raw
  modified_base (381)..(381): a, c, t, g, unknown or other
  misc_feature (381)..(381): n is a, c, g, or t
  modified_base (637)..(637): a, c, t, g, unknown or other
  misc_feature (637)..(637): n is a, c, g, or t
  modified_base (646)..(646): a, c, t, g, unknown or other
  misc_feature (646)..(646): n is a, c, g, or t
tcagtctacgtagccacgaccggtgctcgatttagtgctatagacttgggtttgggggggagaggagccccagccttgggatccccaagtgttttcattcagtgatcaggactgaacacagaggacctcaccatggagttcgggctgagcttggttttcctgctgctatacttaaaggtcgtcagtgtgaagtgcaggtggtgagtcgtggggactccgttaggtaacgccggtcggggtcctagcgtctcgtgtcgtcgcctgtggtacttctcgttacagtaagtcgcgtggattggtaggttccggccgcgtccggtccgtaccggggtaaggggtaacgggcgtagggtacgggttgggttacggtaacggtttaanaaaaggtaaagtgtaagtaggtaagaaacgtaaagtcggaacgttacggtacgaacccgacggtaaggtaaaggacgttaacgtaccacctacgtacgtacgaataacggtaataacgtaaccggtaaaggtacgttaggttactacgtagtaaacgacgtataaccgacgtaaacgaaacgggaccagacccgtaccgtacgttaaccttactaacgtaccgaaccgtacgtaagtaccggttaaggaccgtaanaccgttaanaaccgggttaacgaacggtagtcttaaacggttgttagtaccgtaagtccgttaccgggcgacggtacgtaaggtggttcccgg

SEQ ID NO: 113691 - DNA, 826 bp, Homo sapiens
  misc_feature: GYAE6OF01AWPWA.15.86.H09.1.454.CMB.1.raw
tcagtctacgtagccacgaccggtgctcgatttagtgctatagacttgggtttgggggagaggagccccagccttgggatccccaagtgttttcattcagtgatcaggaatgaacacagaggactcaccatggagttcgggctgagctgggttttccttgctgctatcttaaaaggtgtccagtgtgaagtgcgaggtggtggagtcgtggggagccgttaggtaaacgccgtgggggtcccttaggagtctcctgtgtcggccttcgtggtattctactttcagttaagtggctggatggtacggttcggggtcccgccgacggtccgtaccggaagggggtaacgggggcgttagggtagggttggggtttacggtaacgttttaacgaaaaaaggttaaaaagtggtaagttagggtaagaaaggtaaaagtacggtaaccgttacggtcgaaccgtaacccggttaaggaaaacggtaacgtaacgtttacccaaacctacgtacgtaacgaaaaggtaacgtaaacgttaaacgttaaaccggaaaaacggttacggttaagtttaagttttaacggaactaaaagttacgaaaccgtaccggtaacccgtaaacggaaaaacccggacggaaccgacgtaaccggtacccgttacttaaccgttaccttaacggtaaccccgtaacgaggttaaccgttacggaacgttacgaccgtaaccgtaacggtaaaccgggttaaaaggcggtaacgtttagtgtttaccgtttagaacgttacgtccgggtacggggaacccgtaaggtacgtcggttccggg

SEQ ID NO: 113692 - DNA, 923 bp, Homo sapiens
  misc_feature: GYAE6OF01EMO4S.15.86.H09.1.454.CMB.1.raw
tcagtctacgtagccacgaccggtgctcgatttagtgctatagacttgggtttgggggggagaggagccccagccttgggatccccaagtgttttcattcagtgatcgaggactgaacacagaggactcaccatggagttcgggctgagctgggttttccttgctgctatacttaaaaggtgtccagtgtgaagtgcaggtggtggagtcgtgggggagtccttaggtaaacgccgtgggggtcccttagacgtctcctgtgtcggctcgtggtattctactttcaagttaagtggctggagttggtaggtttcggggtacccgccgacgggtccgttaccccggaagggggtaacgggggtccgttaggggtaaggggtttcgggggtttaggggttaaccggttttaaacgtaaaaaaaggttaaaaaagttggtaagttaggggtaagtaaacggtaaaaaagtaacggtaaccgttaaccgggtacggtaccgtaaccccggttaaacggaaaacgggtaaaacgtaaaccgtttaacgtaaccctaaaccgttaccgtaaccgtaaaggaaagtaaattaaaccgtttaaaaaccgtaaaaaccggtaaacccgggttaagggtttaactttaacgggttaaacaaaacgttaacggtaaacccgtaaccgggtaacccttaaacggggaaaaaccccggaacgggtaaaccgaacccggtaaccggtacccgttaacccgtttaaataccgtttaaaccgtacccgtaaaccgaacggttacgttaacggaagtacggtacaaccggtacggtaaaacgggaacggtaacggtcgttaggtttactcggtttacgttaagtaacgtttacccgggttacgggaccccggtaacggggtaacttacgggttacccggg

SEQ ID NO: 113693 - DNA, 647 bp, Homo sapiens
  misc_feature: GYAE6OF01B77Z5.15.86.H09.1.454.CMB.1.raw
  modified_base (220)..(220): a, c, t, g, unknown or other
  misc_feature (220)..(220): n is a, c, g, or t
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (338)..(338): a, c, t, g, unknown or other
  misc_feature (338)..(338): n is a, c, g, or t
tcagtctacgtagccacgaccggtgctcgatttagtgctatagacttgggtttgggggggagaggagcccccagccttgggatccccaagtgttttcattcagtgatcaggactgaacacagagactcaccatggagttcggctgagcgttgggttttccttgctgctatacttaaaaggtgtcctagtgtagaagtgcgaggtggtggagtcgtggggngtccgttaggtaagtccggtcggggtcccttagagtcctctgtgtgcctntgatctcttcatagtgctgntgtgtcggcgcgngcncgagggaggngtggtgtggttggtacgttaanaaaagtaaagtgagtaggagaagaaatagtacgtacggtcgcgaacggtagaaacggataataccactatactacgaagaataataactaacgaaaacggtgtagttatagaataaacgtagaacacgtaccgaaacgaaaccgagaacctacgacgtcgttaactattacgtacgacctaagtacgtaacgttaggaactcgacgtaacggtaaccggtaaaggtaagggtaccgtattagttacggtttctttagacgttacgttcccgggtaccggggaacctagggtaaccgtagggttcccggg

SEQ ID NO: 113694 - DNA, 852 bp, Homo sapiens
  misc_feature: GYAE6OF01A1QAU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttagggtaaacgccggtggggggtcccttaggacgtctccgtgtgtggcctgtggattctacttcagtaagtggtcgtggatggtaggttcggggtacccgccgtacgggccgtaccggaagggggaacggggggtccgttggggaagggttgggggtttacgggtaaccggttttaaacgaaaaaaaggtttaaaaaagtggtaaggttagggtaaggaaaaggtaaaaaattacggtaaaccgttaacgggtacgaacccgtaaacccgggttaaggaaaaaaggggtaaacgtaacgttaaccgaaccctaacgttaccctaaacggaaaggtaaacgtaaattaaaaccgtttaaaccgaaaaaaacgggttcggttaacggtttaagttttaaggaaacccttaaaagtacgaaaaccgtaacggtacccgtaaaacggaaaacccggtaacggaacctaaccgaacggtaacccgtacgtttaaacttcgtaactaacccgaacgtaacgtacgtttacggaagtaccgacgtaagtacggtaaacgggtaaaggtcggtacttagtagttctttaggattacggtaccggtcggggtaacccgaagggtacgtaggttaccggg

SEQ ID NO: 113695 - DNA, 976 bp, Homo sapiens
  misc_feature: GYAE6OF01BXJSE.15.86.H09.1.454.CMB.1.raw
tcagtctacgtagccacgaccggtgctcgatttagtgctatagactttgggtttggggggagaggagccccagccttgggatccccaagttgttttcattcagtgatcaggactgaacacagaggactcaccagtggagttcgggctgagtcgttgggttttccttgctgactatacgttaaaaggtgtccgtagtgtagaagtgcgaggtgggtggaggtcggtgggggagtccgtttagggtaaacggccggttcgggggtcccgtttaaggcgttccttccgttggtcggtcggtccttcgtaggtactttcgtactttcgaaggttaagtggtcgtaggtagtcggttagggttcggggcccgaccgtacgggtccgtaccgggaagggggaacgggggtcgtggggtagggttggggttaacggttaaccggttttaaacggaaaaaaggttaaaaagtggtaacggttaagggtaaggtaaaagtaaaaacggtaggtaaccgttaacgggtaacggtaaccccggtaaacccggggtaaaaggtaaaacggtaaacgttaaacctttaacccgaaaccgtttaaactacccgttaaacggaaaaaggtaaaccgttaaagttaaaaaccgtttaaacccgggtaaaaaaccgggttacggtttaaggtttaaccgtttaaggtaaaaccttaaaaaggtaccgtaaaccgacggtaaacccgaaacgggtaaaaaccaccggggtaaacaacgggtaaccggttacccttaaaccgtttaacgttacccgttaaccgaaccgtaaaccgtaaggtaaccggtttacgaaggtaccgtaagaccgggtttaaccgggaaacgggttaaaacgggtcgttccttaaggtttatttcggttttaaacggacgtttccgttaccggggtacccgggtaaacccggaaacgggttaaacgtggtttacccgggg

SEQ ID NO: 113696 - DNA, 825 bp, Homo sapiens
  misc_feature: GYAE6OF01C0HC8.15.86.H09.1.454.CMB.1.raw
  modified_base (179)..(179): a, c, t, g, unknown or other
  misc_feature (179)..(179): n is a, c, g, or t
  modified_base (301)..(301): a, c, t, g, unknown or other
  misc_feature (301)..(301): n is a, c, g, or t
tcagtctacgtagccacgaccggtgctcgatttagtgctatagacttgggtttggggggagaggagccccagccttgggactccccaagtgttttcattcagtgatcaggactgaacacagagactcaccagtggagttcgggctggagctgggttttcctgctgctatacttaaaggntccagtgtgagtgcgaggtggtggagtcggtggggacgtccgttaggtaacggtcccggttcgggggtacccttaaggtacgtccttccgtggttgtcggccttctggtacttctaacgttntaacgttagtggcgtaggtagtggtaggttccgggtccgaccgaggcccgtacgggaagggggaacggggtctggggtacggtgggttacggtaacggtttaaacaaaaagttaaagtgaagtaggtacgaaaagtaaacgtagtaaccgtacggtacgacccgtaaacggtacggaaaagggtaactactaacccgactaacgttactaaccggaaataacggtaaacttaacgtaaaaccgtaaaaacccggtggtttaagtttagttaacggaaacttaaacggtaacgaaacgtaccggtaaccgtaaacggaaaacccgtacgaaccacggtaaccgtaccgttaattacgttaacaccgttaaccaacgtaaggttacggtaacgggtaatgaaccgtaagtaccggaaaacgggtaacggacgtaaccgttaaggttcgtttaacgtttacgggtaactttccgggttaaccggggtacgggaacccccggttaaagggtaacgttaaggttccggg

SEQ ID NO: 113697 - DNA, 757 bp, Homo sapiens
  misc_feature: GYAE6OF01CYYMJ.15.86.H09.1.454.CMB.1.raw
  modified_base (530)..(530): a, c, t, g, unknown or other
  misc_feature (530)..(530): n is a, c, g, or t
  modified_base (666)..(666): a, c, t, g, unknown or other
  misc_feature (666)..(666): n is a, c, g, or t
  modified_base (717)..(717): a, c, t, g, unknown or other
  misc_feature (717)..(717): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagctgggttttcctgctgcttatacgttaaaggtcgtcctagtgtagaagtgcgagggtgggtgggtaggtcggtgggggtacgtaccgttagggtaaacgtcccgggttggggggttaccccgttaggtacggtccgttccgttggttcggtcgggtccttccgtggtacttcctacttacgagtaagtcggtcgtggacgtggtaggttcggggccgtccgacggtccgtcggaaggggacggggtacgtgggtaggtgggttacgggtacgtttaaacgtaaaagtaaaagtgtaaggtggtaaggaagtaaaacgttaggtacgtacgggttacgaccgtaccggtaaggaaacggagtacgtacctaactactacganaacgtagtaactaactaacggtaaaacgtcggtttaatagtttacgaagtaaagtaacgaacggtaacaaccggtaaagaaaccggacgaaccacgtacgtaactacttagtacctacgtaccgtaatcgttaagngtaacgaggtctaacgacgtaacggtaggaggtacccttgtacttcggttntaattccggtacggtcgggtaccgaggtactagggtccgg

SEQ ID NO: 113698 - DNA, 652 bp, Homo sapiens
  misc_feature: GYAE6OF01BHDDH.15.86.H09.1.454.CMB.1.raw
  modified_base (388)..(388): a, c, t, g, unknown or other
  misc_feature (388)..(388): n is a, c, g, or t
  modified_base (577)..(577): a, c, t, g, unknown or other
  misc_feature (577)..(577): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgtagttcgggtccgccgaggctccgaggggaaggggcgtgggaggtgggttggacgtttacaaaagtaaatgagtggtagaagaaatagacgtacggngaccgaccgtagaaagagtatacactatctacgaagagaataatacgaaaacgtacggttgtaattgactaaagtcgaaacacgtaccgtaaggaaaaccgaggaccacgacggtcccgttactaagttacgacgtaacccagtacggtatttacgggaatgactacgtacggtaaacgggtaaagggngtcttaagtcgtttacgtttacgaattacggttcgggtaccgggggacccaaggggtaacttaacgggttccggg

SEQ ID NO: 113699 - DNA, 874 bp, Homo sapiens
  misc_feature: GYAE6OF01DY432.15.86.H09.1.454.CMB.1.raw
tcagtctacgtagccacgaccggtgctcgatttagtgctatagactttgggtttggggggggagaggagccccagccttgggactccccaagttgttttcattcagtgatcaggactgaacacagagactccaccatggagttcgggctgagtcgttgggttttccttgtctgtcttaattacgttaaaaggtcgtccgtaggttgttgaagtgtcgtagggtgggtaggtaggtcggtcggggggtagtaccgttaggggtaaacggtcccgggttcggggggttacccgttaggtacgtccgttccgttggttcggtcggtccgttacgtcggttacttttaccttaccgtttacgtaagttagtggtcgtagggtagttggttacgggttcggtccccgaccgtacggtcccgtaacggggacggggggaacgggttcgggaggggttaacgggtttggggttaacggttaaccgttttaaaaaggtaaaaaaggttaaaaagttggtaaaggttggtaaaacggtaaaagtaaaaggtaacgtaacggtaccggtacgtaaacccggtaaccggtaaaggtaaaggtaacgtaacgtaccgaactacgtacgtaagaagtaaataattaaaacgtaaccggtaaaacggttgttaatttacgtagaaacgtaaacgtacgaagtaaccgtaaccggtaaaccggaaacgtacggaactaacgtaccggttactacttaagtcctaacgtactaaagtcgttaagtacgggatagacgtagtacgggaaacgtaaggtcgtacgttaggttctttaagtcgtacgttacggttacccgggacgggttaaccgaacggtacgttggttccgg

SEQ ID NO: 113700 - DNA, 717 bp, Homo sapiens
  misc_feature: GYAE6OF01DD715.15.86.H09.1.454.CMB.1.raw
  modified_base (673)..(673): a, c, t, g, unknown or other
  misc_feature (673)..(673): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtctgcatctgtccttcgcgtagggacgcctcgatcaagcctcacctcgaccaaccgtaagtagtagagaccataccgaacctaccaacaagtacgtaagtaggtacacaacgaggaacgaaccgacgggtaaccctacccccgtaagtaataacttaaagtaagtaaaaggttaaggagtagacggtacggacgacgaccgtaaccgaaccggggaacgggggaaccggtacccgtaacccgtacgtaccgtccgttacgacggttccgggtccttaccggtacggttacggtcggggtacccgttaccggacccgttacccgttacccacccgtacctacctacccgtacccctaaccctaccgtaccgttactacggaacgtacgttaggacgtacgtagtacgttactcgtacgtggtacggaggacgacgacgaacctagtacgtagacgtacgaacgtagggtacgggttcgggtggtacgggnggaacgtacggacgtccggacgtacccgtcggtacgcgacccgg

SEQ ID NO: 113701 - DNA, 840 bp, Homo sapiens
  misc_feature: GYAE6OF01CMJPR.15.86.H09.1.454.CMB.1.raw
  modified_base (552)..(552): a, c, t, g, unknown or other
  misc_feature (552)..(552): n is a, c, g, or t
  modified_base (827)..(827): a, c, t, g, unknown or other
  misc_feature (827)..(827): n is a, c, g, or t
tcagtctacgtagccacgaccggtgctcgatttagtgctatagacttggggtttggggggggagagggagccccagccttgggatccccaagtgttttcattcagtgatcaggactgaacacagaggactcaccatggagttcgggctgagtcgttgggttttccttgctgcttatacgttaaaaggtgtcagtgtagaagtgcgtaggtggtggaggtcggtgggggacgtccggttagggtaaaacggtcccgggttacgggggggttcccttaaggtacgtttcctccgttggtcggtcggtccgttcgtggtactttccgtactttcgaaggttaacgtggtacgttggtacgttggtacgggttcggggtccgccgacggtcggtaccgggtaaggggagggggcgtgggtagggttggggttaggtaacgtttaagaaaagtaaaagtggtagtaggtaagaagtaaaagtaggtaccgttacggcgtaaccgtaacggaacggaaaggtaatacgtaaccaactactacgtaacgtaaaggtaanaaacgttaacgtaaaccgtaaacgggtgtttaagttaccgttagaaactaaagtaggaaaccctacgtaaccgggtaaacggaaaaccgtacaaaccgacgtaccgttaaccggttaacctttaagttaccccgaacggtaaccctaaggtaaacgggttagttaacccgggaagtacggaaacgttacggtaaacggtaaaggacgggtaacttgttacggtagtttcgttttagaagttcccgggttaggtaccccggggagaaaccggggtntcggggttaccgg

SEQ ID NO: 113702 - DNA, 655 bp, Homo sapiens
  misc_feature: GYAE6OF01EM5NM.15.86.H09.1.454.CMB.1.raw
  modified_base (216)..(216): a, c, t, g, unknown or other
  misc_feature (216)..(216): n is a, c, g, or t
  modified_base (305)..(305): a, c, t, g, unknown or other
  misc_feature (305)..(305): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggganccttggtaaagccgtggggggtcccttagacgtctcctgtgtggccctgtggattcactttcagtaatggctggatgagttggccgcgngctccgagggagggcgtggagtgggtggacgtttacaaaagtaaaatgataggtagaagaaaatagactacggtgacaccgtagaaagaacgtatacgcatctacaaagactaataacttacgaaaaacgtcggtataagtttgaactaaatagaaactagacccgtaagaaaacccggtagaacgacacgacccgttacgtaacttacgtacgtacccaacgtagtattacgggaaacgtgtaccaagtaccggaaacggtaaagggacggtacttaaggttgtccgttttaagacgttaaacgtccggttaacggggaccccttaaggggacctaaagggttaccggg

SEQ ID NO: 113703 - DNA, 756 bp, Homo sapiens
  misc_feature: GYAE6OF01B9U5I.15.86.H09.1.454.CMB.1.raw
  modified_base (714)..(714): a, c, t, g, unknown or other
  misc_feature (714)..(714): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatcttaaaaggtgtccagtgtgaagtgcgaggtgggtggagtcgtgggggagtccgttaggtaaagccgttgggggtcccttaggagtctcctgtgtcggcctctggtacttcactttcaagtaagtcggcgtggactggtaggttcggggtcccgccgacggcgtacccggagggggaacggggtcgtaggggaggttggggttaggtacggtttaacgaaaaagttaaaaagtgtaagtaggtagaaagtaaaagtaggaacgtacgggtagacgtaacccggtaaggaaacggaaagtacttaaccgaactacgttacgtacgaaagaagtaaacttaacgttaaaccgaaaaacgtcgggttagttaagtttacgaacgtaaacgtagaaacgtaccggactaaacggaaaaccgtacgaaccgaagaccgttaccgtaacttacgtttaaccgtacgtaaaccctaagtacgttagttaaccgggagttcgaactaacggttaccggaaacggtaaggacgtccgttaagtcgttacgtttanaacgttcgtacgcggggtaaccgtagggtagtaacgttcggg

SEQ ID NO: 113704 - DNA, 1198 bp, Homo sapiens
  misc_feature: GYAE6OF01DUSFB.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcggctgagctgggttttccttgctgctatacgttaaaaggtcgtccagtgtagaagtgcagggtggtggagtcgtgggggagtccgttaggtaaacggcccggttacgggggggtcccctttaaggacgttcccgttcccgttaggttcggttcgggtcccttcggttcggtaactttccgttaaccttttaccgtaaaggttaaagttcggggtaccgttaggggtaagtttagggttaaacgggtttccggggggttaaccccggacccccggttaaagggggtacccctttaccccgggggaaacgggggggtaaaacgggggggtccggttaggggggtaacgggttttagggggggtttttacgggggtaaaacccggtttttaaaccggaaaaaaaaaagggttttaaaaaacgttgggttaaaccgttacgggggttaaagaaaaaacggttaaaaaaggttaaccgggtaaaccggtttaaccggggttaccgtaaccccggttaaaacccccggggttaaagggtaaaaacggggttaaacgtaaaaccggttttacccgtaaaccccgtaaacgttttacccgttaaaccggaaaacgggtaaaacggttaaaacgttttaaaaaccgttaaaaccgggtaaaaaaaaccccgggttccggggttttaaagttttaacggtttttaaacgaaacccgttaaaaaagttacccggggtaaaaacctacgggttaacccccggttaaaaacgggaaaaacccccggggtaaacgggtaaaccctaacccggtaaacggttaccccccggtttaaacgttttaacgttaaaccccgtttacgggttaaaacccccgtaaaccgtaacgggttaacgtttaaccggggtaaaggttccgtaaacggtaacccgttaaccggggaaaaccgggtttaaaagggaccccgggttaaacgttaagttcccggttttagttttaaacggtactttaaccgggttcccgggttaaccccgggggacccggttaaacggggtaccgtaaaccggggtttta

SEQ ID NO: 113705 - DNA, 787 bp, Homo sapiens
  misc_feature: GYAE6OF01CXZJ6.15.86.H09.1.454.CMB.1.raw
tcagtctacgtagccacgaccggtgctcgatttagtgctatagacttggggtttggggggggagaggagccccagccttgggactccccaagtgttttcattcagtgatcaggactgaacacagaggactcaccatggagttcgggctgagtcgttgggttttcctgctgctatacgttaaaggtgtcagtgtagagtgcgagggtggtggaggtcggtagggggtacgtaccgttaggggtaaacgtccgggttcggggggtcccttaggtacgttccttcgtggttgtccggccttcgtggacttctaccttagtaagtagtcgcgtaggtagtggtacggttccgggaccgccgtacggccgtaccgggaggggaacggggtcgtaggggtggttagggttcggttaaaccgtttaaagaaaaaggttaaaagtgtaagtagggtaagaaaagtaaataggaccgttacgggacgaacggtaacggaaggaaacggtaaagtacgtacccgtaaacgtacttacgaagtaaaggtaactaaattaacgtaaaccgaaaggttaacggttatttaacgttaggaaacctaaagtaacgaaacgtaacgtaccgtaaaacggaaacggtacgaccaacggtccgtaactacttaaataaccgtactaaccaacggtaacggtaccgttaacgggatacgactacggtaacggaaacgggtaaagtcggtattagttagttacgttagtagtaccggtcgggacccgaggacggtaagtcggttcgg

SEQ ID NO: 113706 - DNA, 737 bp, Homo sapiens
  misc_feature: GYAE6OF01DLPSO.15.86.H09.1.454.CMB.1.raw
  modified_base (678)..(678): a, c, t, g, unknown or other
  misc_feature (678)..(678): n is a, c, g, or t
  modified_base (693)..(693): a, c, t, g, unknown or other
  misc_feature (693)..(693): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagtcttgggttttccttgctgctatacttaaaggtgtccagtgtgaagtgcgtaggtggtggagtcggtgggggactcggttaggtaacgtccgggttcgggggttcccttaaggtcgttccttccgttggttcggtcggcccgtcgtaggtattaccttactttcgaagttagtggtcgtggtagtacggtaggttcgggtcccgcgaacggtccgtacggaagggggtacggtcggagggtagggttgggttaacggtacgttaaacgtaaaaggtaaataggtagtaggtaagaaacgtaaaagtagtaacggtacggtacgaaccgtaccggtaaggaacggaatcaccaactataacgacgaaagacgtaattaaacaacggtaaaacgtagttacgtattacgaactaaagacgaactacgtaaccgaacggtaaaccgacgaccgtaacgtaccgcttaacctagttaacctacgtaacagtacgtaacgtacgtactgtaacgagttaaccggaaggtaacgngttactagtacgttnttagaacgttacgtcggggtaccggacgaaggtcgtagttcggg

SEQ ID NO: 113707 - DNA, 1017 bp, Homo sapiens
  misc_feature: GYAE6OF01AVMY4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcttgggttttccttgctgctatacttaaaaggtgtccagtgtagaagtgcgaggtggtggagtcggtgggggacgtccgttagggtaaacgtccggtgggggtcccttaggacgttctccgtggtgtcggtcctcgtggtacttctactttcgaagttaatggtctaggtacgttaggtacggtttggggttccccgaccgtacgggtccgtacccggaaggggggtaacggggggtccgttaaggggtacggggttggggggttttaacgggtaaccggtttttaaacgaaaaaaagggtttaaaaaagtgggtaaagtttggggtaaaggaaaaggtaaaaaagttagggtaacccgttaacgggtacggtaacccgaaaccccggggttaaaggaaaaacggggtaacgtaacgttaccgaaaccgttacgtaacctaacggaaaaggtaaacgtaaacgtttaaaacgttaaacccggaaaaaacggggttaccgggtttaagtttaacgttttaacggaaaaccttaaaaaacggttaacgggtaaaacccgtaaacggtaaacccccggttaaaacgggaaaaaacccgggtaacgggtaaacccctaaccggtaaacccgggttaaccccgtttaaaccgttaaaccttttaacccgtaaaccggttaaaccccaaacgttaacggtaaacggttttaacgggaacggttaccaccggtaaacgttaaccgggaaacgggtaaaaacgggtacgttaacggttacgttaccggtttaccgttttaaggaacgtttaccgggttaaccgggttacccggggaacccggttaaaggggtaacccgttaagggttaccccgggg

SEQ ID NO: 113708 - DNA, 727 bp, Homo sapiens
  misc_feature: GYAE6OF01BLNX4.15.86.H09.1.454.CMB.1.raw
  modified_base (268)..(268): a, c, t, g, unknown or other
  misc_feature (268)..(268): n is a, c, g, or t
  modified_base (558)..(558): a, c, t, g, unknown or other
  misc_feature (558)..(558): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggnttcactttcagtaatggctggatgtaggttgggtacccgccgaggctccgaggggaaggggcgtgggaggtggggttggacgtttacgaaaagttaaaagtgagtagggtagaagaaaactaggaactacggtgaccgtaaccccggtagaaaacgggaagatttaccgacctatctacgaaacgagaactaaagttaacgaaaaacggtacggttagttaagtttacgaactaaaagtgaaaccgagtacccgtacgaaaaaccggacggtaacacgaccgacccgttnttaacgttctacgtaacccaacgtacggtacttacgggaagtacgaccaacggttaccggaaacgggtaaaacggagggtacccttaaggttcggttaccgtttttggaaatttacggttccggtaccggggggtaaccccacgggggaacttaaaggtttcccggggg

SEQ ID NO: 113709 - DNA, 855 bp, Homo sapiens
  misc_feature: GYAE6OF01EKXTI.15.86.H09.1.454.CMB.1.raw
  modified_base (685)..(685): a, c, t, g, unknown or other
  misc_feature (685)..(685): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctggagcgttgggttttccttgctgctatacttaaaaggtgtccagtgtgaagtgcgaggtgggtggagtcggtgggggagtccgttagggtaaacgtccggttcggggggttccccgttaaggtacgttcctccgtggttggtcggtcccttcgtggtacttccttactttcaagtaagtggcgtaggagttggtaggttcggggtcccgaccggacggtccgtaccggaagggggaacggggtcggtggggtaggggtttgggggttacgggtaaacggtttaacgaaaaaaggttaaaaagttggtaagtagggtaagtaaaagtaaaaagtacggtaacgttaacgggtacgaccgtaacccggtaaggaaaacggtaagtaacgttaccaactatacctaagaagtaaagtaattaaacgtaaaccgaaaaacgggttacgttaaggtttaactttaaggaacgtaaaaagtcgaaaccgtacggaacccgttaaaccgggaaaaacgtacgggaaacctaccgtacggtaacccttnttaaacgttaaccgtacggtaacccagttacggttaacgttaccggaaggtacgtaccgtaacgtaacgggtaaacgaaaaaggggtcgtacgtttaagtttgttccgttttaagtagttaaccgttccgggggaccggggtaccgaaacggggtactaaggttcccggg

SEQ ID NO: 113710 - DNA, 818 bp, Homo sapiens
  misc_feature: GYAE6OF01DF7XL.15.86.H09.1.454.CMB.1.raw
  modified_base (218)..(218): a, c, t, g, unknown or other
  misc_feature (218)..(218): n is a, c, g, or t
  modified_base (807)..(807): a, c, t, g, unknown or other
  misc_feature (807)..(807): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctagtcttaaaaggtgtccagtgtgaagtgcaggtggtggagtcgtggggganccgttggtaagccgtgggggtcccttagagtctccgtgtgtggtcctcgtggattcgtacttcaagtaagtggctggatggtaggttcggtccgccgacggctccgaggggaacggggcgtgggaggtgggttcggtacgtttacgaaaagtaaaactgtagtaggtagaaacgaaaagtagacgtacggtacgaccgtaacccggtaaggaaacgggaaagtacttaccgaaccctagttaccctaacgtaaaacggacgtaaaacgtttaaacgtttaaaacccgtaaaaaaaaccggggttacccgggtttaaaggtttaaacgtttttaacggtaaacgttaaaaacgttaaacggaaaaccgtaacggtaaccccgttaaacgggaaaaaaaccccgggacgggtaaaccgaaccgaacggttaccccgttactttaacgtttaaacccgttaacgttaaccccaacgtaacgtacgttaaccgggtaaggtcaacgtaacgtaaccgggtaaaacggtaagggacggtaccttaagtcggttactttacgtattacgttccgggtacgggcccgtaaacgggntaacggtcggg

SEQ ID NO: 113711 - DNA, 700 bp, Homo sapiens
  misc_feature: GYAE6OF01EIG3J.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtgggtggaggtcgtggggggagtccgttgggtaaaagccggttgggggggttccccttaaggagttcctcccgttggtggtcgggcccttcgtggtatttcctacttttcaagttaatggctggatggtaggttcgggtcccgccgaggcctccggaggggaaggggcgtgggaggttggggttggtacgtttaagaaaagtaaaatgatggtagaagtaaaatagacgtacggtgacgaccgtaggaaagagattacactatctacaagtagtaataacgttaacgaaaaacggtcggttagttaatttagactaaaagtcgaaactacggtaccgtaaacggaaaaccgacggaacacgtacgtacccgttattaacttacgtactacccaagtagtagttacggagtcgactagtaccgtaaacggtaaaggacggtacttagtgttcgtttagacttacgttcggtaccggggaccgaagggtacgtaggttccggg

SEQ ID NO: 113712 - DNA, 707 bp, Homo sapiens
  misc_feature: GYAE6OF01BZP11.15.86.H09.1.454.CMB.1.raw
tcagtctacgtagccacgaccggtgctcgatttagtgctatagacttgggtttgggggggagaggagccccagccttgggatccccaagtgttttcattcggtgatcaggtctgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctccgtgtgtcggcctcgtggattcactttcagtaatggctggatgagttggccgcgaggctcgaggggagggcgtgggaggtgggttaggacgtttagaaaaagtaaaatgagtggtagaagaaaatagacgtacggtgaccgaccggtagaaaggagacttcaaccatactacgaaagagtaattaacttaacaaaacggtcggttagttaatttacgaactaaaagtagaaacctaacggtacccgtaaagggaaaaacccgtaggaaacctaacgaacggtacccgttaacttaacgttaaccgtcgtaaccctaacgtaacggtaacgttaaccgggaagttcgactaacgtacggtaaacgtaaacgggacgtacgttagttcgttacgttttaggaacttacggttcggtaccggggacccaaggggtaactacgggttcgggttacccgg

SEQ ID NO: 113713 - DNA, 721 bp, Homo sapiens
  misc_feature: GYAE6OF01A9PUZ.15.86.H09.1.454.CMB.1.raw
  modified_base (417)..(417): a, c, t, g, unknown or other
  misc_feature (417)..(417): n is a, c, g, or t
  modified_base (455)..(455): a, c, t, g, unknown or other
  misc_feature (455)..(455): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgagggtggtggaggtcgtgggggagccgttaggtaaagccgtgggggtcccttagagtctcctgtgtcggcctcgtggtattcctactttcagtaatggcgtggatggtaggttcgggtccgccgaggcgtccggaggggaaggggtcgtgggaggttggggttggtacggtttaacgaaaaagtaaaagtgagtaggtaagaagtaaaagtagacgtacgngaccgtaccggtaagaacgaagtactacaccatactanaagtacgtaattaattaacgaaaacggtacggttatttacgttagaaagtaaatagaaacgaccgtaccgtaaaggaaaaccgaggaacccaacgtacgtaccccgtttaagttaactttaaccgacgttaacccaagtaaggttaacgttacgggaagttaccgactaagtaacggaaacggttaaaagggcgttaacgttaagttgttacgttttagacttacgttccgggcggggaacccgaagggtaacctagggttccggg

SEQ ID NO: 113714 - DNA, 706 bp, Homo sapiens
  misc_feature: GYAE6OF01A8S29.15.86.H09.1.454.CMB.1.raw
  modified_base (186)..(186): a, c, t, g, unknown or other
  misc_feature (186)..(186): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtntgcatctgccttgcgtgggacgcctcgatacaagcctccacctgaccctaacccgtaagtaggtgacgtacaactacccgaaacctaccaaccagtacgtaagtggtaactaccaaacacggaacgaaccgaacgggtaaccccgtacccccgaagttaactaataaagtaagtaaaaggttaagtagtagagtgacacgaccgaacgaaccgggaacggggacggaccgtacccgactcgtctcgacgtcggtcctcgtaggtcgtcggcgtcgacctcctaccgtccactactaccctacctacccgtaccgtacgtactacgtacgtacgtacggacgtacgtaggtacgtactaccgtaggttggaacgggaaggtaccggaacgacccaagtaacgtagtacggacgtaccggaccggtaagggttaccgggttggggtacggttacggggacggggtaaccggaaccggtacggtaccggtacgacccggttacgtacggttacccgaaccggg

SEQ ID NO: 113715 - DNA, 793 bp, Homo sapiens
  misc_feature: GYAE6OF01ENEF4.15.86.H09.1.454.CMB.1.raw
  modified_base (765)..(765): a, c, t, g, unknown or other
  misc_feature (765)..(765): n is a, c, g, or t
  modified_base (787)..(787): a, c, t, g, unknown or other
  misc_feature (787)..(787): n is a, c, g, or t
tcagtctacgtagccacgaccggtgctcgattttagtgctatagacttggggtttggggggggagaggagccccagccttgggactcccccaagttgttttcattcagtgatcaggactgaacacagaggactcaccatggagttcgggctgagcggttcggtttcgtgacgtcgctaatacgtaaagtgtcagtgtgaagtgcgaggtgggtggagtcggtgggggacgtaccgtttagggaaacggtccggttggggggttaccctttaggacgttcctccgtggtggtcggcctacgtggatttctacgtttacaagttaatcgggctagggaattggtaacggtttcggggtaccacccgtaaggggtcctaccggggaaagggggaaccgggggtggtggggtaagggtttcgggggttaggttaaccgtttaaacgaaaaaaaggtttaaaagtgaacggttaggttaagaaaagtaaaaagtaggtaaccgttaaggctacccggaaccggtaagaaaagggaataacttcgaaccctagttacccgaaggaaagtaagtaaacttaaacgttaaaacgaaaaaccggttacgggtttaagtttaagtttacgtaaaactaaaggtaacaaaccgaacgtaacctaaacgggaaaacgacggaactacgacgtacctattaacgtactacgtaacaccgagttacgtaacgtagacgtagacgtaacggaaacgtaaggccgtattcggtattacgtnatgtcggtacggacgacggagnggtacg

SEQ ID NO: 113716 - DNA, 842 bp, Homo sapiens
  misc_feature: GYAE6OF01DDYK0.15.86.H09.1.454.CMB.1.raw
  modified_base (709)..(709): a, c, t, g, unknown or other
  misc_feature (709)..(709): n is a, c, g, or t
tcagtctacgtagccacgaccggtgctcgatttagtgctatagacttggggtttggggggagaggagccccagccttgggactccccaagttgttttcattcagtgatcagactgaacacaggagactcaccagtggagttcgggctgacgtcgttgggtttcctgctgctatacgttaaagcgtacagtgtagagtgcgtaggtgggtaggtaggtccgggtaggggacgtccgtagggtaaacggtccgggttcggggtacccttaggcgtcctcgtggtgtccggtcctcgtggtacttcttacgtttaacgagtaacgtcggtagtggtatggtagggttccggtcgaccgtgcggtacgggaaggggtacggtcgtgggtaggttgggtacggttaacggtaaaactaaaaaggtaagtaggaggttagggaagtaaaacgtaagtacgtaagtaccggtaccggaacgtaacccgggaaagtaaagtacgtaacctaacgacctaataccgggaactaaaagggtaaactaagtttaaaacgaaaccggtaaagtttccggtaagtttacgtaacgtaaagtaaacgttaccggaacaacggttaaacccgaaaggtaaaaccccgtaagggaaaccaacccgtagtacccgtttaaccgtaacgtttccgaaaccctaaggtaacctaaagttaacccgggngttaaaccggtacaggttaaaccggaggtaaacgggaaacgtaggtccttaagttacctttgttcccggaaagttccggggttaacgggccccgggtaaaacggtcgggttaaaccggtgttttaccccgggg

SEQ ID NO: 113717 - DNA, 889 bp, Homo sapiens
  misc_feature: GYAE6OF01BNCSS.15.86.H09.1.454.CMB.1.raw
  modified_base (213)..(213): a, c, t, g, unknown or other
  misc_feature (213)..(213): n is a, c, g, or t
  modified_base (802)..(802): a, c, t, g, unknown or other
  misc_feature (802)..(802): n is a, c, g, or t
  modified_base (853)..(853): a, c, t, g, unknown or other
  misc_feature (853)..(853): n is a, c, g, or t
tcagtctacgtagccacgaccggtgctcgatttagtgctatagacttgggtttgggggggagaggagccccagccttgggatccccaagtgttttcattcagtgatcgaggactgaacacagaggactcaccatggagttcgggctgagcttgggttttccttgctgctatacgttaaaggtgtccagtgtagaatgacgagggtgggtaggngttcggtagggggacgtccgtttagggtaaacggtccggttcggggggttacccttaggcgttcctccgtggtgtcggtcctcgtggtactttcctacttttacgagtaacgtggtacgtagggtagttaggtacgggtttacggggtccccgaccggtacgggtccgtacccgggaagggggtaaacgggggtccggttaggggttacggggtttacgggggtttacgggtttaaacccggttttaaaaggtaaaaaaaggttaaaacggtaggtaaggtttacgggtaaagtaaaaaggtaaaacgttaacggaaccgttaacgggtaccgaacccggtaaacccggttaaagggaaaaccggtaacgttacttaaccccgaaccgttaaccgtaccgtaaacggaaacgtagttaaaaccgtttaaacgttaaaaccgggaaaaccgttcgggttttaagtttaacgttaacggaaattaaaacgtcgaaacgtaccggtaacccgtaaggaaaccgtccgaacaccggtaccgtacgttaccgttaatttcccgaatacccgtaactaaggttccgtaaacgggnttacgactaggtacggaaacggttaaacgcgtacttcgggtatttcgttancgttacgtcggacgggtaccgaagtcgtaaggtcgg

SEQ ID NO: 113718 - DNA, 679 bp, Homo sapiens
  misc_feature: GYAE6OF01BHVBR.15.86.H09.1.454.CMB.1.raw
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (228)..(228): a, c, t, g, unknown or other
  misc_feature (228)..(228): n is a, c, g, or t
  modified_base (256)..(256): a, c, t, g, unknown or other
  misc_feature (256)..(256): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtcgttggcaaggcgctatagtagntcngtgagactgcgtagtgagtgtgtggatctaggaacgtcgttgggctaagngtctctgtcgagccatgtctagtcttanagtagtcgtagtagtagtcgtacggtcggtccgacgtacggtacgacggacgggtacggtacggtcggtaggtacggtacggtacgtaacgtaaagtaagtagtagtagtagtaagtaagtacgtacgtacgtacgtacgtacgtaaggaagtacgtacgtacgtacgtactaacgtacgtaagtacgtaacgtaacgtaacgtaacggttacggttagtagtaacgtaacgtaacgtaacgtaacgaacgtaacgtaacgaacgaacgtaacgtacgtacgtacgtacgttacgtacgtaacgtacgtacgtacgtacgtacgtacgtacgtaacgtagtaacggtaacggtaaggtaacggtacgttagttaggttacgtagtagtacggtacgtacggtacggtacggtacgtcggtacg

SEQ ID NO: 113719 - DNA, 709 bp, Homo sapiens
  misc_feature: GYAE6OF01D7IP0.15.86.H09.1.454.CMB.1.raw
  modified_base (271)..(271): a, c, t, g, unknown or other
  misc_feature (271)..(271): n is a, c, g, or t
  modified_base (657)..(657): a, c, t, g, unknown or other
  misc_feature (657)..(657): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctggagcttgggttttccttgctgctatcttaaaagtgtccagtgtgaagtgcaggtggtggagtcgtgggggagtccgttaggtaaacgccgtggggggtcccttaggagtctccgtgtgtcggcctntggattcactttcaagttaatggctggatggtagttcggtccgcgaggcctccgaggggaacgggcgtggggaggttggggttggtaacgtttaacgaaaaaaggttaaaatgaagttagggtagaaacgaaaataggaactacggtgaccaaccgtaggaaagaatatacacatacgacaaagagtaaactaaagttaacgaaaaacggtcggttaagttaacgtttagaaactaaagtaacgaaacctacgaaccgttaaaggaaaacccggtacgaaccgaaccgtacgtacccgttacttaacgttacctaacgtaaccaacgtagtaacgttacggtagtacgataacgtaggaaacggtaaagggcgtacgtaattgttnttttaagattaccggttcggacggggacccgtaagggacgtaggttaccggg

SEQ ID NO: 113720 - DNA, 951 bp, Homo sapiens
  misc_feature: GYAE6OF01B057Z.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaccccggactcaccatggagttcgggctgagctgggttttccttgctgctatacttaaaggtgtcagtgtgaagtgcgaggtggtggagtcggtgggggacgtccgttagggtaaacggtccggttcggggggtcccctttaggacgttccgtccgttggtggtcggtccctcgtggtactttctacgtttacgtaaggttaagtcggtcgtggtaagttggtacgggttccgggtcccggaccgtacgggtcccgtacccgggaagggggaacggggtcggtaggggtagggttcggggttacggttaacggtttaaacgaaaaaaggttaaaagtaggtaaggtagggtaagaaaagtaaaacgtacggtaaccggttacgggtacgtaacccggtaaacccggtaaaggaaagggtaaacgtactttaacccgaacccgttacgtaaccgtaacgtaaaacggtaacgttaaaacgtttaaaacgtttaaaaccggtaaaaaaccgggttacggtttaagtttaacgttttaacgaaacccgtaaaagttaacggaaaaccgtaaccggtaacccgtaaacgggaaaaacccgggacggtaaacccgaaccgtacccggttacccgtttaacgtttaaccgttaccgttaacgtaacccgtaacgtaacggttaaccgttacggtaacgtacgtaacgtaacggttaaccgggtaaacgtaaaagggtcggttaacttacgttacggtttaacgtttacgtaaacgtttaccggttaccgggtaaccgggggaccccggttaacgggtaacgtacgggtttacccggg

SEQ ID NO: 113721 - DNA, 743 bp, Homo sapiens
  misc_feature: GYAE6OF01BUXGZ.15.86.H09.1.454.CMB.1.raw
  modified_base (527)..(527): a, c, t, g, unknown or other
  misc_feature (527)..(527): n is a, c, g, or t
tcagtctacgtagccacgaccggtgctcgatttagtgctatagacttgggtttgggggggagaggagccccagccttgggatccccaagtgttttcattcagtgatcgaggactgaacacagacgactcaccagtggagttcgggctgagtcgttgggttttcctgctgtctatacgttaaaggtgtccgagtgtgaagtgcgtaggtggtggagtcggtggggatcgttaggaacgtccggtggggtcctagctctcgtgtgtcgctgtgtattctacttacgaagttagtggtcgtaggtacgtaggttaggtccggtaccgcgtaacggtccgtaccgggaaggggtacgggtcgtagggtagggttcggttacggtacgtttaaacgaaaagtaacgtgacgtaggtaagaaagtaatcggtaacgtacggacgtacgtaaccggtaagaacgtacgtactaccgaactagtaccgaagtaataagttaactaacgtaaaccggaaggtcgtttatacggtanaactaaagtcgaaaccacggttaccgaaaggtaacgacgtaccacgttcccggtaactttacgttaacgtaccgtaacgtacccaaagggttcgaccggtaaggtctacgtaacgaacggtttaaccgaaaacggggttagcggttaagttaacgttgttaacgtttacgacgttcggggtaccgtacgggaccgtaagttaccgtccgggttcgg

SEQ ID NO: 113722 - DNA, 834 bp, Homo sapiens
  misc_feature: GYAE6OF01EY4H8.15.86.H09.1.454.CMB.1.raw
tcagtctacgtagccacgaccggtgctcgatttagtgctatagacttgggtttgggggggagaggagcccccagccttgggatccccaagttgttttcattcagtgatcaggactgaacacagagactcaccatggagttcgggctgagtcgttgggttttccttgctgtctatacgttaaaaggtgtccagtgtagaagtgcgagggtggtggaggtcggtgggggtacgtccggttagggtaaacgccgggttcggggggttcccttaggtacgttcctccgtggttgtcggtccgtcgtcggtatttctacgtttacgaagtaagtggtcgtaggagttgggtacggttccgggtacccgaccggacggtaccgtaccggggaaggggtacgggggtcggtaggggtacggggtttagggggttacggtaaccggtttaaaacgtaaaaaaggttaaaagtaggtaacggtagggtaaacgtaaagaaaaggtacgtaacggtaaccggtagtaacccgaccggtaaaggaaacggtaacgtaacgttaccaccgtaataccgtaaagaacgtaactaaattaaacgtaacgtaaaaccgttacggttagttagttaacgaaactaagtaacgaataccgaacgtaaaccggaaacggtaacgaccgagtaccgtaccgttactaacgttccgtaacgtaaccgtaacgtagtaacgttacgggtaagacgtacaacggtaccgtaaaggggtaacgtacgttacgtagttcgttagtttaccgtaagttaccgtaccgggcggtaaccggaccggtaggtaacgttcggg

SEQ ID NO: 113723 - DNA, 877 bp, Homo sapiens
  misc_feature: GYAE6OF01B3OZ8.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttggtaaagccgtggggggtcccttaggagtctccgtgtggtggcctctggatttcactttcagtaatggctggatggaggttcgggtccgcgtacggccgtaccggaggggaacggggtcgtagggtaggttgggttaggtaacgtttaacgaaaaagtaaaatgagtggtagaaagaaaagtagaacgtaacggtcgaccgaacccggtaaggaaaaggaagtacgttaccaacctatacctacaaagagtaaattaaacgttaaccgaaaaacggttacggttaagtttaagtttaggaacctaaaagtaacgaaacccgtaagtaaccccgtaaagggaaaaacccggaggtaaaccaaccggtaacggtaccccgttaacgttaacgttttaacccgtaacgttaaacccccgtaaacggtaacggttaaacggtttaaaccgggaaaacggtttcggaaaccgtaaaccggttaaacccgggtaaaaacggggtttaaaaacggggtaccgggtttaaactaaacggttttaccgggttaacggttttttttaacgggaagttttaaacccgggttacccggggttaacccgggggggttaaccccccggaaaacgggggtaaaacccgtttaaacgggtttaccccggggg

SEQ ID NO: 113724 - DNA, 814 bp, Homo sapiens
  misc_feature: GYAE6OF01D7S9D.15.86.H09.1.454.CMB.1.raw
  modified_base (720)..(720): a, c, t, g, unknown or other
  misc_feature (720)..(720): n is a, c, g, or t
  modified_base (770)..(770): a, c, t, g, unknown or other
  misc_feature (770)..(770): n is a, c, g, or t
  modified_base (792)..(792): a, c, t, g, unknown or other
  misc_feature (792)..(792): n is a, c, g, or t
tcagtctacgtagccacgaccggtgctcgatttagtgctatagacttggggtttggggggagaggagccccagccttgggatccccaagtgtttcattcagtgatcaggactgaacacagaggactcaccatggagttcgggctgagcgttgggtttcctgctgctatacgttaaaggtcgtacgagtggtagtaagtggacgagggtgggtgggtagtcggtgggggtacgtccgttaggaacggtccgttcggggggtccttaaggcgttccgttccgtggttggtcggtccgtcgtggtacttcctacgtttacagttaagtcgtgtaggtagttaggttagggttcggggtcccgccgacggtccgaccgggaaggggggacgggtcggtaggggtagggttcggggttacggttaacggtttaaacgtaaaaaagggttaaaagttacggaaggttaaggtaaccggtaaaaggtaaaaacgtaaggtaaccggtaacggtaccgtaacccggtaaaccggtaaaggaaaacggtaaacgtactttaccaacgtacttactaacggaaagtaacttaacgtaaacttaaaccgaaaaccggttaggttaactaaggtttacgaaagtaactaaggaacctaacgaacctaaaggaaaccgtacgacctaacgcggttaacctacgttactcgaacttaccgacgataacggttancggatacgacggttaggaaagtaaggtgaccgttgttaacttcgtttaancgttaacgggcggttaaccggngggacgtaacggtcggttcggg

SEQ ID NO: 113725 - DNA, 472 bp, Homo sapiens
  misc_feature: GYAE6OF01CPBTJ.15.86.H09.1.454.CMB.1.raw
  modified_base (185)..(185): a, c, t, g, unknown or other
  misc_feature (185)..(185): n is a, c, g, or t
  modified_base (447)..(472): a, c, t, g, unknown or other
  misc_feature (447)..(472): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgccctcgtcatcaccgcctcagccttgtacttttccggatttgcctaggaaaaccngcctacacgacttaaaccgggacaacccgtccgcccggccaacatacgccttcctcccgtccccccttgaccagtaaccaaccaagtaccaaggtaatattaacctgttcccatcgaacctacgtcctttcggccttcgccttaggggcctaacctccacccctcgcccccgaatttaaaccggtgggaaccacggtaaaccccgtttgggtaccctttccgggcgaggccggggtctaggccaaagggccggacattacgnnnnnnnnnnnnnnnnnnnnnnnnnn

SEQ ID NO: 113726 - DNA, 727 bp, Homo sapiens
  misc_feature: GYAE6OF01CYE8Q.15.86.H09.1.454.CMB.1.raw
tcagtctacgtagccacgaccggtgctcgatttagtgctatagacttgggtttggggggagaggagccccagccttgggatccccaagtgttttcattcagtgattcaggactgaacacagaggactcaccatggagttcgggctggagcgttgggttttccttgctgctatacttaaaaggtgtccagtgtgaagtgcgagggtggtggaggtcggtgggggacgtccggttagggtaaacggtcccggttcggggggtacccttaggacgttccgtccgtgtgtcggtccttcgtggtactttctaccgttttagaagttaagtggtcgtggtatggtacggttcgggtcccgaccaaggtccgtaccgggaagggggaacgggtcgtagggtacggttgggttacggtaacgttaaagaaaaagtaaaagtgagtaggtaacgaagtaaatagacgtaggcgacgaccgtaagaaagatactacactatactagaagtaataattaacgtaaacgaaacggtggttattagttacaactaaagtcgaaaccgagtacccgaaacggaaaaacgcgtaaacacgtacgtacgtactaagttccagtacaatagtagtacgagtcagacgtaacgaaacggtagacgttacgtagttacgttacgttttagaagtttacccgtacggggacccggggacccgtaagggtaaaccgtgggttcccgg

SEQ ID NO: 113727 - DNA, 933 bp, Homo sapiens
  misc_feature: GYAE6OF01CHS9J.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagacctcaccatggagttcgggctggagcttgggttttcctgctgctatacttaaaaggtgtccagtgtgaagtgcgtaggtggtggagtcgtgggggatccgttaggtaacgccggtcgggggtcccttagacgtcctcgtgtgtcgtcctcgtggattctactttcagtaagtcggtcgtggtagtggtacggttccgggtccgccgacggtccgtacccgggaaggggggaacggggtccgtaggggacgggttcggggtaccggacccctaaacgtaacgtaaaaaccggtaaaaaagggtacgttaaacggggtaaacgtacggtaaacccgtaaacccgttaaacccggttagttaaccgggttaacggttaaaacccgtttcccggttagggttaccgggtaaacggttaccggggtacccgttaacccgtttaccccggaacccggtttccccgtaaacccggtaacgggaaccgggttaaccccgaacccgtaaacccgtaaacggtaaccccttaccgtaaaccgtaaacgtacccttacgtaacgaacccgtaaaagttaccgaaaaccgtaccggtaacgaaccggacgggtaaccccgggaacggtaacccggtaaccggttccgttaaggtttaacgttaacggtttaccgtaggggttacgaagggttaaccgtaagggttctttacgggtttacgtaccgggggtaccgggtttacccggggaccgttaacccggggttacccgttaccgggtacccgtaccccgttcctacccgtaccgaccccgttacccccgg

SEQ ID NO: 113728 - DNA, 757 bp, Homo sapiens
  misc_feature: GYAE6OF01DYS6M.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtgggtggagtcgtgggggagtccgttaggtaaaggccggtcggggggttccccttaggagttcctccgtggtggtcggtcctcgtggtactttcgtacttttcgaagttaagtggtccgtggtagttggtaggttcggggtccgccgaggcctaccggagggggaagggggtcgtggggtacgggttggggttagggtaacgtttaacgaaaaagttaaaagtgtaagtaggtagaaagaaaagtagacgtacggtgacgacccgtaggaaaggtaacgtactacaacatacgaacgaagaagtaattaactaacgaaaacggtacggttagttaatttacgaataaagtaacgtaaacgaacgtaccaaacggaaaacccggtagaacctaacgacggtaccgttactaacgtttactacggtaaccaacgtacggttaacgttacgggtaatcgactaacgttacggaaacggtaaagggacggtacttattcgggttactttaggtacgttacgttccgggtacgggaacccggtaagggaacgtaggttccggg

SEQ ID NO: 113729 - DNA, 797 bp, Homo sapiens
  misc_feature: GYAE6OF01D9JT8.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttggttttccttgctgctatacttaaaaggtgtcagtgtgaagtgcgaggtggtggagtcgtgggggagtccgttaggtaaagccgttggggttcccttagagtctcctgtgtcggtcctctggtattctactttactagtaagtggcgtggtagtggtagttcgggtccgccgacggccgtccggaaggggaaggggtcgtgggtagggttggggttacggtaacgtttaacgtaaaaagtaaaagtagtagtaggtaggaaagtaaaagtagtaacgtacggtgaccgtaacccgtaggaaaacggtaagtaacgttaccaaccgtaataccgtaacgaaagaacgtaaattaaacgttaaacgaaaaacggtacggttagttaagtttagtaactaaacgtaagtaaacgtaacggacccgtaaacggaaaaccgaacgaaccgacgtaacgtacccgttaaccttaacttaacgtaccgtaaacccgtaacgtaacgtaacgttaacggtaacgtagaacccgtaaggtaaccggtaaaacggtaaaggtaacggtacgttaagtttacggtttacgtttaaggtacgttacggttaccgggttaccgggtacccggtaaacgggtaacgtacggttacccgggg

SEQ ID NO: 113730 - DNA, 866 bp, Homo sapiens
  misc_feature: GYAE6OF01CMP13.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacttaaaaggtgtccagtgtgaagtgcagggtggtggagtcgtggggagtccgttaggtaaacggtccggtcgggggtacccttaggagttcctccgtgttggtcggccttcgtggtacttctactttcgaagttaacgtggcgtggtattggtaggttcggggtcccggccgaagggtcctaccggaagggggtaacgggggtcttaggggtaggttgggggtttacggtaacggttttaaacgaaaaaggtaaaagtaggtaagtagggtagaaaagaaaagtaacgtaacgtacgggtacgacctaacccggttaaggaaaaggaagtactaccaaccgtatccgtaacaaagtaagtaattaaacgttaaaccaaaaccgggtaggttacggttaatttacgaaacgtaaatacgtaaacgacgtaaccgtaaacggaaaaacccggtacggaaccgaacccgtacggtacccgttaacgtttaaacctttacgttaaccggtaaccgaaaccgtaggttaaacccggtttacggaaagggttaccaacggtaacggtaaccggtaaacgggttaaaacgggtaccggtacgttaaggtttacggttttacgttttacggtaagtttaccgttaccggggtacccggggtaacccgggtaaaccgggttaccgtaaaaggggtttccccggg

SEQ ID NO: 113731 - DNA, 744 bp, Homo sapiens
  misc_feature: GYAE6OF01D6495.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcagggtggtggagtcgtgggggagccgttaggtaagccgtgggggtcccttagagtctcctgtgtggcctctggattctactttcagtaatggctggatggaggttcggtccgccgaggctccggaggggaggggcgtgggaggtgggttaggtacgtttaagaaaagtaaaagtgagtggtagaagaaaatagacgtacggtcgacgtaccggtagaaaaggaagtacttaccaactatctaacgaaagaagtaattaaacgttaaacgaaaaacggtcggtttaagttaatttaggaactaaaagtacgaaacacggacccgtaaggaaaaacccggagaaccaacgtacggtaccgttaacttaacgtttaccgtacggtaaccctaacgtaacgtttaacgttacgggaagttcgtaaccgaacggtaaccggtaaaccgggtaaaagggtaccggtactttaagttcggtttaccttttaggaactttacggttccgggtacgggggtaccccggtaagggtaacgtaacgggtttaccgggg

SEQ ID NO: 113732 - DNA, 707 bp, Homo sapiens
  misc_feature: GYAE6OF01BSO35.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttaggtaaagccgtgggggtcccttagagtctcctgtgtggcctctggattcactttcagtaatggctggatggtagttcgggtccgccgaggccgtccggaggggaacggggcgtggggtaggttggggttacgggtacgttttaacgaaaaaggttaaaaatgaagtagggtagaagaaaatagacgtacggtgacacccggtagaaaggaagacgttacacctatctacgaagagtaataataacgaaaacgtacggtagtattagacaaatagaacacgacctaagaaaccgagaacacgacgccgttacttaacgttactacggtaaccacgtaacgtaacgttacggtaagtcgacgaacgttacggtaaacggtaaaacggtacgggtaccgttagttcggtttccgttttaagtacgtttacggttcgggttaacccgggggtaccccggaaagggggtaaccgtaagggtttaccggggg

SEQ ID NO: 113733 - DNA, 858 bp, Homo sapiens
  misc_feature: GYAE6OF01BV28L.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcgttgggttttccttgctgctatacgttaaaaggtgtccagtgtgaagtgcgtaggtggtggagtcggtgggggacgtccgttagggtaaacggccggttcggggggttcccctttaggtacgttccgttcccgttggtcggtcggtccttcgtggtacttcctacctttacgtagttaagtggtactggagtggtaggttcggggtcccggaccgacgggtccgtaccgggaagggggaacgggggtcgttaggggtagggttcgggggtttacgggtaacggttttaaacggaaaaaaggttaaaaagtggtaacggttagggtaaggtaaagtaaaagtacgaacggtacggtacgaccgtaaaccgggtaaggaaaacggtaacgtacttaaccgaaccgtactaccgtaacgaaagtaacgtaattaaacgtaaaccgaaaacgggttacggttagttaacgtttacgaacgtaaaagtacgaaaccgtacgtacccgtaaacgggaaaaccggcggaaccaaccgtacgtacccgttaattaaccgtacgtaccgtaaaccgactaacggtacgttaacgggaacgtacgtaccgtaacggtacgaacgggtaaaacgggtgaaactttggtacgtttaaccgttagtaacgttcggtacccgggtcgggaaccccggtaagggtacccgttaggttaccggg

SEQ ID NO: 113734 - DNA, 685 bp, Homo sapiens
  misc_feature: GYAE6OF01BZ5HH.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcgtgggggtcccttagagtctcctgtgtggcctctggattcactttcgagtaatggctggatggagttgggtccgcgaggctccgagggaagggggctgggacgtgggttcggacgtttacaaaggtaaaaatgtagtggtagaacgaaaagtcgactacggtgcaccggtgaaaggaagatcgaactacgtctacgtaagataattaacgttacaaaaacggtacggttagtaagtttagaccgtaaatacggaaacaggtacccgtaaggaaaacccgtaggaacctaacgacgtacccggtaacttagttaacccgtgttaacccgacgtaagtacgttacgggaaagttcggaccagttacggaaccgttaaagggccggtacttaagtcgttaccgtttttagacgtttaagtccgggtacgggaccccgtaagggtacctaagtttccgggg

SEQ ID NO: 113735 - DNA, 720 bp, Homo sapiens
  misc_feature: GYAE6OF01B9DIG.15.86.H09.1.454.CMB.1.raw
  modified_base (422)..(422): a, c, t, g, unknown or other
  misc_feature (422)..(422): n is a, c, g, or t
  modified_base (509)..(509): a, c, t, g, unknown or other
  misc_feature (509)..(509): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtgggggagccgttggtaaagccgtgggggtccttagagtctcctgtgtggcctcgtggattctactttcagtaagtggcgtggatggtaggttcgggtcccgccgaggtccgtccggaaggggacgggggcgtgggaggttggggttaggtacgtttaacgaaaaaggtaaaaagtgtaagtaggtagaaagaaaagtagacgtacggtnaccgaccgtagaaaggaagtactcaacatacacaagataataactaacgaaaacgtacggttagtaatttacgactaaatcgaaacncgacctaaacggaaaccgaggaacccacgtactacccgttacttacgttacgtaaccgtaaccaacgtaagtacggtttaacggaagttggtaacctacggtaacgggtaaacgggtaaaagggcggttacttagttacggtttcttttaaggtaagttacggttcccgggtacgggggtaccccgaaaggggtacctagggttacccggg

SEQ ID NO: 113736 - DNA, 752 bp, Homo sapiens
  misc_feature: GYAE6OF01ETV6S.15.86.H09.1.454.CMB.1.raw
  modified_base (206)..(206): a, c, t, g, unknown or other
  misc_feature (206)..(206): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtggtggngtcgtgggggagtccttgggtaaacgccgtcggggggttcccttaggacgttcctccgtgtgtcggcctcgtggtattcactttcagtaatggcgtggatggtaggttcgggtcccgccgacgggccgtaccggagggggaggggtcgtgggtagggtggggtttggtaacgtttacgaaaaagttaaaaagtggaagtaggtagaaagtaaaagtaagacgtacggtcgacgacccggtagaaaggaagtactccaacctactctaacaagaagaattaaacttaacgaaaaacgtacgggttaattaagtttacgaacgtaaacgtaggtaaaccacggtaccctaaaggaaaacccggtaacgaaccgtaaccgacgtacccgttaccgttaactttacgttaccgaacgacgtaagttacgttaacggtaaggtcgaacgtaacgtaccggtaaaaccggtaaagggtacggtacttagtagttacgtttttagaagttacgttccgggtacggggacccgtaacgggtacgtaggttccgg

SEQ ID NO: 113737 - DNA, 899 bp, Homo sapiens
  misc_feature: GYAE6OF01C8T7G.15.86.H09.1.454.CMB.1.raw
  modified_base (832)..(832): a, c, t, g, unknown or other
  misc_feature (832)..(832): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcttgggttttccttgctgctatacttaaaaggtgtccagtgtagagtgcagggtggtggagtcggtgggggacgtccgttagggtaaacggtccggtcggggggttaccccttaggtacgttccttcccgttggttcggtcgggtcccttcgttacgggtaacttttccttaaccgttttacgtaaaggttaagttcgggtaccgttagggtagttagggttaacggggtttccgggggtccccggacccgtacggggtccccgtacccggggaaagggggggtaacggggggtccgttagggggtaggggttttacggggggtttacgggttaaaccggttttaaacgtaaaaaaaggtttaaaaagtgggttaaaggttaggggtaacgaaaaggtaaaagttaggaaccgttaacgggtaccgacccggtaaacccgggtaaaggtaaaagggaaacgttaaccttaccgaaaccctacgttacctaacgaaaggtaaacgtaaattaaacgttaaaccggaaaaacccgggttgttaacggtttattagaaactaaagtacgaaactcggtaaccgtaaacggaaaccgtacggacaaccgtacggtaccttaagttaacttacgacctaaccgagtagtacgttacggaactcgacgacgttaaacggacggttaaaggngttacttagttccgttatttaggaatttccggcgggttaaccgggacccgaaggtctaggttccggg

SEQ ID NO: 113738 - DNA, 987 bp, Homo sapiens
  misc_feature: GYAE6OF01D0IY6.15.86.H09.1.454.CMB.1.raw
tcagtctacgtagccacgaccggtgctcgatttagtgctatagacttgggtttggggtacgatttgatgttacctgatgcttagaggtcttttcctggaagcagggctatttgttgcttcagccaccgtagtcgcctcgtcactccacgcctcgacgtcctttgttacgtttttccggtagttttcgaccgtaacggaaaaccctacgtaccccgtaaccccggtaaccggttaaaacccggggaccgaacccggtcccggacccccggaccaaacgtacgttaccgtccctttcccgtccccgttaccccccttgaccgtaacgtaaaccaaccgtaaacggtaaccgaaggttaaacttaaccgtttaaacccgttccggtttacccaacgttaccggtaaccgttacccgttcccgttttccgggcccttccggtaccggtttacggggtcctacccgtacccgtaccccgttaccggtaaccccgttaagtttaaccgggttacggaaccgtaaccgggttacccgtttcgggtcccgttaccgggcgggtaccggtccgggtttaccttttacccgtacccggtttacgttttaccgttacgttttaacttcgtacgtaccgtagtaccgttacgttaccgtacttaccgttccttaacgtacctaaccccgtcgtaacgtcctaacgttcccgtacctaccgtaacgaccgtaccctaaccttaacccgttcgaaccgttaacgtacccgttaaccgaaccgttacccctaccccgtaaacccccgtaaaccaaccggaacgtactaaccgtcggtacccgtccgtaccgtcggtacccgtacgtccggttccgttaccggtcgtttcgtttaccgggttaacccggttttccccggtccttttaaccgtccgtttccccccgtccgtaactaccggttaccgtacggtaccgtttaaccggtagttaaccgggtacccgg

SEQ ID NO: 113739 - DNA, 1029 bp, Homo sapiens
  misc_feature: GYAE6OF01DYPNJ.15.86.H09.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
tcagtctacgtagccacgaccggtgctcgatttagtgctatagacttggggtttgggggggagaggagcccccagcccttgggatccccaagtgttttcattcagtgatcaggactgaacacagagactcaccatggagttcgggctgagcttggttttcctgctgctatacttaaaggtntcagtgtgaagtgnaggtggtggagtcggtgggggacgtccgttagggtaaacggccgggtgggggtaccccttaggacgttcctcgtggtggtcggtcctcgtggtactttctacctttactaaggttaagtcgggtcgttgggtagttagggtacggtttccggggcccgtaccggacgggtccgtaccggggaaggggggtaacggggtcggtacggggtagggtttagggggtttacggtaaccggttttaaaacgaaaaaaggtttaaaaagtaggtaaggttagggtaaaggtaaaaacggttaaaaaggtaaaccggtaaccggttaaaccgggtcggtaaccccgtaaacccggggttaaaggaaaaacggggtaaactaaccgttacccaacccgtacgttaacctaaagtaaaacggtaagtaaaacgtttaaaaccgtaaacggtaaaaaaccggggttacgggtttaagtttaagtttaaacgggtaaaaccttaaaaggttaaccggtaaaaaccgaaccggttaaaccggtaaaaaccgggtaaaaaaccccgggaacggtaaacccaaccccgttaacggttaaccccggtttaacctttaaaactttaaccccggttttaacgaaacccgtaaaccggttaacggttaaaggttaacccgggtaaacgttaccggaaccggttaaacggtaaacccggggtaaaacgggttaaaaagggtccggttaaccgttaagttttccgggtttaacgttttacggaacgtttaccccggggtcggtaaaccgggggaccccggtaaaggggttaccccgttaagggtttaccccggg

SEQ ID NO: 113740 - DNA, 809 bp, Homo sapiens
  misc_feature: GYAE6OF01BRM67.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggttttccttgcgtgctatacgttaaaggtgtccagtgtgaagtgcgaggtggtggagtcgtgggggagccgttaggtaaacgccggtggggggtcccttaggacgtctccgtgtggtcggtcctcgtggtactttctacttttcgaagttaagtcggctgggatggtacggttcgggcccgtccgaggcctaccggagggggtaacgggggcgttggggtagggttcggggtttacgggtaaccgttttaacgaaaaaggttaaaagtggtaagttagggtaggaaaagtaaaagtacggtaccggtacggttacgaccgtaacccggtaaggaaaggaagtacgttaccaaccattactacgaaaggtagtaacttaaacgttaacgaaaaacggtcggttagttaagtttaccgaactaaaagttcggaaaccgtacggtaacccgttaaacggaaaaaccggcggtaaaccctaacgtaacccggtacccgttaacgttaacgtttacccgtaacggttaacccacgtaaggtacgttaccgggaatcgacctaaggtaccggaacggtaaaggtcgtaccgttagtacgtttacgtttagaacggttacgttccgggttaacggggaccccgtaaagggcccgttagggtcgg

SEQ ID NO: 113741 - DNA, 613 bp, Homo sapiens
  misc_feature: GYAE6OF01EZ636.15.86.H09.1.454.CMB.1.raw
  modified_base (370)..(370): a, c, t, g, unknown or other
  misc_feature (370)..(370): n is a, c, g, or t
  modified_base (507)..(507): a, c, t, g, unknown or other
  misc_feature (507)..(507): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggggagccgttggtaaagcctggggggtcccttagagtctcctgtgtggcctctggattcactttcagtaatggctggatgtagttgggtccgccaggctccgagggagggggcgtggaggtggggttggacggtttacaaaagtaaaatgagtggtanagaaatagacgtacggtgcacccgtagaaaggaagtactcacatactacaagagataattcaaaacgtacggttagtagtttagacaaatgaactaagacctaggaaaaccgaggaaccacgagccgtactattacngtaccactagattacggaagtgcctagtccgtaaccggtaaaggaggtactattgtcttttaggattagttcggtacgggggacccctaaggggtccaaggttcgg

SEQ ID NO: 113742 - DNA, 945 bp, Homo sapiens
  misc_feature: GYAE6OF01BYF1H.15.86.H09.1.454.CMB.1.raw
  modified_base (837)..(837): a, c, t, g, unknown or other
  misc_feature (837)..(837): n is a, c, g, or t
tcagtctacgtagccacgaccggtgctcgatttagtgctatagacttgggtttgggggggagaggagccccagccttgggatccccaagtgttttcattcagtgatcaggactgaacacaggagactcaccagtggacgttcgggctgagtcgttcgggttttcctgctgtctatacgttaaaggtcgtctagtgtagagtgcgtagggtgggtggacggtgggtagggggtacgtaccggtttaagggtaaaccggtccgggttacgggggttacccttagtacgtccgtccgttggtcgtcggtccttcgtaggtacttaccttactttagaaggttagtcggtacgttagggtgttacgggttacgggttccggggtacccgaccggtacgggtccgtaaccgggggtaggggggtaacggggtacggtaggggttacggggtttacgggggttaacgggtttaaacccggtttaaaaggtaaaaaaaggtttaaaggttagggtaaagttaagggtaaacggtaaaaggttaaaacggtaacgtaccggtttaacggaaccgtaacccggtaaaccgggtaaaggtaaaacggtaacgtaacccgttaccgaaaccgttaccgtaaacgttaaacggtaaaaggttaaacgtaaaactttaaaccgttaaaaccgggaaaaacggtttcgggttaatttaaacgttacggaaaacgttaaacgaacgtaaaccggtaaccggtaaccgaaaacgggtaaccgaacgacgaccgtttaacgacgtttacttaaacgtcgtaacctaaaccgaggttaaacgacggttaaaccgngaaccgtaacgtagaaaccgggtaaggtaaccggtgttacccttagggttattacgttagaacgtacgggtacccggacgggtaaaggacctttaaggcggtttaccg

SEQ ID NO: 113743 - DNA, 755 bp, Homo sapiens
  misc_feature: GYAE6OF01AUAAR.15.86.H09.1.454.CMB.1.raw
  modified_base (713)..(713): a, c, t, g, unknown or other
  misc_feature (713)..(713): n is a, c, g, or t
tcagtctacgtagccacgaccggtgctcgatttagtgctatagacttgggtttgggggggagaggagccccagccttgggatccccaagtgtttcattcagtgatcaggactgaacacagaggactcaccatggagttcgggctgagctgggttttccttgctgctatcttaaaaggtgtcagtgtgaagtgcgaggtggtggagtcgtggggagtccttggtaaacgccgtgggggtccctagacgtctcctgtgtggccctcgtggtacttcacttttcagtaagtggctggatggtagttcgggtcccgccgacggccgttaccgaagggggaacgggggtcgtagggtaggttcggggtttacggtacggttttaacgaaaaaaaggttaaaaacgtggtaaagtgggtaagaaagtaaaaaagtacgtaaccgtaaccggtcggacccgtaacccgggtaggaaaaacggaacgtaacgttaccaaccgtaatactaccgaaagagttaaactaaacgttaaccgaaaaacggtcggttagttaactttacgaataaacgttacgaaaccagaacccgtaacggaaaaacccgtggaaccaacgacggtccctaaccttaagttaccgtacgtaaccgacgtaggtaacgtttacggaagtaccggatacgtaacgggtaaacgtaaagggcggtacttagtcggttntttagatttacggtccggacggaccgaggaaccgtggtccgg

SEQ ID NO: 113744 - DNA, 761 bp, Homo sapiens
  misc_feature: GYAE6OF01CY2RA.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagtcggctgagctggttttccttgctgctatacgttaaaggtgtccagtgtagagtgcaggtggtggagtcgtggggagtcgttggtaaacgccgtcgggggtcccttaggacgttctccgtgtgtcggtccttcgtggtaacttctacctttcgaagtaatggtctaggtagtaggtacggttcggggtccgaccgaaggtccgtaccggaaggggaagggggtcctaggggtaggtcggggttaggtaacgttttaacgaaaaaagttaaaagtgtaagttagggtaagaaaaggtaaaaatacggaaacgtacgggtacgtaccgtaaacccggtaaggaaaacggtaaagtacttaccgaaccacgtactaacgaaagtagtaataacgttaacgaaaaacggtcggttaagttaacgtttagaaactaaagtaacgtaaacgtacggtaacctaacgggaaaaacccgcggaaacctacgaacgtaccttaactaactttaaccgacgttaaacaactagtaacgttacggacttaggactaagttaacgaaacggttaagacgggtactaggttcgtaatttacgattacggtcgttaacgggaccaaggtaagtacgtcgg

SEQ ID NO: 113745 - DNA, 712 bp, Homo sapiens
  misc_feature: GYAE6OF01CA3BT.15.86.H09.1.454.CMB.1.raw
  modified_base (322)..(322): a, c, t, g, unknown or other
  misc_feature (322)..(322): n is a, c, g, or t
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (515)..(515): a, c, t, g, unknown or other
  misc_feature (515)..(515): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctggttttccttgctgctatacgttaaaaggtgtccagtgtagaagtgcgaggtggtggagtcgtggggagccgttaggtaaacgccgtcgggggtcccttagagtcctaccgtgtcgtcggccttacgtggacttctactttcagtaatggctgatgtaggttcgggtccgcgnggcctccggaggggagggctgggnggttgggtggtaaccgttaanaaaagtaaatgagtgtagaaagaaatagacgtacggtgaccgaaccggtagaaagatactacgaacatacgnaaagtanaattaataacgaaacgacggttagtattaggaactaaagtcaaacgacgtacccgaaacgaaaaccggngaaccaaccggacgttaacccgttaagttacttaccgtaaccgtaaccgtaactaggtaaacctttacggggaaactcgtagaaacgtaccggggtaaaggtaaaaggcggtttaacttaggttcgtttaacgtttcgtaaagttcggttacccgggtacccggacggttaacccgggtaaatcggttttaccgggg

SEQ ID NO: 113746 - DNA, 897 bp, Homo sapiens
  misc_feature: GYAE6OF01EIA8V.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgttgggttttccttgctgctattacttaaaaggtgtaccaagtgtgaagtgcgaggtggtggagtcgtgggggagccgttagggtaaacggccggttcggggggttaccccttaggtacgttccttcccgttggtcggttcggtcccttcgtggtactttcctactttcgagtaagtggtctggagttggtaggttcggggtcccggacccgacggccgtacccgggaaggggggaacgggggcgttagggggtaaggggttcgggggtttacgggtaaccggttttaaacggaaaaaaaggtttaaaaacgtggtaaagttagggtaaggaaaagtaaaaagttacgaacggttaacggtacgaccgaacccggtaaggaaaaggtaacgtaacgttaccaaccctactacctaacgaaaggtaagtaacttaaaacgttaaccgaaaaacggttacgggttagttaagtttacggaaataaaagtacgaaccgtaacgtaacccgtaaacggaaaacccggaggaaccctaaccgtaccggtacccgttataaaccggtttacgtaaccgtaaccccaagtaacggttacgttaacgggaagttaccgaaccgttaaacgtccgggtaaaaacgggtaagggtaacggttaacgttacggttacggtttacgttttaggtaccggtttaacgtccgggggttacccgggaaacccgggtaaggtaacccggttaagggtttcccgggg

SEQ ID NO: 113747 - DNA, 811 bp, Homo sapiens
  misc_feature: GYAE6OF01CJVGM.15.86.H09.1.454.CMB.1.raw
  modified_base (303)..(303): a, c, t, g, unknown or other
  misc_feature (303)..(303): n is a, c, g, or t
  modified_base (569)..(569): a, c, t, g, unknown or other
  misc_feature (569)..(569): n is a, c, g, or t
tcagtctacgtagccacgaccggtgctcgatttagtgctatagacttggggtttgggggggagaggagccccagccttgggatccccaagtgttttcattcagtgatcaggactgaacacagagactcaccatggagttcgggctgagtcttgggttttccttgctgctatacgttaaaaggtctccagtggtagaagtgcgagggtgggtggagtcggtggggagccgttaggtaacgcggtcgggggtccctagtagtcctccgtgtcgtcggcctcgtggtattcgtactttcagtaagnggtcgtggagtggtacggttcgggccgccgaggccgtccgggaggggtaacgggggcgttagggtaggttggggtttacggtaacgtttaaacgaaaaaaggttaaaagtaggtaagttagggtacgaaaaggtaaaacaggtaaccgtaggtcgaccgtaaccggaaggtaaaggaacgtaattaccgaactacgtacctagaaacgaagttaaattaaacggtaaacgtaaacggttcggtaatttaacgtaataaacgtaaanaaccggtaaacaccgtaacgtaaaccggaaacgaacggacaacggtacgtacttaacgtacttaaccgtacgtaaacccgaacgttaggtaacgttaacgggattacgaacgtaaccgggtaacggtaaaacgggaaacggttacgtaaccgttaggtttacgttttaacgttaacggtacgtttaccgggtaccggggtaaccggtacccgggtaaacgtcccgggttaacgttcccgggg

SEQ ID NO: 113748 - DNA, 773 bp, Homo sapiens
  misc_feature: GYAE6OF01DT2ZD.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggttttcctgctgctatcttaaaaggtgtccagtgtgaagtgcgaggtggtggagtcgtgggggagtccgttagggtaaacggccggtggggggttccccttaggacgtcctccgttgtggtcggccctcgtggtattctactttcgaagtaagtggctggattgtaggttcgggtcccgccgaggccgtccggaaggggaaggggcgtgggtaggttggggttacggtaacgtttaacgaaaaagtaaaagtgtaagtgggtaagaaagaaaacgtagtaaccgtacggtacgaccgaacccggtaaggaaaagggtaagtaacttacccgaacctattacccaagaaaggtaagtaaattaacgttaaaaccgtaaaaacggtacggtttaagttatttaacgaacgttaaagacgtaaacgaccgtaccgtaaacggaaaaccgggaccgaacgaaccgtacgtacccgtttaactaacgtttaaccgtaagtaacccctaacgtacggtaacgtttaacgggaacgtcgacctaacgtacgggaaaccggttaaagggacgtcttagtgtttcgttagacttacggtcggtacgggaccgaaggtacgtaggttccggg

SEQ ID NO: 113749 - DNA, 942 bp, Homo sapiens
  misc_feature: GYAE6OF01ENGAJ.15.86.H09.1.454.CMB.1.raw
tcagtctacgtagccacgaccggtgctcgatttagtgctatagacttgggtttgggggagaggagccccagccttgggactccccaagttgttttcattcagtgatcaggactgaacacagagactcacatggagttcgggctgagtcgttgggttttcctgctgtcttatacgttaaaggtcgtacagtgtaggaagtgacgtaggtggtaggtagttcggtaggggtacgtaccggtttagggtaaacggtccggttcgggggttacccttaggtacgttccgttccgttggttcggtcggtccttcgttaggtactttccgttactttacgaaggttagtcggtacgtggagttggtacggttccggtccgacgtacggtccgtacgggaaggggtacggggtcgttggggtagggttcgggttacggttaacgtttaaaacgaaaaaggttaaaagttgaacgttaggtaagtaaacgtaaaagtacggtacgtacggtacgaccgaaccggtaaggaaaacggtacgttaacgtacctaaccgtaactaccgtaaggaaaacgttaacgtaaacgtttaaaccggtaaaaccgggtaaaaaccgggtttacggtttaaggtttaaacgtttaccgaaagttaaaacggttaacgggaaacccgttaaccggttaaacccgggaaaaccggtaaaaacccgcggaaaccttaccggtaccggtttaacccgttacgttaaccgttaaccgaaccgttaacccgaacggttaagtttaaccggtaacgggtaactacgggttaaccgtaaaacggttaacgggtaaaccgtaaagggtcccggtttaagtttattacggttttcggtttaaacgtaacgtttccgggtaccccggggtacggggaaaccccttagggtaaccgtttacggggtttcccg

SEQ ID NO: 113750 - DNA, 804 bp, Homo sapiens
  misc_feature: GYAE6OF01AKVT4.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctggttttcctgctgctatcgttaaaggtgtccagtgtgaagtgcaggtggtggaggtcgtgggggacgtccgttagggtaaacgccggtgggggttccccttaggacggtccttccgtggtggtcgcctcgtggtacttcgtactttcgagttaatggctggtatggtaggttcgggtcccgccgacgggtcctaccggaagggggtaacgggggtctaggggtacggttcggggtttacgggtaacgttttaacgaaaaaagggtttaaaaactggtaaggtacggtaaggtaaaacggtaaaaagtacggtaaccgttaacgggtacgaaccggtaccccggtaaggaaaacgggtaacgtacttaccgaacgtactacttacgaagtaagtaacttaaacgttaacgaaaaccggtagttagtaacttacgaactaaacgtagaaccgacgtacccgtaacggaaaaccgtaccggaaacaccgtacggtacccgtatttacttaaccgtacgtaacgaactacgggttacgttacggaactcgaactaaggaccggtaaacggtaaagggacgtacgtttaacgtcggttaactttacgtaacttaccggtcggaaccggggttaccccgaaagggtccttaagggttccggg

SEQ ID NO: 113751 - DNA, 951 bp, Homo sapiens
  misc_feature: GYAE6OF01B4T7K.15.86.H09.1.454.CMB.1.raw
tcagtctacgtagccacgaccggtgctcgatttagtgctatagacttgggtttgggggagaggagcccccagccttgggatccccaagtgttttcattcagtgatcaggactgaacacagaggactcaccatggagttcgggctgagtctgggtttccttgctgctatacttaaaaggtgtccagtgtagaagtgcgaggtggtggagtcgtgggggagtccgttagggtaaacggccggtcggggggttacccttaggacgtccgtccgttggtcggtcggtcccttcgtggtactttctacgtttacgaagttaagtggacgtggtagtggtacggttcgggtcccggaccgacggtccggtaccgggaagggggtaacggggtcgtaggggtaggttcggggtttacggtaaccggtttaaactaaaaaaggttaaaaagtggaaaggtagggttaacgaaaaggtaaaaacgttagggtaaccgtaacgggtaccgaacccggtaaaccgggtaaacgaaaacgggaaattaacctaacgtaacctacgtaaccgtaacaaaaggtaagtaaacgttaaacgttaaaccgaaaaacggttacggtttaagttaacgtttaacggaaacttaaaagttaacggaaaccgaacggtaacccgtaaaacgggaaaaacccgacggaaaccctaacccgaacggttacccccgttaacgtttaaaccgtttaaccccgttaaccgaaccccgtaaagggttaaacccggtttaagggtaacccggggttaaagcccggaaaacccttaggggttaaaccgaaaaccggggttaaagggaccggtttacttaacgggttacgtttttcccgttttagggaaaacccgtttccggggttccggaaccccggggggaaccccgtaaagggtacccgtttaacggggttcccggg

SEQ ID NO: 113752 - DNA, 711 bp, Homo sapiens
  misc_feature: GYAE6OF01B83GL.15.86.H09.1.454.CMB.1.raw
  modified_base (186)..(186): a, c, t, g, unknown or other
  misc_feature (186)..(186): n is a, c, g, or t
  modified_base (209)..(209): a, c, t, g, unknown or other
  misc_feature (209)..(209): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtntgcatctgtccttgcgtgggacncctcgatcaagctccacctcgaccaccgtaagtagtgagacacgtaccgaacctacacctagtacgtaagtagtactacaacgacggaacgaaccggaaccgggtaaccccgtaccccgtaagttaataaagttaagtaaggtaaaaggttaaggtaggtagtagtacggacgaccgacccgaacggaaccgggaacggggaccggtaccgtacccgtacgtcgtaccgttacgtacggtcggtccgttacgtacggttcggtcgggtaccgtaccggtacccgtaccctaccctacctaccctacctacccctaccctacccgtaccgtacgtacgtacgacgtacgtacggacgtacgtacgtacgtactacgtacgtaggacggacgacgaccaccgtaacgtacgtagtacgacgtacggtacggtacgggttcgggttcgggtagggtacgggacggacggacgacgtccgtacggaccggtacggtcggccgaccg

SEQ ID NO: 113753 - DNA, 871 bp, Homo sapiens
  misc_feature: GYAE6OF01CIR8U.15.86.H09.1.454.CMB.1.raw
  modified_base (830)..(830): a, c, t, g, unknown or other
  misc_feature (830)..(830): n is a, c, g, or t
  modified_base (835)..(835): a, c, t, g, unknown or other
  misc_feature (835)..(835): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatgggagttcgggctgagcttgggttttccttgctgctatacttaaaggtgtccagtgtgaagtgcgagggtggtggagtcggtcgggggactccgttagggtaaacggtccggtcggggggttaccctaaggtacgttcctccgtggtcggtcggtaccctcgttaggtacttcctacgtttacgagttaacgtgggacgttggtagtggtacgggtttcgggtacccgccgaagggtccgtacccgggaagggggaacggggtcgtagggtacgggttcggggttacggtaaccgtttaaagaaaaaggttaaaagtggtaacgtagggtaagaaagtaaaaacgtacggtaacccggttacggtaccgaacccggtaacccggggtaaaggtaaaacgggtaacgtaaccgttacccaaccgtacgttaccgaacgtaaaacggaactaactttaaaacggtaaaacccggtaaaacgggttaaccgggttttagttaaacgtttacgaaaccgtaaaaggtaccgtaaaccggtacggtaacccgttaaacgggaaaaacccggacggtaaaccaacccggtacgttaacccggttaccttaacgtttccctaaccgtaacctaagtaaccggttagttaacgggtagtcgaacgttaagtaccgggtaaaggaaggtagtaccttagttccttnttagngttacgtcgggtacgacccgaggtactagggttccg

SEQ ID NO: 113754 - DNA, 773 bp, Homo sapiens
  misc_feature: GYAE6OF01C0YIO.15.86.H09.1.454.CMB.1.raw
tcagtctacgtagccacgaccggtgctcgatttagtgctatagacttgggtttgggggggagaggagccccagccttgggatccccaagtgtttcattcagtgatcaggactgaacacagaggactcaccatggagttcgggctgagctgggttttccttgctgctatacgttaaaggtgtccagtgtgaagtgcgaggtggtggagtcgtgggggagtccgttggtaacgccgtcgggggtcccttagacgtctcctgtgtcggcctcgtggacttctactttcagtagtggctggagtggtaggttcggggtcccgaccgaggccgtaccggagggggtaacggggtcgtgggtaggttgggggttacggtaacgttttaacgaaaaacggtaaaagttggaagttagggtagaaaggtaaaacgtacggtacgtaccgggtacgaccgtaacccgggtaggtaaaacgggaacgtaacttacccgaacccgtattaccgtaacgaaacggtaagtaaactaacgtttaaaccgaaaaaccggttccggttaagtttagttacgaaactaaagtacgaaaaccgtcggtacccgtaaacggtaaaacccggcgggtaacccaacggtacggtaacccttacgttactttaccgtaccgtacccaacgtagtacgttacgggaatcgacgtacgtaacggaacggtaaggaggtactagttacgttcgtttagacgttgtccgggtacggacccgtagggaccgtagtcggg

SEQ ID NO: 113755 - DNA, 686 bp, Homo sapiens
  misc_feature: GYAE6OF01A9SXM.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcaccttgagcacttattggatgtacttggtcccgccgaggctaccgagggaaggggcgtggaggtgggtcggcccaaccgaactaacgaaaaagataggaagtacgaacaactaacctaatagtacgaaactcgtcgtgaagtcgggacccgtacttccgaacccgttccgtacccgaagaacggaaccggaaccgacccgaaagtaacctacctaaccgtaacattacctacgaaccaaagttaacgaaaccaaacccgtggaaacgtacgaccgggaacggaaccgaacgggtacctaggttagttaactttaacggtgtagtaggagtagtcgtagttcgtgggtacgggttcggggacccggtaacgggtaacccgtcggtaccacccggttacctcctccgacgtaccccg

SEQ ID NO: 113756 - DNA, 924 bp, Homo sapiens
  misc_feature: GYAE6OF01DHY44.15.86.H09.1.454.CMB.1.raw
tcagtctacgtagccacgaccggtgctcgatttagtgctatagacttgggtttggggggagaggagccccagccttgggatcccaagtgtttcattcagtgatcaggactgaacacacgagacctcaccatggagttcgggctgagctggtttcctgactgctatacttaaagtgtccagtgtgaagtgcgaggtggtggagtcgtaggggagtccgttaggtaaacggtcccgtacggggggtacccctttaggtacgttccgtaccgttggtcggtaccgggtcctacggttggttaacgttccttaaccgttttcgtaaacggttaacgtcgggtacgtagggtaagtcggttaacggttaccggggttcccggacccgtacgggaccgttaccccgggtaagggggaaaccgggggtttccgtaggggttaaccggggtttaggggttttaccggggtaaaaccgtttttaaccgaaaaaaagggttaaaacgttacggtaaaggtttaacccgggtaaggaaaaccgttaaaaaggttacccggtaaaccgttacgggtaacgacccggttaacccggggttaagaaaacggggtaataacgtaccggtaaccgacttaacggttacaaaggtaactaaggttaaactttaaacggaaaaacgtccgggttttaattaaggtttaaccgaattaaaacgacggtaaaactccggaaacgttacccggaaaaccggaaggacccgtaccgtaagtacccgtaaccttattaaccgtctaaacgtaccgtagtaagtacccgggtaatacggtactaacggtaccggtaaagtaaggtaacgggaccttaggtacgttcgttaaaccggtactaaggttccgggaaccgggtaccttaacgggaccgttagggttaaccgg

SEQ ID NO: 113757 - DNA, 903 bp, Homo sapiens
  misc_feature: GYAE6OF01BNRQN.15.86.H09.1.454.CMB.1.raw
  modified_base (770)..(770): a, c, t, g, unknown or other
  misc_feature (770)..(770): n is a, c, g, or t
  modified_base (809)..(809): a, c, t, g, unknown or other
  misc_feature (809)..(809): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggttttccgttgacgtcgctatacgttaaaggtgtcagtgtgaagtgcgaggtggtggagtcgtgggggacgtccgttagggtaaacgtccggtgggggggttcccctttaaggacggttccttccgtggttgtcgggtccctcgtggtacttctacttttacgaagttaagtcggtctagggtattgggtaaggtttcggggtcccgaccgacgggtcccgtacccggaagggggaaacgggggtccggttggggtaagggtttgggggtttaacgggtaaccggttttaaacgtaaaaaggttaaaaagtggtaagttagggtaagaaaagtaaaaagtacggtaacgtaacggtcggaccgtaacccggtaaggaaaagggtaagtaccgttaccaaccgtaactactaacgaaagaagtaattaaacgttaaaccggtaaaaacgggtacggtttaggttaactttacgaaacctaaaagttacggaaacctacgtaacccgttaaaaggaaaaccccgggaggaaaccctaacgtaccgggttaccctttaacgttaacgttaacccgtaacgtaacccgtaacgtaaggttaaccgttaacggggaacgttanacccggtaaagtaccgggtaaaagggttaaaacggggtnttaaccgttaaattcccggggtttaatttaacgtagttaaccggttccggggtacccgggtaacccgaaggggttacctaaacgggtttccggg

SEQ ID NO: 113758 - DNA, 864 bp, Homo sapiens
  misc_feature: GYAE6OF01AW4Q2.15.86.H09.1.454.CMB.1.raw
  modified_base (201)..(201): a, c, t, g, unknown or other
  misc_feature (201)..(201): n is a, c, g, or t
tcagtctacgtagccacgaccggtgctcgatttagtgctatagacttgggtttggggggagaggagcccccagcccttgggatcccccaagtgttttcattcagtgatcaggactgaacacagaggactccaccatggagttcgggctgagcgttgggttttccttgctgctatacgttaaaggtgtccagtgtgaagtgngaggtgggtggaggtcggtggggacgtccgttaggtaaacggtccggtcggggggttacccttaggtacgttcgttccgttggtcggtcggtcctcgtggtactttccttaccttttactaagttaagttcggtacgttggtagttcggttacgggtttccggggccccggtaccgtacgggtccgtaccccgggaagggggacggggtcgtaggggtaggggttggggttacggtaacgtttaaacgaaaaaggtaaaagtggtaaggttacggtaaggaaagtaaaacgtacggtaacgttacggtacgacccggtaacccggtaaggaaaggtaacgtctaaccgtactaacgtacgtaacgaaagtaaacgttaataaacgggtaaactaaacggttacgggttatttaacgttaggaaacttaaaggtaaccgaaaacggtaaccgtacccgtaaaaggaaacccggtaacgtaacccgaacgtaccggttacccttaacgttaacgttaacccacgttaacccgacgtaaggttacgttaagggtaacggttagtaccggtaaaccggaaaggtaagggtaacgtacgttattacggtacgtttagaccgttggtacccgggaccgggttagacgggtactcggggttcgttaccgg

SEQ ID NO: 113759 - DNA, 900 bp, Homo sapiens
  misc_feature: GYAE6OF01CCXR9.15.86.H09.1.454.CMB.1.raw
tcagtctacgtagccacgaccggtgctcgatttagtgctatagacttgggtttggggggggagaggacgccccagcccttggggactccccaagtgttttcattcagtgatcaggactgaacacagagactcaccagtggtagtcgggctgagtcgttcgggttttccttgctgcttattacgttaaaagtgtaccgagtggtagaagtgcgtagggtggtcggaggtcgggtaggggtacgtacgttacgggtaacggtccgggttcgggggttacccttaaggtcgttccgttccgttggttggtccggtccgttacgttggtactttcctacctttagtaaagttagtcggtacgtaggtagttacggttacgggttccgggtacccgccggtacggtaccccgttacggggaacggggggtaaccggggtccggtaagggttgggttacgggggtttaacgttaaccggtttaaaacggtaaaaaaggttaaagtggtaaaggttaggtaaacggaaagtaaaagttacgtaaccggtaacgtcggaaccgtaaccggtaaaggaaaggtaactaccgtaacccgaattacgtaaccgtaaacgaaagtaacgtaaacgtttaaacgttaaaccggtaaaaacgggtttcggttaacgtttaacgttaacgaagtaaaacgtaaccggaactaaccggtaaccgtaaacgggtaaaacccggaagtaaaccctaccggtaaaccgttaccgttaaccgtttaacgttaccgtaaccgtaaccgaagttagtaacggtttaccgaagtcgtactaaggtaaaccggacgtaaaggtccgtaagttgttacttagtttgaacgttccgacgggtaccgaggtaaggtcgtggtaccgg

SEQ ID NO: 113760 - DNA, 829 bp, Homo sapiens
  misc_feature: GYAE6OF01BBEBU.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacgccgtggggggttcccttagagtctcctgtgtcggcctctggtacttctactttcagtaagtggtcgtggatggtaggttcgggtcccgtccacgggcctaccggaggggaaggggcgtgggtaggtggggttggtacgtttaacgaaaaagttaaaagtggaagttcgggtagaaaaggtaaaagtacggtaacgtacggtacaccgtaacccggtaaggaaaacggtaacgtacttacaaccctatacctaacgaaagtaactaataaacgttaaaccgaaaaaacgggttcggttaagtttaacgtttacggaaactaaaacggtacgtaaaaccgaacggtaaccccgtaaaacgggaaaaacccggtacggaaaccctaacggtacccggttaaccctttaacgttaacttaacccgttaccggtaaaccctaacgtacgtaacggtttaaccggagttacgaaccgtacggtaacgggtaaacggtaaaaggggaccgttacgttaggttacggtttactttacggaagttaccggttaccggggtacccggggtacccggtaaaggggtaaccgtaaaggttttcccggggg

SEQ ID NO: 113761 - DNA, 934 bp, Homo sapiens
  misc_feature: GYAE6OF01DBPGQ.15.86.H09.1.454.CMB.1.raw
  modified_base (453)..(453): a, c, t, g, unknown or other
  misc_feature (453)..(453): n is a, c, g, or t
tcagtctacgtagccacgaccggtgctcgatttagtgctatagacttggatttgggggggagaggagccccagccttgggactccccaagttgttttcattcagtgatcaggactagaacacgagaggactcaccagtggaggttcgggctggagtcttcgggttttcctgctgctatacgttaaacggtgtccagtgtagaagtgacgaggtgggtggacggttcggtggggagtccgttagggtaacggtccggttggggggttacccttaggacggttctaccgttggtacggtcggtcctgtaggtacttcacttacgtagtagtcggtctaggtatggtaggttccggtccgcgacggtccgtacgggaagggggtacggtcggtagggtacgggttgggttaggtaacgtttaaacgaaaaaggttaacgtggtaaggtagggtaanaaaggtaaaatcgtaacggttacggacgtaaccgtaaccggtaagggaaaacggtactacttaaccgaccgttaataccgtaaagaaaacgttacggtaaaacttaaacggttaaaccgtaaaaaccgggtttacgggttacgttttaaacggtaaaccgtaacggttaaaagtaaacccggtaaacgtaacccggggttaacccgtaaaaaccgggtaaaccccgggaacccgtaacggaaaccggtaccgggttaacccttaaccggtttaaacgtttaccccgtaaccggttaaaacccgtagttaaaccgggttgtttaaacccgggggataccgtaaacccggtaggtttaaaccccgggaaggggtttaaaacgccgggttatttacccggttattttacgggttaaacggttacttaccggggtacccgggttacggggggaaaccccttaaagggggttcccgtttaccgggg

SEQ ID NO: 113762 - DNA, 850 bp, Homo sapiens
  misc_feature: GYAE6OF01ESWV7.15.86.H09.1.454.CMB.1.raw
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagcgttgggttttccttgctgctatacttaaaaggtgtccgagtgtgaagtgcgaggtggtggaggtcgtgggggagtccgttaggtaaacgtccggtcgggggtcccttaggacgttcttccgttgtggtcggtcctgtggtattctactttacgagttaagtggtcgtggtagtggtaggttcgggtcccgtccgacgggccgtaccgggaagggggaacggggcgtggggtaggggtttggggttacgggttaacggttttaaacgtaaaaaggttaaaagtagtagttagggtagaaagtaaaagtagtaaccgtacggtcgaccgtaacccggtaagaaaggtaataacgtacctaactataccgtaacgaaagtaagtaaacttaaacgtaaaccgaaaaccggttaggttacgtttaagtttaggaaaccttaaaagaccggaaacgtaaccggtacccgtaaaacgggaaaaacccggtacggtaaacccgtaaccgtaacccgggtaccctttaacgtttaaccgttaccggttaacccgttaaaccccgaagttaacgggttaaaccggttaacgggtaacggtcgaaccgttacgtaacgtaaaccgggtaaggtacgggtcctttaagttcggtttaacgtttggattacgggttcggtaccggggaccgtacgggaagtaggttcccggg

SEQ ID NO: 113763 - DNA, 841 bp, Homo sapiens
  misc_feature: GYAE6OF01CT80G.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcttgggttttccttgctgctatacttaaaggtgtccagtgtagaagtgcgaggtggtggagtcgtgggggatccgttagggtaacgtccggtcggggggtcccttaggacgtcctccgtgtggtcggtcctcgtggtattctactttgagttaacgtggtcgtaggtagtggtacggtttcggggtcccaccggtacggccgtaccgggaagggggtacgggggcgttggggaggttggggttacggtaaacgttttaacgaaaaaaggttaaaagtcggtaagttagggtaagtaaaaggaaaagttaacggaaccgttaacggtcgtaacccgtaacccgggtaaagtaaaacgggtaactaacgtaccgaaccctaactacgtaaacgaaagtaaagtaaatttaaacttaaaccgaaaaacggttacggtttaagttaacgtttaacggaactaaagtacgaaactaccggtaccgtaaacggaaaaaccgacggtaacaaccgtaacgtcccgtttaaacttaacgttaaccgttacgtaaaccccggtaactaaggtacgttaacgggtagtacgtaacgtaaccggttacgggaaaacggttaaaacgggcgttaaccgttatttcggttaacttttaggacttacggtcgggtacgggtacccgaagggtaacttacgggttcggg

SEQ ID NO: 113764 - DNA, 825 bp, Homo sapiens
  misc_feature: GYAE6OF01CBYQ1.15.86.H09.1.454.CMB.1.raw
  modified_base (128)..(128): a, c, t, g, unknown or other
  misc_feature (128)..(128): n is a, c, g, or t
  modified_base (158)..(158): a, c, t, g, unknown or other
  misc_feature (158)..(158): n is a, c, g, or t
  modified_base (231)..(231): a, c, t, g, unknown or other
  misc_feature (231)..(231): n is a, c, g, or t
  modified_base (505)..(505): a, c, t, g, unknown or other
  misc_feature (505)..(505): n is a, c, g, or t
tcagtctacgtagccacgaccggtgctcgatttagtgctatagacttggggtttggggggggagagggacgccccagccgttgggactccccaagttgttttcattcagtgatcgaggactagaacanaggagactcacagtggtagttcgggctggngtcgtttcgggttttcctgctgtacttaattaagttaaaggtctacgagtgtagaagcgagtagggtggtggngtcggtggggactcgttaagggtaacgtccgggtcgggggtaccttaggacgtcctcgtggtcgcggtccttggtgtacttctactttgaagtaagtggtctggtagtggtacggttcgggacccacgacggtaccgtacgggaggggaacgggtgtgggtagggtcgggttacggtaacgtttaaacgaaaaagtaaagtagtacgtaggaagaaagtaaaactaggacgtaggtcgactacggaagaaaggtatactaccactatacgtaanaaagtacgtaataacgttaaacgaaacgtggttagttaaagttccgaaagaaagtacgaaaacgaccgtaacgtaaaacgggaaacgacggtaacaacgacgttacgtaatttacgtaccgtaacgtaaacgtaaacgtacgttaacggttaggaaacgttcgaaaacgtccggtaaaacgggttaaaaccggaaagggttaccggtaaacttaaggttaccggtttttaacgggtaagtttaaacccggtttacgggttacccggggaaaaccccgggttaccggaaaacggtaaaggttaacccgggtttacccgggg

SEQ ID NO: 113765 - DNA, 818 bp, Homo sapiens
  misc_feature: GYAE6OF01BWPD7.15.86.H09.1.454.CMB.1.raw
tcagtctacgtagccacgaccggtgctcgatttagtgctatagacttgggtttgggggggagaggagccccagccttgggactccccaagttgtttttcattcagtgatcaggactgaacacagagactcaccatggagttcgggctgagtcgttgggttttccttgctgtcttattacgttaaaaggtcgtaccgtagtgtagaaggtgcgtagggttgggtggtaggtcggtgggggtacgtaccgttagggtaaacggtccggttcggggggttacccttaggtacgttctccgtgttggtcgtccttcgtgtacttctactttctaagtagtggtcgtaggtagtggttacggttccgggtcccgaccgtacggtccgtaccgggaggggtaacggggtcggtgggttaggggttggggttacggttaacgtttaaacgaaaaagttaaagtgtagtagggtaaagaagtaaaagtacgaacggtacggacgacgtaaaccggtaaggaaacgtaagtacttaaccactactacgtaacgaagtaaagttaaactaaacggtttaaacccaaaacgggttagggttaactttaatttacgaaaacggaaaagttaaccgaaacgtaccgtaaacggtaaacggaaacgaacgaacctacgtaccgtcttaattactcctaacgtaccagtacgtaggttaacgtagacacgtaaggaccgttaaaacgggaaggtacgttacgttgttacgttttcgttaggtactaaccggttccgggtacgggaaccccgtaaggtaccgtgggtttcccgg

SEQ ID NO: 113766 - DNA, 852 bp, Homo sapiens
  misc_feature: GYAE6OF01C5NQK.15.86.H09.1.454.CMB.1.raw
tcagtctacgtagccacgaccggtgctcgatttagtgctatagacttgggttggggggagaggagccccagccttgggatccccaagtgttttcattcagtgatcaggactgaacacagaggactcaccatggagttcgggctgagctgggttttccttgctgctatacttaaaaggtgtccagtgtgagtgcgagggtggtggaggtcgtgggggacgtccgttagggtaaacggtcccggtggggggtcccttaaggtacggttcctccgttgtggtcggccttcgtggtacttctactttctaagtaatggtacgtggtaagtggtaggttcggggtccgccgtacggccgtacggacgggggtaacgggggtcgttaggggtagggttcggggttacggtaaacggtttaacgtaaaaaaggttaaaacgtaggtaagtagggtaagaaaggtaaaaagtacgtaacggttacggtacgaccgtaaacccggtaaggaaaacggtaaagtaccgtaaccgtaacctacgttaccgtaacgaaaggtagtaaacttaacgttaaaaccgtaaaaccgggtacgggtttaagtttaacggttaacgtaaactaaaagttcgggaaaaacctacggtaaccccgtaaaggaaaacccggtaagaccctaacgtaccgtcgttaaccgtaactttaccgtaaccgtaaccctaagtacgtaacggttcggtaacgttacgaacccgttaaagtaacccggaaacgggttaaaggacggtacttaggttaccggttctttaaggacgttacggtaccgggtacggggtaccccaaggggtaacttggtcccgg

SEQ ID NO: 113767 - DNA, 924 bp, Homo sapiens
  misc_feature: GYAE6OF01DY2ZO.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtggggagtccgttagggtaaacgccggtcggggggttccccttaggtacgttcctcccgtggtggtcggcccttcgtggtacttcctacttttcaagttaagtgggcgttggagtggtaggttcgggtcccgccgtaggccgtaccggaagggggaacgggggtcgtaggggtagggtttgggggttacgggttaacggttttaacgaaaaaaggttaaaaagtggtaagttagggtaggaaaacgtaaaagtaaggtaaccggtacggtacgtacccgtaacccggtaaggaaaaggaagtaactaccgaaccctatacctaacgaaagaaggtaaacttaaacgttaaaccgaaaaacgggttacggttaagtttaacgtttagtaaactaaagtaacgtaaaccgaccggtacccgtaaacggtaaaaaccccggacggtaaacccaacccggtaaccggtacccgtttaacccgttaaacgtttacccgttaaccgtaaacccccgtaacgtaaacggttaacggtttaaccgggaaaggttccgtaaccgtaaacggtttaaccgggaaaccgggttaaaaaggggtaccggttaaccgtttaaggttccggttttacgtttttaaggtaaacgtttaaccgggttccccgggttaaaccggggggaccccccgtaaaggggtaaacggttaaccgggtttccggggg

SEQ ID NO: 113768 - DNA, 919 bp, Homo sapiens
  misc_feature: GYAE6OF01C70E0.15.86.H09.1.454.CMB.1.raw
tcagtctacgtagccacgaccggtgctcgatttagtgctatagacttggggtttggggggagaggagccccagccttgggatccccaagtgttttcattcagtgatcaggactgaacacagagactcaccatggagttcgggctgagtcgttgggttttccttgctgctatacgttaaaggtgtccagtgtgagtgcgtaggtggtggagtcggtgggggacgtacgttagggtaacggtccggttcgggggtacccttaggtcgttcctcgttggtacgtcggtccttgtcggtacttactaccttttacgaagttaaggtcggtcgtagggtacgttacggttacgggttccggggtcccgacggtaacggtccggttaaccgggaaggggggtacggggtcgttaaggggtacgggttcgggttacgggttaacgtttaaacgaaaaaggttaaaagttggtaaggttaggtaaaggtaaaagtaaacgtacggtacggttaacggtacgtaccgtaaaccggtaaggaaacggtaaccgtactaccgtaactacgttaccgtaaacgaagtaacgtaacgttaaaccgtaaaccgtaaaacggtggttacggtttaacttaacgaacgtaaaacgtaccgggaaacctacgggtaaacccgtaaagggaaaaaccccggtgtaaacccgtaacttaccggggtacctttaacgttaaccgttaccggtaacggtaccccaaaagggttccggtaaaggtttccgggtaaacgtctaacccgggttaacgttaaccggggaaaacgttaaaggggtcctttaaacgttggtttacccgttaacggtttacgaacgggtttccggtaaccgggggtaccgttaacccggggaaggtgttaaacgggtttccccgggg

SEQ ID NO: 113769 - DNA, 632 bp, Homo sapiens
  misc_feature: GYAE6OF01B0OE8.15.86.H09.1.454.CMB.1.raw
  modified_base (430)..(430): a, c, t, g, unknown or other
  misc_feature (430)..(430): n is a, c, g, or t
  modified_base (478)..(478): a, c, t, g, unknown or other
  misc_feature (478)..(478): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatggtaggttcgggtccgccgaggctccgaggggaggggcgtgggaggtgggttggacgtttacgaaaagtaaaatgagtggtagaagaaaatagacgtacggtgacacccgtagaaaggaagtattacacatctacaaganataatacaaaacgtcggtatattgataatgaacagacctagaaaccgngaaccacgagccgtatacttactacgtaccacgtaagtagttacggaagttagaccgtaagtaccggaaacggtaaagggacggtacttaagttcggttactttttaggaattacgtcgggtacgggggaccccaaggggtacaaggttccggg

SEQ ID NO: 113770 - DNA, 856 bp, Homo sapiens
  misc_feature: GYAE6OF01ERSAV.15.86.H09.1.454.CMB.1.raw
tcagtctacgtagccacgaccggtgctcgatttagtgctatagacttgggtttgggggagaggagcccccagccttgggatcccccaagttgttttcattcagtgatcaggactgaacacagaggactcaccatggagttcgggctgagtcgttcgggttttccttgctgcttacttacgttaaaaggtcgtcctagtggtggtaagtgcgagggttggtggtaggtcggtgggggacgtccgttaggtaaacggccggttcgggggttcccttagtacggttccttccgttggtcgtcggtccgttcgtggtacttcctacgtttcgaaggttaagtcggtcgtaggtagttggtaacgggttcggggtaccccggcccgaacgggtccgtaccggggaaggggggtaacgggggtcggtggggtaggggttcgggggttacgggttaacggtttaaacgtaaaaaggttaaaaagttgtaaggtaggtaacgaaaggtaaaagtaacgtacgtaacggtacggaccgtaacccggtaaggaaaaggaacgtaacgtaccaaacgtactacgaacgtaagtaagtaaactttaacgtaaacgaaaacggttacggtttaagttaagtttaacaagtaaaacgtacgtaaaaccgaccggttaaaccgaaaccggtaaaaccggacgtaaccgaaccgtaaccgtcccgttaacttaattaccgtaacgtaaccgaacgtaaggtacgttaacggttaagccgtaacgtggttaacggtaaacggtaaaggtgtaccgttagttctaggttttacagttaccggtcgggtaccggacggtaacggtgtcgttcggg

SEQ ID NO: 113771 - DNA, 787 bp, Homo sapiens
  misc_feature: GYAE6OF01BIHJL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttagggtaaacgccggttcggggggtacccttaggacgtcctccgtggtggtcggcctcgtggtattctacttcagtatcggctggatgtagttcgggccgccgaggtctaccggaggggacgggcgtagggaggttggggttcggtaacggtttacgaaaaagttaaaagtgtaagtaggtagaaacgtaaaaagtacggaacgtacggtacgaccgtaacccggtaaggaaacggaagtactaccgactactacgtacaagaataagtaacgttaaaccgaaaacggtcggtttaataagttttacgaaactaaacgtagaaacctacggtaaccctaaacggaaaaacccgggacgaacccaaccgacggtacccgttaattacttaaccgtacgtaacccaacgtaaggtacgttaacggaagtcgtaactaacggtaacggtaaagggtaaaaccgggtcgttaagttacgtttaccggtttgttttaacggaagtttacccggttacggggtaccgggaacccccgggtaaagggtaaccgttaaccgggttccgggg

SEQ ID NO: 113772 - DNA, 870 bp, Homo sapiens
  misc_feature: GYAE6OF01C7C02.15.86.H09.1.454.CMB.1.raw
  modified_base (228)..(228): a, c, t, g, unknown or other
  misc_feature (228)..(228): n is a, c, g, or t
  modified_base (731)..(731): a, c, t, g, unknown or other
  misc_feature (731)..(731): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctattacgttaaaaggtgtccagttgtagaagtgcgagggtggtggagtcggtagggggacnccgttaggtaacggtccggtacggggggtcccttaaggtcgttccgtccgtggtcggtcgggtcccttggttagggtactttctaccgtttacaaggttaaggtcggtcgtagggtacttggttacgggtttcggggtcccgacgtcggcccgttacccgggaaggggggtacgggggtaccgttggggtacggggttttacgggggttacggggtaaacccggttttttaaggtaaaaaaaggttaaaacgttaggtaaggttagggtaagtaaaggtaaaacgttaggtaacggttacggtacgacccgtaaacccgggtaaggaaaaggtaagttaccttactaaccctgtaaccaacgaaaggtaagtaaacgttaaacgtttaaaccggaaaacggttcgggtttaaatttacgtttaacgaacgtaaaagtcggtaaaccacgtaccgttaaaccgggaaaacggtaccgactaccggacgtacccgttaatttaanacccggttagaaccgtacttaggtaccgttaggaacgtcgaacggtaaccgtacgggaaaccggtagggtactggttattcgttaggtttacgtacgcgttaccggggacggtacgtaaagggcgttaggttcccgggg

SEQ ID NO: 113773 - DNA, 722 bp, Homo sapiens
  misc_feature: GYAE6OF01EWIOJ.15.86.H09.1.454.CMB.1.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (339)..(339): a, c, t, g, unknown or other
  misc_feature (339)..(339): n is a, c, g, or t
tcagtctacgtagccacgaccggtgctcgatttagtgctatagacttgggtttggggtccactggggcagtctcgaatagagctcttggaagtccctccaaccatggcctgggtctccttctacctactgcccttcattttctccacaggtctctgtgctctgcctgtgctgactcacgcccccgtntgcatctgccttgcgtgggacncctcgatcaagctccacctcgaccacccgtaagtagtcgagcataccgaacctaacaccatacgaatggtactacaaacagaacgaccgagggaaccctcccccagtataactaagtaagaaagttaagngtagagtggcacgaccacgaacggaacggggaccggaactcccgaatccgtctacgagtcggtctccgtacggtcgtaggggctccggacccgtccgtaccacccgtaccctacgtccctacccgtaaccctaccgacgttccacggtacgtacgtgggaacgtgtacggtaacgtttaccgacgtacgttcgggaagggaacggacggaccgtaccctaacggtaacttaaggtcggaacggttaccgggaacggtaacggggtttacgggggtttaccgggggttacggttccgggggaaccggggaaccgggaaacctaacgggttccccgggtaccggtacccggttaaccccgggttggaaccccgggtaaccccggg

SEQ ID NO: 113774 - DNA, 681 bp, Homo sapiens
  misc_feature: GYAE6OF01EGMVN.15.86.H09.1.454.CMB.1.raw
  modified_base (409)..(409): a, c, t, g, unknown or other
  misc_feature (409)..(409): n is a, c, g, or t
  modified_base (524)..(524): a, c, t, g, unknown or other
  misc_feature (524)..(524): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcttgggtttttccttgctgctatacttaaaggtgtccagtgtgaagtgcagggtggtggagtcgtggggggagccgttagggtaaacggccggttcgggggggttcccctttaagggacgttccgttcccgttggttggttcggtcccttcgttggtatttcctacttttcaggttaaactgggcttggagtgtaggtttggggtacccgccgaggccgtccgaggggaaggggcgtgggaggttggggtggtacgttanaaaagtaaatgagtaggtagaagaaagtagacgtacggtgacgaccgtaggaaggaatactacacatctacaagatataactaacgaaaacgtacggttagtatttagactaaanacgtaacacgtacctaggaaaaccgacgacacgagaccttctaattacctacgaaccagtagtagttacggatacgacgagtcggtaacgtaaagggacgtcgttagtcgttactttgattacgtcggacggtaccggacgggtagtacggttcggg

SEQ ID NO: 113775 - DNA, 798 bp, Homo sapiens
  misc_feature: GYAE6OF01AINUA.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccagtggagttcgggctgagtcgttgggttttccttgctgcttatacgttaaaggtcgtccagtgtgaagtgcgaggtggtgggagtcggtgggggagtccgttagggtaacggtccggttcggggggtacccttaggtacgttcctccgtggtcggtcggtcctcgtaggtacttcgtactttcgaagtagtggtcgtaggagttggtacggtcgggtacccgcgacggtccgtaccggagggggagggtcggtagggtaggttgggttacggtaacgtttaaagtaaaaggttaaaaggtgtaaggtaggtaagtaaagtaaagtacgtacggtaacggtacgaccggtaaccggtaaaggaaacggtaacgtacttaacccgaactaaccgtacgtaaacgtaaagtaacgttaaacttaaacggtaaaccgtaaaacggttacggttaagttacgtaagaaactaaaggtcaaacgtaccgtaaccgaaacgtaaaccggagaaccctacgtccgtactaaccgttacttaaccagtacccgaagtacgtaggttaaccggataccgtatacggtaacggtaacggtaaggtacgtacttaggttacgttagtttacgacgtttacggtaccgggtaccgggaagtacgggtaactggggttaccg

SEQ ID NO: 113776 - DNA, 692 bp, Homo sapiens
  misc_feature: GYAE6OF01CBKN1.15.86.H09.1.454.CMB.1.raw
  modified_base (632)..(632): a, c, t, g, unknown or other
  misc_feature (632)..(632): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctgggttttccttgctgctatacttaaaaggtgtccagtgtgaagtgcgaggtggtggagtcgtgggggagtccgttaggtaaacgcccgtggggggtcccttaggagttcctcctggtgtggccttcgtggattctactttcagtaagtggctggatggtaggttcggggtcccgaccgaggcctaccggaggggaaggggtcgtagggtggttggggttggtaacgtttaacgaaaaagtaaaagtgagtagggtagaaagtaaaagtagacgtacggtacgaccgtaaccgtaggaaaaggaacgtactaccaccgtatactacgaaagtaagtaataacttaacgaaaaagtacggttaagttaagtttacgaactaaagtacgaaacacgacgtaaggaaaaccgagacctaacgacgtacctaatacttactacgtaaccagtagtagttacggaagtcgacagtacggtaaagaagggngtactagttacgttgtttagattagtaccggaccggggaccacgggtactaaggttcggg

SEQ ID NO: 113777 - DNA, 684 bp, Homo sapiens
  misc_feature: GYAE6OF01BSOWP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccgaggctccgaggggaagggggcgtgggaggtgggttggacgtttacaaaaaggtaaaatgagtggtagaagaaaatagactacggtgacacccgtagaaaggaagattacaccatctacaagagtataatacaaaacgtcggttagtatttagacaaagtagaaacacggacctaaggaaaaccgaaggacaaccgacgtacccgttacttaattaacgtacgtaacccacgtaagtacgtttacgggaaagtcgaacctaagttaccggaaacgggtaaaagggagggtacccttaagttcggtttacttttttaggaatttaacggttccggttacggggggaacccctaacgggggtaacctaaagggttcccgggg

SEQ ID NO: 113778 - DNA, 843 bp, Homo sapiens
  misc_feature: GYAE6OF01ES6F3.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagagactcaccatggagttcgggctgagcgttgggttttccttgctgctatacttaaaaggtgtccagtgtgaagtgcgaggtggtgggagggtcggggggacgtccgtttagggtaaacggtccggttcggggggttccccttaaggtacgttccgtcccgttggttcggtcggtcccttcgtggtactttccgtacttttacgaagttaagtggtcgtggtagtggtacggtttcggggtcccgaccgtacggtccgtaccgggagggggtaacggggtcgtaggggtaggttggggttacggtaacgttttaacgaaaaagttaaaagtggtagtaggtagaaagtaaaagtaggtaacgtacggtacgaccgtaaccggtaggaaaaggatacgttacccaactacgttaccgtaacgaaacggtaagtaaacttaaacgttaaaccggtaaaacggtacggtttagttaaccgtttacgaaacttaaaacgtaacgaaaccgtacggtaacccgtaaacggtaaaaccggtcgtaaaccgaaccgtaccggtacctttaactaacgttaaccgtacgtaaccctaagtacgttaacgttacggaacgtcgaacgtagtaacggaaacggttaaggacgttacgttacgttagtttacgtttacgacgtttaccggtccgggtacgggtaccccgtagggaaccttaggttcgggttacccg

SEQ ID NO: 113779 - DNA, 846 bp, Homo sapiens
  misc_feature: GYAE6OF01DI3VF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcggctgagcttgggttttcctgctgctatacttaaaggtcgtcagtgtagagtgcgtagggtggtggtaggtcggtgggggacgtccgttagggtaaacggtccggtacgggggttacccttaggtacgttccgtccgttggtcggtcggtccttcgtaggtacttcctacttacgaagttagtggtcgtaggtagttggtacggttcggtcccgacgacggtcgtcggaaggggtacgggtcgtgggtaggttcgggttaggtaacgttaacgaaaaagtaaagtagtaagtaggtagtaaagtaaaagtagtaacgtacggtacgtaccgtaacccggtaaggaaacggtaaacgtaccgttaccgaacccgtacttaacgtaacggtaaacgtaaagtaaacgttaaacgtaaaaccggtaaaaacggttaccggttaagtttaacgttaacgtaaagtaaacgtaacgtaaacgtaccggtacccgtaaaaggtaaacccggaacgaacgtaacggtaccgtaccgttaacgtttaacgttaaccgtaccgtaaacctacgtaacgttaacggttaacggtaagtaccgacgtaaacgttaaccggaaacgggtaaaggaccggttacgttaagtttcggtttagtttaagtacggtttacggtaccgggtaccgggaccgggtaacggtacgtagttcccggg

SEQ ID NO: 113780 - DNA, 957 bp, Homo sapiens
  misc_feature: GYAE6OF01C8KGW.15.86.H09.1.454.CMB.1.raw
  modified_base (216)..(216): a, c, t, g, unknown or other
  misc_feature (216)..(216): n is a, c, g, or t
  modified_base (278)..(278): a, c, t, g, unknown or other
  misc_feature (278)..(278): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtggggganccttaggaagccgtgggggtcccttagagtctcctggtgtggcctcgtggattctacctttnaagttaagtgggtcctagggagttggttaacgggttcggggttacccggcccgaagggtcccgttacccgggaaaggggggtaaacggggggtccgttagggggtacggggtttgggggttttacgggtaaaccggtttttaaccggtaaaaaaagggtttaaaaagtagggtaaacggttagggtaacggaaaaaggtaaaaagttacggtaaaccggttacgggttacggtacccgtaaaccccgggttaaggtaaaaacggggtaaacgttacgtttacccggaaaccctacgttaacccgtaaccggaaaggtaaacgtaaacgtttaaacggttaaaaccgtaaaaaaccgggttccgggtttaaggttaacgtttacggtaaacctaaaggttaacgtaaaaccgacgtaacccggttaaaccggaaaacccggtaggaaccctaaccgtaacggtacccccggttaatttaacgtttaacccgtaacggttaacccctaaacgtcggttaacgttacggtaacgttccgaaccgtacgggttaaaccggaaacgggttaaagggtaaccgggtcgtttaacgtgttttaaacccggttttaggaacgtttacggttacccggggttaccggggacccggttaaaacggggcgttaacgggtttaacccgggg

SEQ ID NO: 113781 - DNA, 652 bp, Homo sapiens
  misc_feature: GYAE6OF01BDPRO.15.86.H09.1.454.CMB.1.raw
  modified_base (286)..(286): a, c, t, g, unknown or other
  misc_feature (286)..(286): n is a, c, g, or t
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
  modified_base (445)..(445): a, c, t, g, unknown or other
  misc_feature (445)..(445): n is a, c, g, or t
  modified_base (489)..(489): a, c, t, g, unknown or other
  misc_feature (489)..(489): n is a, c, g, or t
  modified_base (550)..(550): a, c, t, g, unknown or other
  misc_feature (550)..(550): n is a, c, g, or t
  modified_base (643)..(643): a, c, t, g, unknown or other
  misc_feature (643)..(643): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttcctgctgctatacttaaaaggtgtccagtgtgtaagtgcgtaggtggtggagtcggtgggggatccgtttaggaacgtccggttgggggtacccttaggtacgtctcctggtggtcgccttctaggtnttctcttgagtaagtggcgtggagtgtggtccggtcgcgnggtccgtccggaaggggaacgggngtagggtaggtgggtggtagttaacgaaaagtaaatgtagtagtagtaaagaaagtacgagtacgtagcgaaccgtagaagagtactacacctantaacgagagtaataattaacaaacggttagtagttactagtaanaaagtcgtaaccacggtacgaaaccgaaacgacggaacacgtaaccggtctaccgtttaanaaccgtacgaaccagtaacgtagtacgtacgcagtacgtacgtaagggtagtgtagtcttggttctagtacgtcgtccgggtcgaaccggtancggtggtcg

SEQ ID NO: 113782 - DNA, 882 bp, Homo sapiens
  misc_feature: GYAE6OF01ATKBX.15.86.H09.1.454.CMB.1.raw
  modified_base (180)..(180): a, c, t, g, unknown or other
  misc_feature (180)..(180): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtntccagtgtgaagtgcgaggtggtggagtcgtgggggatccgttaggtaacgccggtgggggtacccttaggacgtcctccgtgtggtcggcctgtggtacttctacttttcgaagttaagtggcgtggatggtacggttcgggtccgccgtaacggtccgtaccggaaggggggtaacggggccgttagggtacgggttggggtttacgggtaaccggttttaaacgaaaaaaaggttaaaaacgtagggtaagttacgggtaaaggtaaaaggtaaaaaacgtacggtaaccggttaacgggtacgacccggtaaaccgggtaaggtaaaaacgggtaacggttaacttaaccgtaaccgtaacgttaccgtaaacgtaaacgggtaaagttaaaactttaaacgttaaaaccggtaaaaaaccgggttaacgggtttaacgttaaacgttttaacggaaacttaaaaggtaacgtaaaaccgacggttaaccggtaaaccggaaaaccgggacgtaaaccgaaccgtaacgtacccgttaactaacgttaccctacggaacccctaagtaacgttacggtaaaggtacggtacgtaacctaggtacggaaaccggtaaaggggcgtacgttagttacgtttcgtttaggacttacgggtaccggaccgggggtaacccaagggtcgtaaacggttccggg

SEQ ID NO: 113783 - DNA, 1092 bp, Homo sapiens
  misc_feature: GYAE6OF01A4LFT.15.86.H09.1.454.CMB.1.raw
  modified_base (187)..(187): a, c, t, g, unknown or other
  misc_feature (187)..(187): n is a, c, g, or t
  modified_base (949)..(949): a, c, t, g, unknown or other
  misc_feature (949)..(949): n is a, c, g, or t
tcagtctacgtagccacgaccggtgctcgatttagtgctatagacttgggtttgggggggagaggagcccccagccttgggatcccccaagtgttttcattcagtgatcaggactgaacacagaggactcaccatggagttcgggctgagtcgttgggttttccttgctgctattacgttaaaggtntcagtgtagagtgcgaggtggtggaggtcggtgggggacgtccgttagggtaaacggtccggttcgggggggttaccccttaaggtacggttccgttcccgttggttcggttcgggtcccgttcgttgggtaactttccgttaacctttttaccgtaaggttaaagttcgggtcgttagggtaagttggtaagggtttccgggggtcccggcccgaacggggtccgtaccgggaagggggaacgggggtcggttaggggtagggttggggtttacgggttaaccggttttaaacgtaaaaaaggttaaaagttggtaaggttaggggtaaggtaaaagtaaaaacgttaacggaaccgtttaaacgggtacggtaacccgtaaaccccggttaaagggaaaaacgggtaaagttaacgttaacccaacccgtaagttaccctaaacggaaaagtaaacgtaaacgtttaaaacgttaaccggaaaaaaaccggtttacgggtttaagttttaaacgtttaacggtaaaaccgtaaaaagtacgaaaaaccggtacccggtaacccgttaaaaaccggggaaaaaaccccggagggtaaacccccgaacgttaaccggttaccccggtttaaactttaaacgttttccccgttaaacccggttaacccgaaaggttaaacccgggtttaacgttaacccgggggaaacgtttcgaacccggtttaaaaccgggtaacggaaaacccgggggtttaaaaagggngggtttaaacccttttaagggttaccccggttttttaggtttttaaaccgggtaagtttaacggggttacccccggggggtaacccggggggtttaaacccaaaacgggggtttaaccgtttaaaccggggttttcccggggg

SEQ ID NO: 113784 - DNA, 774 bp, Homo sapiens
  misc_feature: GYAE6OF01DMOUH.15.86.H09.1.454.CMB.1.raw
  modified_base (183)..(183): a, c, t, g, unknown or other
  misc_feature (183)..(183): n is a, c, g, or t
  modified_base (604)..(604): a, c, t, g, unknown or other
  misc_feature (604)..(604): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagtcgtgggtttttccttgctgtctatacgttaaaggtntccagtgtgagtgcgaggtggtggagtcggtggggacgtccgttagggtaaacggtccggtcgggggttcccttaggtacgttcctccgtgtgtcgtcctcgtggtatttctactttacgtaagtaagtcggcgtggtagtggttacggttcgggccgaccgaggccgtaccggaggggaaggggtcgtgggtagggttgggttacggtaacgtttaaataaaaagtaaagtgtagtaggtaagaaagaaatacgtacgtacggtacgaccgtaaccggtaaggaaagtaagtactccgaactatacgaaacgaataaacgtaaacttaaacgtaaccgtaaaaacgggtcgttttaagttaaccgtttaagaaacttaaaagtaacgaacggtaacgtaacccgaaacgtaaaacccggngaaccctaaggtacccggttaccttagttttaacaacccgtttacgaacctaaggtagtacctttaggggaattcgaacgaacgtacgggaaacggtaaggcttacgtaggtttcttaggtttacgagttcggaccggtacgggacccgtaagggtctgggtttccccgg

SEQ ID NO: 113785 - DNA, 906 bp, Homo sapiens
  misc_feature: GYAE6OF01B3I3V.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacaggaggactcaccatggagttcgggctgagtcgttggttttcctgctgctatacgttaaaggtcgtcagtgtagagtgacggaggtggtggtacgtcggttaggggcgtaccgttagggtaaacgtccgggttacggggtaccttaggtacgtcgtccgtggtacgacgtccgttcgtaggtacttacaccgtttagactacgttaacttaggttggtagttcggttaccggttcggtaccccgtacggaccggtaccggtacgggaggggtaacgggggtcgtagggtacgggtcgggtccggaacctaaccgaaagtaaaacggaaatacgggtaggtaaacgtagaaccaaccgttaacgttaggtaacggttctaaacccggttggtaacggttaggtaacggttaccggtaccgtttaaaccgtcccgggttaaccccgttaccgtaacccggtaacggggaacccgaaccggtaacccgaaaccggtaaaccgttaccccgtaacccttaaacgttaccctaaacgttaccggtaaccggttaaacccgaaacgttaacccgggtaaaaaacccttcggaaacgggtaccggaacgggaaacccgggacgggttaaacccgtcgggttacgtaacggtttagttaaacggtttggtttaccggaagtacggagttacggttaccgttcgggtacgtcggggtcggggttaacccggtcggaacccgggtttactaccgggttaccgtacccgtcctttccgacccggtaaccgtaccccgg

SEQ ID NO: 113786 - DNA, 808 bp, Homo sapiens
  misc_feature: GYAE6OF01BDVX9.15.86.H09.1.454.CMB.1.raw
tcagtctacgtagccacgaccggtgctcgatttagtgctatagacttgggtttgggggggagaggagccccagccttgggatccccaagtgtttcattcagtgatcaggactgaacacagaggactcaccatggagttcgggctgagcttgggttttccttgctgctatacttaaaaggtgtccagtgtgaagtgcgaggtggtggagtcgtggggtagcgttaggtaagccggtgggggtaccttagagtctccgtgtgtcggcctcgtggtacttctactttcgaagtaacgtggtcgtggagtggtaggttcgggtccgccggtaggccgtaccggacggggaagggtcgtagggaggtttgggttacgggtaacggttttaaacgaaaaaggttaaaaagtgggtaagtagggtaagtaaaacggaaaagttacggtaaccgtaacggttacgaccggtaaacccggtaaggaaaacggtaacgtaagtacccaaccgtacgtaactacgtaaagaagtaacgtaaacgttaaacccaaaaagggttccgttattattacggaactaaagtaccggaactaacgaccgtaaacggaaaaccgtagggaaccctaaggacgtaacccgtaacttaacgttccctaaacgtacccagtaaaccggtagttaacccgggtaagttacgccgtaaacgttaccgggaaacggttaaaacggtcgggtaacttaagggtcgttaccgtttagtaacccttaggtccggggttaaccgggacccgggttagggaacccttaagggttcgg

SEQ ID NO: 113787 - DNA, 787 bp, Homo sapiens
  misc_feature: GYAE6OF01AGJNS.15.86.H09.1.454.CMB.1.raw
  modified_base (161)..(161): a, c, t, g, unknown or other
  misc_feature (161)..(161): n is a, c, g, or t
  modified_base (221)..(221): a, c, t, g, unknown or other
  misc_feature (221)..(221): n is a, c, g, or t
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
  modified_base (710)..(710): a, c, t, g, unknown or other
  misc_feature (710)..(710): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgacgcgtcggtttcgtnacgtgctatacgttaaagtcgtccgagtgtagaagtcgcgtagggtggtcggagttcggnggggacgtccgttagggtaacgcggttacgggggttacccttaggtacgttccgtcgtgtcggtcggtcctcgtacggtcttactacgtttcgagtaacgtgtagtggtattggtcggttcggccctacggtacggtccggtacggaaagggggtcgggtcgtcgggtaggttacgggttagtaaaccgttttaaagaaaaacgtttaaagtggaaccggttaggaacggtaaaacgtaagtaccggtaacggttacggcgtaccgaaacccggttaaggaaagaacggttacgtaccaccgtagtacccgtaanaaggtaanaacgttaaacaaggttaaccgtagtgttaatcgaaataacacgaacgaacgttacccggaaacgaacggctaacgacgtaacgttacgaacttacctaagtaacctacgagttaacggacgttcgaacggttaaaccggcggtaaacccgtaggtaacgttaacgngttagttaccgtttacgttaagtaaccgtttaccgacgggttacgggtaacccgtaggttacgtaaccggttccggg

SEQ ID NO: 113788 - DNA, 774 bp, Homo sapiens
  misc_feature: GYAE6OF01BFPRX.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccctagagtctcctgtgtcggcctcgtggattcactttcagtaagtggctggagtggtaggtttcggggtcccgaccgaggccgtccggagggggaggggcgtagggtacggtggggttacgggtaacgttttaacgaaaaaggttaaaaagtggtaagtagggtagaaaggtaaaaacgtaggaaccgtaacggtagacccgaacccggtaaggaaaacggaagtactttaccaacctatactaacgaaagagtaattaaacttaacggaaaaaccggtacggttagttaagtttacgaaacgtaaaatacgaaaacacggtaccctaaacgggaaaacccgacggaaccaacccggacgtacccggttaactttaacgttaccgtaacgtaacccaagtacgtacgttacggaaggttcgacctaagtaccggtaaaacgggtaagggtacggtactttagttacggttacgttttacgatttacggtccgggttaccggggacccgtaagggtaacgtacgggtttcggg

SEQ ID NO: 113789 - DNA, 776 bp, Homo sapiens
  misc_feature: GYAE6OF01CJIUN.15.86.H09.1.454.CMB.1.raw
tcagtctacgtagccacgaccggtgctcgatttagtgctatagacttggggtttggggggagaggagccccagccttgggactccccaagttgttttcattcagtgatcaggactgaacacagagactcaccatggagtcgggctgagtcgttcgggttttcctgctgtctattaacgttaaaggtcgtacgagtgtagaagtgcgtaggtgggtggaggtcggtggggcgtcgtaggtaacgcggttcggggtcctagtctctcgtgtgtcgtctgtgtcttctacttatagtagtgtcgtgtagtggtaggttcggtccgccgcggcgtacggaggggagggtcggtgggtaggtagggttaggtaacgttaaacgtaaaagtaaagtagtagtaggtaagaaagtaaagtaagtacggtacggtacgaccgtaaccggtaaacggtaaaggtaaccccccccgtaatacctaacgtactacgtaagtaaagtaagtaaacgtaaacgttaaacgtaaaacggttaacggttaagtttaagttaacgtaaacgtaaacgtaacggtaaaccgtacgtaaccgtaaacggaaaccgtaacgaaccgaaccgtaccgtaccgttaacttaacgttaacgtacctaacgaacgtaaggtacgttaacggtaacgtacgtactaggtaacggtaaacggtaacggtacgtacgttagttcgtttagttacgtacgttacgtaccggtacgggtaccggaacggtacgtacggttccgg

SEQ ID NO: 113790 - DNA, 828 bp, Homo sapiens
  misc_feature: GYAE6OF01BG3GO.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtccagtgtgaagtgcgaggtggtggagtcgtgggggagtccgttggtaaacgccgtgggggtacccttagagtctccgtgtgtcggcctcgtggtacttcctactttacaagtaagtcggtacgtaggattggtacggtttcggggtcccgaccgtagggcccgttacccggaaggggggtaacgggggtccgttaggggtaggggtttagggggttttacgggttaaccggtttttaaaccggtaaaaaaaggtttaaaaaacgtgggtaaacgttaggggtaagtaaaaggtaaaaataacggtaaccgtaacggtacgaccgtaaacccggtaagggaaaacggaagtaactttacgaccctacgtaccgtacgaaaggtaacgtaattaaacttaaccgaaaaacggtacggttagttaacgtttagaactaaaagtcgaaacgtacggaacccttaaaggaaaaccgtacgaaccaacgtacgtaccgtaaacctttagtaacctaaccgtaaccaacgtacgttaacgttacggaacgtcgaactaaggtaaccggtaaagtaaacgggtgtaccttagttagttccgtttagacgttacgttccgggtacgggaccctaagggaacgttaggttacccggg

SEQ ID NO: 113791 - DNA, 977 bp, Homo sapiens
  misc_feature: GYAE6OF01EQJYJ.15.86.H09.1.454.CMB.1.raw
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagcgttgggttttccttgctgctatacgttaaaggtgtccagtgtagaagtgcgagggtggtgggagtcggtagggggacgtccgttagggtaaacggccggttcggggggttcccttaggtacgttccttccgttggtggtcggtcctcgtggtacttcctactttcgaaggttaagtcggtcgttaggacgttggtacgggttcggggtacccgaccgtacgggtccgtaccggggaaggggggtaacggggtcggtaggggtaggggtttagggggtttacggggttaaaccggttttaaaaggtaaaaaaggttaaaaacgttgggtaaaggtttaggggtaaaggtaaaagtaaaaacgttacggaaacgttaaccgggtacggtaacccggaacccgggtaaaggaaaagggtaacgttaacgttacccgtaactaacgtaccgtaacgtaaacggtaaagttaaacgtttaaaacgttaaaccgaaaaacgggttcgggtttaaagtttacgtttaacggaaactaaaacgtaaccggtaaactaaccggtaaccgtaaaaccgggaaaacccggtaagaacccgtaaccggtaaccggtaccccgttaacttaaacgtttacccgtaaacccgttaaccgaaccgttaaacggggttacgttaaaccgggaacggttacgaaccgttaaacggttaacccgggtaaaacgggtaaagggtacggttaacctttaggtttaccgtttacgttttaaggtaacttacgggtttaccccgggggacgggtaaccccggggtaacggtaagtccggggtttaccgg

SEQ ID NO: 113792 - DNA, 758 bp, Homo sapiens
  misc_feature: GYAE6OF01BDQSU.15.86.H09.1.454.CMB.1.raw
  modified_base (466)..(466): a, c, t, g, unknown or other
  misc_feature (466)..(466): n is a, c, g, or t
  modified_base (554)..(554): a, c, t, g, unknown or other
  misc_feature (554)..(554): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtccagtgtgaagtgcaggtggtggagtcgtggggagccgttggtaaagccgtgggggtccttagagtctctgtgtggcctctggtattctactttcaagtaagtggtctggatggtaggttcgggtcccgccgacggtcctaccggaaggggaacgggggctgggtaggttggggttacgggtaacgttttaacgaaaaaagttaaaaagtggaagtagggtagaaagtaaaagtagacgtaaggtcgacgaacccgtagaaaagaagtacttacaactatctaanaaagagtaataaacttaacgaaaaacgtcggttagttaagttacgaactaaaagtacgaaacacggaaccctaaaggaaaaacccggnggtaaaccaacgtaaccggtacccgttattaaccgttaacctaacgtaaccaagtaacgtaacgttaccgggaagtcgaacgtaacgtaaccggtaaaacggtaaaaggtacggtacttaagttcggttaactttttacggaagttaaccggttccgggtacccgggggaaccccgtaaaggggtaaacctaaaggttcccggg

SEQ ID NO: 113793 - DNA, 801 bp, Homo sapiens
  misc_feature: GYAE6OF01D2D9V.15.86.H09.1.454.CMB.1.raw
  modified_base (502)..(502): a, c, t, g, unknown or other
  misc_feature (502)..(502): n is a, c, g, or t
tcagtctacgtagccacgaccggtgctcgatttagtgctatagacttgggtttgggggagaggagccccagccttgggactccccaagtgttttcattcagtgatcaggactgaacacagagactcaccatggagttcgggctgtagcgttgggttttccttgctgctatacgttaaaggtgtccagttgtagaagtgacgtaggtggtggagtcggtggggacgtcgttaggtaagtccggtggggtcccttaggtcgtcgtcgttgtcggtcgtacctgtagtacttccgtactttcaagtacgtggcgtaggtagtgtacgttccggggtccgacgtacggtccgtacggaaggggacgggtcggtaggtacggttcgggttaaggtaaccgttttaaagaaaaagttaaaagtggtaacgtaggtaagtaaagtaaagtacgtaacgtacggtacgaccgtaaaccggaaggaaagtaacgtaacttaccaacgtaanacctaaaggaagtaaacgtaacgttaaaataaaccgtaaacggttaacggtttaacgttaagtttcggaaaacgttaaagaacgtaaccggtaaaggaacccgttaaacggaaaacggtaacccgaataaccggaccgttacgttaacgttaacttacgtaaccgtaacgaacttacggtacgttaacggtagtacgtacgaacgtaccggtaaacggtaacggacgtacgttaggttagttccgttaggtactcgggttacgacccgggttaacggacgttacggtacgttcccgggg

SEQ ID NO: 113794 - DNA, 816 bp, Homo sapiens
  misc_feature: GYAE6OF01DMLDJ.15.86.H09.1.454.CMB.1.raw
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
tcagtctacgtagccacgaccggtgctcgatttagtgctatagacttgggtttggggggagaggagccccagccttggggactccccaagtgttttcattcagtgatcaggactgaacacagagactcaccatggagttcgggctgagtcgttgggttttccttgctgtctatacgttaaaggtcgtcctagtgtagaagtgcgagggtggtggngtcggtggggatccgttaggaacgccggtcggggtcctagtntctctgtgtcgctcgtgtacttctacttnagtatggcgtagntaggtcggttccgggccgaccgtacggtcgtaccgggaggggacgggtcggtgggtagggttcggggttacggtaacgttaaataaaaaggtaattagggagttaggtaagaaacgtaaagtaacgtaccgtacggtacgacccgtaaacggaaggaaaaggtactactaacactactactagaaagtaactaaacgttaataacggaaacggttagttacgttagtaacgtaaataaggtaacgtaaccgacggtaacctaaacggaaaaccggacgacctaaaccggacgtaccgttacgttaaactttaccgaacgttaacccgacgtaaggttaacggttaacggtactaaccggacccgtaaggtaaacggggaaacccggttaaaggccggtttaaaccttggtttacccgtttaaagtttttaacggacggtttaaaaccccgggttcccgggggaaaaccccgggtaggtaaaccggggttttaaacgaccccgggtttttcccggggg

SEQ ID NO: 113795 - DNA, 706 bp, Homo sapiens
  misc_feature: GYAE6OF01B8XQL.15.86.H09.1.454.CMB.1.raw
  modified_base (462)..(462): a, c, t, g, unknown or other
  misc_feature (462)..(462): n is a, c, g, or t
  modified_base (520)..(520): a, c, t, g, unknown or other
  misc_feature (520)..(520): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttaggtaagccgtcgggggtcccttagagtctccgtgtggtcggtcctcgtggtattcctactttacagttaagtggccgtggaagttggtaggtttcggggtcccgtccgaggtccgtaccccggaaggggaagggggtcgtgggtaggttggggttacgggtacgttttaacgaaaaagttaaaacgtaggtagtaggtaggaaagaaaagtagacgtacgtcgacacccgtagaaaggaanattacactatcgtacaagagaattaatacaaaacgtagtagttattagactaaagtanaaccgacgacctaacgaaaccgacggtaaccaacgtaccgaccgttacgttaacttacgtactaaccgaactagtaacgttaacgggaatcgactacgttacggaacggtaaagtacggtctagttaggttctttacggtaattcgggtacgtcgggggaaccctagggtaccgtagggttacggg

SEQ ID NO: 113796 - DNA, 846 bp, Homo sapiens
  misc_feature: GYAE6OF01BXRUP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaggtgtccagtgtgaagtgcgaggtggtggagtcgtgggggagtccgttagggtaaacgtccggtggggggtcccttaggtacgtcctccgtggtggtcggtccttcgtggtacttctacctttacgaagttaagtcggtcgtggtagttcggtaggttcggggtcccgccgtacggtccgtacgggaggggaacgggtcgtgggtaggttgggttacggtaacgtttaaacgaaaaaggtaaagtgtaagtagggtaagaaagtaaaagtacggtaacgtacggtacgtaaccgtaacccggtaaggtaaacggtaacgtaacgttaccgaacctacgttacgaacgtaaagtaacgtaattaaacggttaaccgaaaacggttcgggttaatttaacgttaggaaccttaaaagacggtaaacgtacggtaaccgtaaacgggaaaaccccggacggtaaacgtaccgtccgggttaacctacgttaaccggttaacgttaaccgaacccgtaaacgtaggttaaccggttacggaagtaccgagtaacgtaaccgggtaaacggtaaaccgggtgtaccgttaaggttacggtttactttaaggtacgtttacccgggtaccgggtaccggggtaaaccgcgggttaaaccttcggggttacccggg

SEQ ID NO: 113797 - DNA, 894 bp, Homo sapiens
  misc_feature: GYAE6OF01DO2XD.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagatggttttcctgctgctatacgttaaaggtcgtcagtgtagagtgcgaggtggtggagtcgtggggactccgttaggtaaacgccggttcgggggtcccttaggacgttcctccgtgtcgtcggccttacgtggtattccgttactttacgaagttaagtcggtacgtaggtagttacggtacggtttccgggcccggacctacgggtcccgtacccgggaaggggggaacggggtcgttaggggtagggtttaggggtttacggttaaaccgttttaaagtaaaaaaagttaaaagtaggtaagtagggtaaagaaagttaaaacgtaggtaaccgttacggtacgaccgtaaacccggaagtaaagggaactacgttaccaacgacttaccgaaacgtaaagtaaagtaaattaaaccgttaaaccgtaaaaaccggttcggtttaagtttaacgtttaaacgaattaaaacgacgtaaaaccgtaccggtaaccgttaaaaccggaaaccccgaagggaaccctaaacccgggccggttaaccccgtttaatttaaccgtttaaaccctaccgtaaaccggttaacgtaacgggtttacggttaaacgggtaacgttacggtaaccgtaaccgttaaaccgggtaaaggttaaacgtaacgggttacttacgttagtttaccgtttagtaacgtggtttacccggggaccgggtaccgaacgggttacgtagggtttaaccggg

SEQ ID NO: 113798 - DNA, 855 bp, Homo sapiens
  misc_feature: GYAE6OF01BA9YW.15.86.H09.1.454.CMB.1.raw
  modified_base (508)..(508): a, c, t, g, unknown or other
  misc_feature (508)..(508): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagcttgggtttcctgctgctatcgttaaaggtgtccagtgtgaagtgcaggtggtggagtcggtggggactccgttagggtaaacgtccggtcgggggttacccttaggtacgtcctccgtgtggtcggtcctgtggtattctactttcagtaagtggctaggagtggtagttcgggtccgaccgtaggtccgtacggaaggggaggggtcgtgggtagggttggggttagtacgtttaacgaaaaaggttaaatcggaagttaggagaaagaaatacgacgtacggcgacgtaaccgtagaaaggtaatacgtacaacctatacgaacgaagtaagtaacttaaacgttaacaaaacgggtnttaagttaagttagaaacgtaaagtacgaaaaccgtagtaaccccgtaaaggaaaaacccgacggtaaccgaacgttacggtaccccgttagttaaaccttaccggttaactaaacccggaacttaaagggttaaccgttacgggaaacgggttacgttaaacccgaaaggtttacccccggggtaaaacgggtttaaaaacgggacggttaaaacgtttaccggggttttaacggtttaaaccgggtttttaacggaaaccgttttaaccggggttaccccgggggtaaccggggtaaaacccccgggtaaacgggtaaccggtttaaaagggggtttcccccggg

SEQ ID NO: 113799 - DNA, 960 bp, Homo sapiens
  misc_feature: GYAE6OF01CY3B2.15.86.H09.1.454.CMB.1.raw
  modified_base (912)..(912): a, c, t, g, unknown or other
  misc_feature (912)..(912): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtccagtgtgaagtgcgaggtggtggaggtcgtggggacgtccgttaggtaaacggtccggttggggggtcccctttaggacgttccgttccgttggtgtccggtccgttcgtaggtaactttcctacttttacgaagttaagtgggtacgttggtaagttggtacgggtttcggggtcccacccggtaacgggtcccgtacccgggaagggggtaacgggggtacgtaggggtacggtttggggtttacgggtaaccggttttaaacgtaaaaaaaggttaaaagttaggtaaaggttagggtaagaaaaacgtaaaacggttaacgtaaccggttaccggtaacgaacccgtaaacccgggttaaaggggaaaaagtaaaccggtaagtttaccccaaacccgttaacgttacccgtaaacggaaaaacggtacgtaaaacgttttaaaccgttaaaaaccgggtaaaaaaccgggtttaccgggttttaaggttttaacgtttaacgggaaaacctttaaaacggttaacgaaaacccggtaacccgggttaaccccgtaaaaaccgggaaaaacccgggttaaccgaaacccctaaccggtaacccgggttaccccgtttaacgttaaactttacccgtaaccgtaaacccgtaacgtacggttacgttaaccggtagtcgaacctaagttacgaggtttaaacggaacggttgtagtttagtaggttntttaacgtagtacgtacgggtaccgggtacccgaaggtacggtaacgg

SEQ ID NO: 113800 - DNA, 878 bp, Homo sapiens
  misc_feature: GYAE6OF01CMFN1.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagtccgttagggtaaacgccggttggggggtcccctttaaggtacggttccttcccgttggttggtcggtcccttcgtggtactttctacttttcgaagttaagtggcgttggattggtaggttcgggtcccgccgtagggtcctcccggaaggggaacgggggcgttgggaggtttgggggttaggtaacggtttaacgtaaaaaggttaaaaagtgtaagttaggtaggaaagaaaaagtaacggaacgtacggtacgacgtacccggtaagaaaagggtaaagtaacttacccgaacccgtaacgttaccgtaacgaaaggtaagtaaacttaaactttaaaccgaaaaaacgggttacggttaagttaaacgttttagggaaacctaaaagttacgaaaaccgtaacggtacccgtaaaggaaaaacccggtagggaaacccaacggtaacccgtacccggttaaccttaacgttttaaccgtaacggtttaaaccccgaaacgtacgttaaaccgttaccgggtaaaggtcgtaaacccgtaggttaaccgggtaaacggtaaaacgggtacggtaccgttattcggttacgttttagaaccgtttaagttccgggtacggggtaccccggtaagggtaaccgttagggtttacccggg

SEQ ID NO: 113801 - DNA, 778 bp, Homo sapiens
  misc_feature: GYAE6OF01C5IFB.15.86.H09.1.454.CMB.1.raw
  modified_base (200)..(200): a, c, t, g, unknown or other
  misc_feature (200)..(200): n is a, c, g, or t
  modified_base (510)..(510): a, c, t, g, unknown or other
  misc_feature (510)..(510): n is a, c, g, or t
  modified_base (707)..(707): a, c, t, g, unknown or other
  misc_feature (707)..(707): n is a, c, g, or t
tcagtctacgtagccacgaccggtgctcgatttagtgctatagacttggggtttgggggggagaggagccccagcctttgggatccccaagtgttttcattcagtgatcaggactgaacacagaggactcaccatggagttcgggctagagtcttgggttttccttgctgtctatacttaaaggtgtccagtgtgagtgngaggtggtcggaggtcgtgggggacgtccgttagggtaaacggtccggtcggggggtcccttaggacgttcctccgtggtcgtacggtccttcgtggtacttccgtactttagtaacgtaagtggtacgtggtaacgtggtaggttcgggtcccgcgaacggtcctaccggaggggtaacggggtcgtagggacggttggggttagtaacgttaacgtaaaaaggtaaaagttgaagttacggtagaaagtaaaatacgaaccgtcggtacgaccgaccggtaagaaacggtagtactacgactacgtanaccgaaagagtaaattaacgtaacgaaaacggtcgttaagttacttacggaaactaaagtacgaaacgtaccgtacgaaacgtaaaccgacggaactaacggaccgtagttaaccttagttaaccgtacgtaaccaggtattacggttacgaagttcaacgtaccggtaagtaaaccgtaaacggtggtaacgtttntacggttaacgttaagtaacttacggtaccggacggggtacccgtaaaggtacccggttagtaccccgggg

SEQ ID NO: 113802 - DNA, 793 bp, Homo sapiens
  misc_feature: GYAE6OF01D9K3G.15.86.H09.1.454.CMB.1.raw
  modified_base (196)..(196): a, c, t, g, unknown or other
  misc_feature (196)..(196): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatacgttaaaggtgtcagtgtgagtgngaggtggtggtagtcggtggggtacgtccgttagggtaaacggccggttcgggggttacccttaggacgttccgtccgtgtggtcggtccttcgtgtacttctactttactagtaatggcgttggagttggtaggttcgggtccgaccgacggccgtaccggaggggaacggggtcgtgggtagggttggggttacggtaacgtttaacgtaaaaaggtaaaagtgtaagttaggtaagaaaacgtaaaagtacgtaacgtacggtacgaccgtaaccggtaaggaaaggtaatacttaccaactactacgtaacgaaagtaagtaagttaaactaaaccgggtaaaaacgtcgggtttattaaacgtttagaactaaaagtacgaaacgtactaacggtaaaacggaaaccgtagaaccacgtacggtaccctttacttaacgtacttaaccgtaaccgaactaggttaaccgttacggaagtacgtcaaacgttaacggacggtaaaaggtccgtaaggttcttaggttccgttaagaccgtttacgtaacccgggttccggggaaaccgttcgggtaaaacgttgggttaccgg

SEQ ID NO: 113803 - DNA, 848 bp, Homo sapiens
  misc_feature: GYAE6OF01COAQL.15.86.H09.1.454.CMB.1.raw
tcagtctacgtagccacgaccggtgctcgatttagtgctatagactttgggtttggggggagaggagccccagccttgggatccccaagtgttttcattcagtgatcaggactgaacacagaggactcaccatggacgttcggctgagtcgttggttttcctgctgactatacgttaaaaggtcgtccagtgtagaagtgcgtagggtgggtggaggtcggtggggcgtaccgttagggtaacggtccggtcgggggttaccctaggacgttccgtccgttggtcggtcggtccttcgttcggtactttccttacgttttacgaagttagtggacgtaggtagtggtaggttccggccgccggacgccgtaccggaggggacgggtcgtagggtaggttagggttacgtaacgtttaaacgtaaaaaagtaaagtcgtaagtaggtaagaaagtaaaacgtcgtaaccgtacggtacgaaccgtaaccggtaagaaacggtaactacgtaccaactacgtacgtaacgaaacgtaagtaaacgttaataaaacccggaaacgggtacggtttaagttacgtttaacgaaacctaaagtacgtaaaccgaccgtaaccgtaaaacggggaaaacccgtcgggaaacaccggtacccgttaaccttacgttaaacttaccgaaccgttaacccgagtaggttacggttaacggtaagcgaaccgtaaggtaaccgggtaaaacggtaagggtccgtaatttaccgtttggttacgtttttaacgaacggttaccggttacccgggggaaaccgggtaccgtaaacgggtaaacgttcgggtttcccgggg

SEQ ID NO: 113804 - DNA, 623 bp, Homo sapiens
  misc_feature: GYAE6OF01BZGDV.15.86.H09.1.454.CMB.1.raw
  modified_base (486)..(486): a, c, t, g, unknown or other
  misc_feature (486)..(486): n is a, c, g, or t
  modified_base (566)..(566): a, c, t, g, unknown or other
  misc_feature (566)..(566): n is a, c, g, or t
  modified_base (587)..(587): a, c, t, g, unknown or other
  misc_feature (587)..(587): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaagccgtggggggtcccttagagtctcctgtgtggcctctggattcactttcagtaatggctggatgagttgggtccgcgaggctccgaggggaggggctgggagtgggttggacgtttacaaaagtaaaatgagtggtagaagaaaatagactacggtgcacccggtagaaaggaagattacactatctacaagagaataatacgaaaagtacggtagttatttgaactaaagtgaaacacgaccgtaagaaaaccggngaaccacgacgtaccgtacttaagttaccgtacgtacccaagtagtagttacggaagtcgactagtacgaaggtaaaggnggtcttaagtcgtcgttttanagtacgtcgacggggacccagggtactaggtccggg

SEQ ID NO: 113805 - DNA, 655 bp, Homo sapiens
  misc_feature: GYAE6OF01B9IDG.15.86.H09.1.454.CMB.1.raw
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
  modified_base (284)..(284): a, c, t, g, unknown or other
  misc_feature (284)..(284): n is a, c, g, or t
  modified_base (378)..(378): a, c, t, g, unknown or other
  misc_feature (378)..(378): n is a, c, g, or t
  modified_base (435)..(435): a, c, t, g, unknown or other
  misc_feature (435)..(435): n is a, c, g, or t
  modified_base (642)..(642): a, c, t, g, unknown or other
  misc_feature (642)..(642): n is a, c, g, or t
tcagtctacgtagccacgaccggtgctcgatttagtgctatagacttgggtttgggggggagaggagcccccagccttgggatccccaagtgttttcattcagtgatcaggactgaacacagagactcaccatggagttcgggctgagcgtggtttcgtgacgtgctatacgtaagtncagtgtgagtcgcgnggtggtggtaggtggtaggggntccgtaggtaacgcgggtcggggtccttagacgtctcgtgtgcgcgtactgtatctattcgataagcgngtgagtggtcggttcggccgcgtcgccgtcggaggggtacggcgtagggtcggtggttacgtacgttaaacgtaaaagaatgtaggttacgganaaagaaagtagtaccggtaggcaaccgtaacggtaagaaggtactagtaccaacgtntaaccgagtaaagtacgtaaagttaactaacgtaaaccggtagttacgtacttagaaactaagaagtaaccgagtaacgaacggaacacgtaacgagtacgtacgtaactaaggtctacccgagaacgtgaacgtatacggagtccgaagtagaacgtagacgtcgttagttgttcgttagtagtacgttcgggtacgacggtacgnggttaccgttcgg

SEQ ID NO: 113806 - DNA, 648 bp, Homo sapiens
  misc_feature: GYAE6OF01D8XP0.15.86.H09.1.454.CMB.1.raw
  modified_base (372)..(372): a, c, t, g, unknown or other
  misc_feature (372)..(372): n is a, c, g, or t
  modified_base (425)..(425): a, c, t, g, unknown or other
  misc_feature (425)..(425): n is a, c, g, or t
tcagtctacgtagccacgaccggtgctcgatttagtgctatagacttgggtttggggggaggaggagccccagccttgggactccccaagtgttttcattcagtgatcaggactgaacacagaggactcaccatggagttcgggctgagctgggttttccttgctgctatcttaaaaggtgtccagtgtgaagtgcagggtggtggagtcgtggggggagtccgttggtaaagccgtggggggtcccttaggacgtctcctgtgttggcctctggattcactttcagtaatggctggatgagttggtccgccaggctccgaggggagggcgtgggaggtgggttgacgtttacaaaagtaaaatgatggtanaagaaaatagactacggtgacgacccgtagaaaggagattcacatctacaganaataatacaaaacgtgtagtacttagacaatagaagacgaccgtaagaaaacccgaggacaacagtaccgtacttactaactcgtaaccaacgtaacggtagttacgggtaagcgtacgaacgtacggtaaacggtaaaggtacgggacttacggttcggtacttttaggaacttaagtcggtaccgggggacccgaaggggtaccgtaacggtttaccgggg

SEQ ID NO: 113807 - DNA, 920 bp, Homo sapiens
  misc_feature: GYAE6OF01DESG7.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcttgggttttccttgctgctatacttaaaaggtgtccagtgtgaagtgcgagggtggtggaggtcgtggggggagtccgttagggtaaacggcccggttcgggggggttccccttaagggacgttccgtccgttggtggtcgggcccttcgtggtacttctacttttcaagttaagtggctggtagtggtacggttcggggtcccgaccgacgggtcctaccggaaggggggaacgggggtccgttggggtacgggtttgggggttacgggtaacggtttaacgtaaaaaaggttaaaagtaggtagttagggtagaaagtaaaaatcgtaacgtacggtcgaccgtaaccggtaaggaaacggaatacgttaccaacctacgttacaacgtaaaggtaataagtttaaactaaaccggaaaaaccggtcgggtttaagtttaattacggaaacctaaaggttacggaaaacccgtacggtaaccccgtaaacgggtaaaaacccgacgggtaaaccgacccgtaacggttacccccggttaatttaaacggttttaccctaaccggttaaacccgtaaacgtacggttaacgggttaaacccggggttaagttccggaaccgttaaaccggttaaccggtaaaacggggttaaaacgggaccggtttacgttaaggtttccggtttaacctttttaggggaaacttttccggtaccccgggggttaacgggggaacccccggttaacgggaaacgttacggggtttaccggg

SEQ ID NO: 113808 - DNA, 989 bp, Homo sapiens
  misc_feature: GYAE6OF01CGMPE.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatgggtagttcgggctggagtcgtttcgggtttttccttggctcgtacttaagttaacgtttaaaagggtcgttaccgtagtggtagaagtcggcggtagggttgggtggtacggttcgggtagggggacgtccggttaagggtaaaccggtccgggttcggggttacccttaaggcgttccttccgtggttcgtcggtccttcgtgtacttccttacgttacgtagttacgtggtacgtggtacgtggttacgggttccgggtcccggccgtacggtaccggtacggggaacgggggtaagggtcgggttagggtacgggtttacgggggttacggtttaaaaccggtttaaacgtaaaaaaaggttaaagtagggtaaggttaacggtaaaggtaaaacgtaaaacggtaggtaaccggttaaccggtaccggaaccggtaaacccgggtaaaggtaaaacgggtaaacgtacgttaacccgaactaccgttaacgtaaccgaaagttaagttaaacgttaaaacgtaaaaccggtaaaccggttaggttttacgttaaggttaaacgaaacgttaaaacgtacggtaaaaccgaccggtaaacccgttaaaacgggaaaaccccggacgtaacccgtaacccggtccggttaacccttaacctttaacggtttacccgttaacgaaccgtaacgtttaacgttaaggttaaccgttagggtaccgtaaacggttaaccggtaaaccgggtaacgtaaagggtctttaaccgttaagttcggttttaaacgttcggtaaacgttccggtacccggggtacgggtaccccgaaaggttaccgttcggggtttacccgg

SEQ ID NO: 113809 - DNA, 777 bp, Homo sapiens
  misc_feature: GYAE6OF01CL718.15.86.H09.1.454.CMB.1.raw
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
tcagtctacgtagccacgaccggtgctcgatttagtgctatagacttgggttgggggggagaggagccccagccttgggatccccaagtgttttcattcagtgatcaggactgaacacagaggactcaccatggagttcgggctgagtcgttcgggttttccttgctgctatacgttaaaggtgtaccagtgtgaagtgacgtaggtggtggagtcggtaggggactaccgttaggtaacgtccggtcgggggtccctaggagtccgtccgtagtcgtcggacctgtacggtnttctacgtttcgaagttagtggcgtaggagtcggtaggttcggcccgacgcggcgtaccggaaggggtacgggngtagggaggttacgggtagtaaccgttaaagtaaaaagtaaatgtaaggtggaagtaaacgtaaataggtaaccgtacggtcgaacccgtaccggaaagaaacggaagtactaacctactactacgtacgaagaacgtaactaaacttaaccggaaaaacgttcggtaagtttaacgttagaaactaaggtaacgaaccgaacgtaacgaaacggtaaaccggacggaactacgaacgtactacgtaatcctaacgactaacgtagtacgtacgaacgtacgaacttcggtaacgaaaaccgggtttagggaacttcggttaatcccggtttaacggtttaagtaacgtttaccggggtcccggtaacccggggaccgggtaaaaccggtcgggtaacgttttcccgggg

SEQ ID NO: 113810 - DNA, 783 bp, Homo sapiens
  misc_feature: GYAE6OF01DF424.15.86.H09.1.454.CMB.1.raw
  modified_base (636)..(636): a, c, t, g, unknown or other
  misc_feature (636)..(636): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagccgtggggagtccgttaggtaaacgccggtcgggggtcccttaggagtctccgtgtgtcggcctcgtggtacttctactttcgaagttaacgtggtcgtagggattggtaggtttcgggtcccgaccgaggcctccggaagggggaaggggcgtgggtacggttggggttaggtaacgtttaacgaaaaaaggttaaaatggtaagtagggtagaaaaggtaaaagtacggtaacgtaacggtcgtaccgtaacccggtaaggaaaacggtaagtaacttacctaaccaagttactaacgaaagtaagttaattaaacgttaaaaccggaaaaaacgtcggggtttaatttaagttacgaaactaaagttaacgaaacgacggtaacccgtaaacgaaaacccggtgaaccaaccgtacgtacccgttnttaacgtaaccgtagtaaccccaagtagttaacgttacggaacgtgaaccgtaacgtacgggtaaacgtaaacgggacgtcgtagtttacgttggtttaagattaccggttcgggaccggggtaccgaaagggtactaagggtccgg

SEQ ID NO: 113811 - DNA, 745 bp, Homo sapiens
  misc_feature: GYAE6OF01EBD5E.15.86.H09.1.454.CMB.1.raw
  modified_base (310)..(310): a, c, t, g, unknown or other
  misc_feature (310)..(310): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggttttccttgctgctatctaaagtgtccagtgtgagtgcaggtggtggagtcgtgggggatccgttggtaaacgtccggtggggggtcccttagacgtctccgtgtgtggtcctcgtggtattctactttcagtatggctggatggtagttcgggtccnccgaggccgtaccgaaggggacgggcgtagggtacggtgggttggtacctttaagaaaagtaaaatgagttagtagaaagaaatgaacgtacggtcgacgtaccggtaagaaggaatctacgacctatactaacgaaagtactaaataacgttaaccggaaaaccgtaggttagttaagtttacgaaaccgtaaagtacgaaacgtaccggtaccgtaaacggaaaacccgacggaacgtaaccgaacgttccgttacttaaccgtttacgaccgttaaacccgacgttaaaggtaacgtttacgggtaagtccgaacgttaagggtacccggttaaaaggaacgggtagggtaacctttagggtccctttaggtttacaaacgttcggttcccgggttaacgggaccggaaggttacccgtaaggtttcccggg

SEQ ID NO: 113812 - DNA, 1089 bp, Homo sapiens
  misc_feature: GYAE6OF01DTAYJ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgcgtgctatacttaaaggtgtccagtgtgaagtgcaggtggtggagtcgtgggggagccgttggtaaaggccgtggggggtcccttagacgtctcctgtgtggcctcgtggtattcactttcgagttaagtggtctaggagttggtaggttcggggtcccgccgtacggtccgtcccggaaggggggaacggggggtccgtggggtaagggtttgggggtttacgggtaaccgttttaaccgaaaaaagggttaaaaagtaggtaagttaggggtaggtaaaacggtaaaaagttaaccggaacggttaacgggttacggaacccgtaaacccggtaagggaaaaagggtaacggtaactttacccaaccccgtaagttacctaacggtaaaacggtagtaaacgtttaaacgtttaaaacccgtaaaaaaccgggttaccgggtttaaagttttaaacggtttttaacgggaaaacccttaaaaaggttaaaccgggtaaaaaccgttacccgggttaaaccccgggtttaaaaccggggaaaaaaacccccggggtaacggggaaaaccccctaaacccgggttaaacgtacccccggggtttttaaacctttaaaccggttttaaacccgttaccgggttaaaaccccgtaacccggttaaagggtaaaccggtttttaacccgggggaaaaggtttcccgggtaaaccgtaaaccgggttttaaaaccccgggggaaaaaccggggtttaaaaggggaacccggggtttaacccgtttaaagggtttttaccgggtttaaccgtttttttaaacggaaacggttttaaccccgggtttccccgggggtttaacccggggggggaaacccccccggttttaaaaggggggaaacccccgtttaacgggggttttaaccccggggg

SEQ ID NO: 113813 - DNA, 852 bp, Homo sapiens
  misc_feature: GYAE6OF01CP5SL.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcgggctgagcgttgggttttccttgctgctatacttaaaaggtgtccagtgtgaagtgcgaggtggtaggagtcgtggggacgtccgttaggtaaagtccggtcgggggtcccttagtagtcctccgtgtgtcggtccttcgtggtacttccgtacctttacgtaagttaagtggtcgtaggtagttggtacggtttcggggtcccgcccgtaacgggcccgtacccggaagggggaacgggggtcgtacggggtaagggtttcgggggtttacggttaaccggttttaaacgtaaaaaacggttaaaaaagtggtaaggttacgggtaaggaaaggtaaaaagtaacggtaaccgttacggtacgacccggtaacccgggtaaacggtaaaaagggaaacgtacgttaaccaaccgtaacttaaccgtaaagaaacggtaacgtaaagtttaaaccgttaaaccggtaaaaaaccggttcgggtttaatttaacgttagaaactaaagtaacgaactaacggaaccgtaaacgaaaaaccgggcgaaacccacgtacggtacccttaacgttacttaaccgtaccgtaacgtaacgtacgtaacggttacggaagtcggaactacggtaccggtaaacggtaaaggacgttacgtagttacgttcgtttagacttacggttcgggtaccgggaacgtgggtactacggttcggg

SEQ ID NO: 113814 - DNA, 803 bp, Homo sapiens
  misc_feature: GYAE6OF01AW1K1.15.86.H09.1.454.CMB.1.raw
tcagtctacgtagccacgaccggtgctcgatttagtgctatagacttgggttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacgccgtcggggggtcccttagtagtccgtcctgtcggtggtccctcgtggtattcgtacctttcgtagtaagtggctggtagtggtaggttcggggtcccgaccgtacggtccgtacccggaagggggaacgggggtccgtaggggtagggttcgggggtttagggtaaccggtttaaacgaaaaaaggttaaaaaagtaggtaagttagggtaaggaaaggtaaaaagtaacggaaccgttacgggtacgaccgtaacccggtaaggaaaaggtaaacgtacgttaccgaaccgtactactaacgtaaagacgtaattaaacgttaaccgtaaaaacggtacggttagttaatttagaaactaaacgtagaaacgtacgaccgtaaacggaaaaccggaacgaaccaccgaacggtcctaacttaacgtactacgaacctacgtaagttactaacgggtagtacgactaaggtaccggtaaggtaaaacggcggtactaggttacggtttacgttgtaaacgttcggtacggtaccggggtaaccccgaagggttaaccgtaaggttcccggg

SEQ ID NO: 113815 - DNA, 708 bp, Homo sapiens
  misc_feature: GYAE6OF01AUPRY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccggtgggggtcccttagacgtcgtcctgtgtggcctctggattctactttcagtaatggctggatggtaggttcgggtccgcgaggcgtccgaggggaaggggtcgtggaggtgggttaggtacggtttaataaaaggtaaaagtgtagtggtagaagaaagtagacgtaggtcgaccgtaaccgtaggaaaggaatacgtacaccatcctaacgaagactagtaaactaacgaaaacggtacggttagttatttacgaactaaagtacgaacgtaacgaccgtaaacggaaaaccggtacgaacgaacgtacgtacgttaccgttaactttactaccgtaacccgaatacgtaacggttaacggagtacgtagacgtaaccgggtaaggtaaaccggggtagtacgttagtacggtttacgttacgtaagttacggtcgggtaccggggaccgaacgggtacgtaacggttccgggg

SEQ ID NO: 113816 - DNA, 717 bp, Homo sapiens
  misc_feature: GYAE6OF01B7Y8P.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaagtggctggatggaggttcgggtccgccgaggcctccggaggggaggggcgtgggaggttggggttaggtacgtttaacaaaaaggttaaaatggaagttagggtagaaagtaaaataggaacgttaacggtcgaccgaacccggtaaggaaaagggtaagtaacttaccaaaccctataccgttaacgaaaggtaacgtaattaaacgttaaccgaaaaacggtacgggtttagttaagtttagaactaaagtacgaaacgtacgaaccctaacggaaaacccggtaggaaccacgacggtacccgttacttacgttaacctacgaacctaacgagttacgttacgggaatcgactacgtacggtaaacggtaaggtacgtcttaagtgttactttagattacgtcggtacgggacgaacgggacgtaggttcggg

SEQ ID NO: 113817 - DNA, 788 bp, Homo sapiens
  misc_feature: GYAE6OF01C968P.15.86.H09.1.454.CMB.1.raw
  modified_base (591)..(591): a, c, t, g, unknown or other
  misc_feature (591)..(591): n is a, c, g, or t
  modified_base (741)..(741): a, c, t, g, unknown or other
  misc_feature (741)..(741): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagtcttgggttttccttgctcgcttaatacgttaaaaggtgtccagtgtagaagtgcgaggtggtggaggtcggtggggacgtcgttaggtaaacgccggtgggggtcccttaggtagtccgtccgttggtggtcggccgttcgtggtacttactacctttgaagttagtcggtacgtggagttagggtacgggtttcggggacccgaccggacggtcgtaccgggaaggggggacggggtctagggggtagggttcggggttacgggtaacgtttaaacggtaaaaaagttaaagtaggtaagttagggaaagtaaaagtaaaacgtaacggtacgttaacgggccgaccgtaaaccggtaagaaaacggtaactacgttaccaacgtactaccgaagaagtaaagtaaattaaacgtaaacgaaacggttagttactaagttanaaaccgaataacgaactaggtaaccgaaagtaaaccgagacacgtacgtcgtaactacttaccgtaacgacctaacgtaaggtacgttaacggagtacacgggtaactaccggtaaacgggaacgtacgtacttaggtattcggtttaangtaacgttccggggtacggacccggtaaggtcgttacgggttcccgg

SEQ ID NO: 113818 - DNA, 865 bp, Homo sapiens
  misc_feature: GYAE6OF01CHB37.15.86.H09.1.454.CMB.1.raw
  modified_base (135)..(135): a, c, t, g, unknown or other
  misc_feature (135)..(135): n is a, c, g, or t
  modified_base (296)..(296): a, c, t, g, unknown or other
  misc_feature (296)..(296): n is a, c, g, or t
  modified_base (772)..(772): a, c, t, g, unknown or other
  misc_feature (772)..(772): n is a, c, g, or t
tcagtctacgtagccacgaccggtgctcgatttagtgctatagacttgggtttggggggagaggagccccagccttgggatccccaagttgttttcattcagtgatcaggactgaacacagagactcaccatggngttcgggctgagtcgttgggttttccttgctgcttatacgttaaaggtctcagtgtagagtgacgtaggttggtggaggtcggtagggggactccggttagggtaaacggtccgggttcggggtccttagcgtctcgtgtgtcgctcgtgtattctacttnagtagcggtctggatggtcggttcgggtcccgcgtacggccgtacgggaagggggacgggtcggtagggtgggtttgggttacggtaacgtttaaacgaaaaaggttaaagtggtaagtagggtaagtaaagtaaaagtacggtacggttacggtaccgaaccgtaaaccgggaaggtaaaacggtacttaccgtaactaacgtaactacgaaacgaaacgttaaagtaaacgtttaaaccgtaaaaacggtaaacgggtttcggtttaatttaagtttaccgaaaaacgttaaacggaaggttaaaaaccccgacgttaaacccgggtaaaaccgggaaaaacccggtacgaaaccccgtcgttaaacccggttccccgttttaaaataccccgttttgtaaacccgacccgaaggtttccgtaaaggttaccggagttcccgaaattaacccgggtaaggaaacggttaagggnttttacccggtttaagttcgtttaatttaaccggtagttacccggttgggggtaaaccccggaccgggtaaaagttacttcgggggtttcccg

SEQ ID NO: 113819 - DNA, 746 bp, Homo sapiens
  misc_feature: GYAE6OF01BNIG0.15.86.H09.1.454.CMB.1.raw
  modified_base (570)..(570): a, c, t, g, unknown or other
  misc_feature (570)..(570): n is a, c, g, or t
  modified_base (681)..(681): a, c, t, g, unknown or other
  misc_feature (681)..(681): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagctggtttccttgctgctatcttaaaaggtgtccagtgtgaagtgcaggtggtggagtcgtggggatccgttaggtaagccgtgggggtcccttaggacgtctcctgtgtggtcctcgtggacttcactttcagttaagtggtctgggattggtaggttcgggtcccgtccgtaggtccgtaccggagggggtaacggggcgttaggggtaggttggggttacggtaacgtttaacgaaaaggttaaaatggtagtggtagaagtaaacgtacgtacgtacggtcgaccgtacccggtagaaaggaacgtacttaccgacctaataccgtacgaagagtaacttaacgttaacgaaaacgggtacggtttaggtaatttaggaacctaaaagtcgaaacgcggtacctaagggaaaacccgnggaaaccctacggaccgtaccgttacgtaactttccgacggtaacccctacgggaagttaccgttacggaagtcgtactagtacccggtaaggtaaaggcggtactttagnggtttaccgtttagaacctttcggtacccgggtacggggaacccaggggtacctagggttcccgg

SEQ ID NO: 113820 - DNA, 856 bp, Homo sapiens
  misc_feature: GYAE6OF01A0144.15.86.H09.1.454.CMB.1.raw
tcagtctacgtagccacgaccggtgctcgatttagtgctatagacttgggtttgggggggagaggagccccagcccttgggatccccaagtgttttcattcagtgatcaggactgaacacagaggactcaccatggagttcggctgagcgtgggttttccttgctgctatacttaaaaggtgtccagtgtgaagtgcgagggtggtggagtcgtggggagtccgttaggtaaacgccggtcgggggtacccttaggacgtccgtcctggtgtcggtccttcgtggtactttcctactttcgaagttaagtggtcgtggatggtaggttcgggtccgccgacggtccgtaccggaagggggtaacgggggtcgtagggtaggttaggggttacggtaaccggttttaaacgaaaaaaggttaaaaagtaggtaagtagggtaagtaaaggtaaaagtacggtaaccgtacggtcgacccgtaacccggtaaggtaaaaggaacgtacttaccgaacctacgtacctaacgaaagtaacgtaagttaaacgtaaaccgtaaaaccggtaacggttagttaagttagtaacgtaaacgtaacgaaaccgaacgttttttttaaccgaaacggtaaaccgaacggaaccgaaccgtaaccggtacccgttaacgttaaccgttaaccgttaaccgtaacccgtaacgtaacggtaacggttaacggtaacggtacgtacgtaacgtaaccggtaaacggtaaacgggtaacggtaccgttagttacggttacgtttaggtaacgttacggtaccggttaccggggtaacccggtaacggtaaccggtaacggttaccggg

SEQ ID NO: 113821 - DNA, 908 bp, Homo sapiens
  misc_feature: GYAE6OF01CW2YT.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctggttttccttgctgctatacttaaaaggtgtccagtgtgaagtgcgaggtggtggagtcgtgggggagccgttaggtaaacgtccggttggggggtcccttaggacgttcctcgtggtgtcggtcctcgtggacttctactttcaagtaagtggcgtaggagtggtacggttcgggcccgaccgaggtccgtacccggtaaggggacgggggtcgttaggggtacggttggggttaacggtaaccgtttaaaacgaaaaaaggtttaaaacgtggtaacggttagggtaacggaaaagtaaaaacggtacggtaaccgtacgggtacggaacccgtaaacccgggtaaggtaaaagggtaacgttaacgtacccgtaacctacgtaaccgtaaacgaaagtaacgtaaacgttaaacgtaaaccggtaaaaaacccggttggttaacgtttaaacgtttaaggaaaccccgttaaagtaacggtaaaaccgtaccggttaacccgtaaaacgggaaaacccgggtaaacggaacccgtaaaccgtaaccggttacccgttaaaccgtttaaaccgtttaacccgtaacccgtaaaccgtaacgtaaggttaaccgttaacgggtaaaccgttggaaacccttaaaggtaacccgggtaaaacgggttaaacgggacgttaacttaggttacggtttactttagtaacgttacggttacccgggtacgggggaacctaacggggtaactaagggttcccgg

SEQ ID NO: 113822 - DNA, 895 bp, Homo sapiens
  misc_feature: GYAE6OF01BMW5Z.15.86.H09.1.454.CMB.1.raw
tcagtctacgtagccacgaccggtgctcgatttagtgctatagacttgggtttggggggagaggagcccccagccttgggatccccaagtgttttcattcagtgatcaggactgaacacagaggactcaccatggagttcggctgagctgggttttcctgctgctatacttaaaaggtgtccagtgtagaagtgcaggtggtggagtcgtggggagccgttggtaaacgccgtgggggtcccttagagtctccgtgtgtcggtcctcgtggtattctactttacagtaatggctggatggtaggttcgggtccgccacggtccgtaccggaagggggtaagggggtccgttagggaggttacggggttacggttaaccggttttaaacgaaaaaacggttaaaaagtggtaagttagggtaaggaaaggtaaaaacgtacggtaaccgttaacgggtacgaaccgtaacccggtaaggaaaaacggtaacgtaacgttaccgaaacctaacgttaccgtaaacgtaaacggtaaacgtaaattaaaaccgttaaccgaaaaaaccggttcggttaagtttaacgtttaacgaaacgtaaaactacggtaaaaccgtaaccggtacccgtaaaccggtaaacggacccggaacggaaccaaccgtaacgtacccgttaacgttaactttaaccgtacgtaacccgtaacgtaacggttaacgttaccgggaagtaccgggacgtaaacggtaaacccgggtaaaacgggtaaaaccgggtaacggttaccgttaaacggtttcgtttaaccgttttaacggttaacttaacccgggttaacccggggttacccggggaaacccccggggtaaaggggtaaccccgttaaaccgggg

SEQ ID NO: 113823 - DNA, 768 bp, Homo sapiens
  misc_feature: GYAE6OF01B636D.15.86.H09.1.454.CMB.1.raw
tcagtctacgtagccacgaccggtgctcgatttagtgctatagacttgggtttgggggggagaggaggccccagccttgggatccccaagtgtttcattcagtgatcaggactgaacacagaggactcaccatggagttcgggctgagctgggtttccttgctgctatacttaaaaggtgtccagtgtgaagtgcaggtggtggagtcgtgggggagccgttgggtaagccgtggggggtcccttagagtctcctgtgtcggcctcgtggattctactttcagtaagtggctggatggtaggttcgggtcccgccgagggcctccggaagggggaaggggtctgggtaggtggggtttacggaaccgttttaagaaaaaaggttaaaaagtggtaagttgggtaagaaaggtaaaaacgtaggaaccgttaacgggtgacctaacccgggtaagaaaacgggaataacttaccaaccctatccctaagaaagagtaacttaaattaaccgaaaaagggtcggttagttaactttacgaaaccgaaaagttagaaaccgagaacccgtaagaaaacccggaggaacaaccgtacgtcccgtaacttaattaccgtacgtaacccaagtacggtagttaccgggaagttccgaacgtaacggtaccggtaaaacgggtaaagggaccggtacttaagtacggtttctttaagggaatttaccgtcccgggtacggggaacccgaacggggtaaactaagggtttccgggg

SEQ ID NO: 113824 - DNA, 738 bp, Homo sapiens
  misc_feature: GYAE6OF01BJXDQ.15.86.H09.1.454.CMB.1.raw
  modified_base (361)..(361): a, c, t, g, unknown or other
  misc_feature (361)..(361): n is a, c, g, or t
tcagtctacgtagccacgaccggtgctcgatttagtgctatagacttgggtttgggggggagaggagccccagccttggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatggtaggttcggggtcccgccgaggcctaccggaggggaagggggcgtggaggtggggttggtacgtttanaaaaagtaaaatgagtggtagaaagtaaaatagaacgtacggtcgaccgaacccggtaaggaaaaggaagtacttaccgaaccctacgtacctaacgaaaggtaagtaaacttaaacgtttaaaccgaaaaaaccggtacgggtttatttaagtttagaactaaaagtacggaaaacacggtacccgtaaaggaaaaaccccggaggaaccaacgtaaccgtcccgttacttaacttaacctacgtaacccaacgtaagtacgtttaggaacgttgacctaagtaccggtaaacgggtaaaggggacgtacttaagttgttcgtttttagattacgttaccggaccggggaacccgaaggggtaactaggttccggg

SEQ ID NO: 113825 - DNA, 851 bp, Homo sapiens
  misc_feature: GYAE6OF01BA1PD.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtagaagtgcgaggtggtggaggtcgtgggggagtccgttagggtaaaggccgttcggggggtcccttagagttctcctggtgtcggtcctcgtggtattcctactttcaagttaagtggtcgtggtagtggtacggttcggggtcccgaccgacggtccgtaccggaagggggacggggcgtgggtagggttggggttacggtaacggttttaaacgaaaaagttaaaaagtgtaaggtaggtagaaaagtaaaagtacgaacgtacggtagacccgtaacccggtaaggaaaaggtaacgtacttaccaaccgtaacttaccgtaaccgtaaaggaacgttaaacttaaacgttaaacccgaaaaacgggttacgggtttaagttaatttaacggaaactaaagtaaccgaaacgaaccggtacccgtaaaaccggaaaaccgggtacgaacctacccggacgttacccggttacttaacgttaaccgtaccgtaaacccaacgtagttaaacggttacggtaacggtacgacgtaacggtaaccggtaaacgggtaaaacgggacggttaaccttagtttacggtttaccgtttaagtacggttaccgttcggggttacccggggaacccggtaacgggtaacggtaaggttcccggggg

SEQ ID NO: 113826 - DNA, 935 bp, Homo sapiens
  misc_feature: GYAE6OF01A1JSQ.15.86.H09.1.454.CMB.1.raw
  modified_base (884)..(884): a, c, t, g, unknown or other
  misc_feature (884)..(884): n is a, c, g, or t
  modified_base (898)..(898): a, c, t, g, unknown or other
  misc_feature (898)..(898): n is a, c, g, or t
  modified_base (910)..(910): a, c, t, g, unknown or other
  misc_feature (910)..(910): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaggtgtccagtgtgaagtgcgaggtggtggaggtcgtgggggagtccgttagggtaaacggtccgtagggggggttccccttaaggacgttccgtcccgttggttcggtcgggtcccttcgtagggtactttcctaaccgttttacgaaggttaaacgttcgggtccttggggaattgggtaacgggtttttccgggggtccccgaccccgtacggggtaccgttaccccggaaacgggggggtaaacgggggggcccgttagggggtaggggttttacggggggttttaggggttaaaccgggtttttaaacccgtaaaaaaaaagggtttaaaaaaacgtttaggaaaggtttacggggtaaaggtaaaagggtaaaaaagtttaacgggaaaccggtttaaccggggtacgtaacccgtaaaccccggggttaaaggaaaaacggggtaaacgtaactttaccgaaccctaactttaccgtaaacgaaaggtagtaaactttaaacgttaaaccgtaaaaaacgggtccggtttaaggttaacgttttaggaaaccgtaaaacgttaacgaaaccgtaaccgaacccgttaaacggaaaacccggtaaggaacccaacggtacgtcccggttaacttaacgtacttaaccgtaaccaacgtagtacgttacggaagtacgactagtacgaaacgggtaaggacggtntagttgtcgtttanactgttaccggngggtaacccgaggacgtagtccggg

SEQ ID NO: 113827 - DNA, 867 bp, Homo sapiens
  misc_feature: GYAE6OF01C8DPT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtggtggagtcgtgggggagtccgttaggtaaacggccggttcgggggggtcccctttaggacggttcctccgttggttcggtcggtccttcgtggtactttccgtacttttcaaggttaagtcggtcgtgggaagttggtaggttcggggtcccgccgtagggcctacccgggaagggggtaaacggggggccgttaggggacgggtttgggggttacgggtaaccggttttaacgaaaaaagggttaaaaagttggtaagttagggtaacggaaaaggtaaaaacgtacggaaccgttacgggtcgtaccggaaaccccggttaaggaaaacggtaacggtaaccttaccgaaaccctacgttacctaacgaaaagtaagtaactttaaaagttaaccgaaaaaaccgggtgggtttaagttaactttacggaaacttaaaagtacggaaacgtacggtaacccgttaaacgggaaaacccggaggaacccaaccggacgtacccgtttacttaacttaacgtacggtaaccctacgtaggtacgttacggtaagtcgactacgttaccgggaacgttaaagggcgttacgttaagttcggttacgtttagaacggttccgttccgggtacccggggacccaaaggggtacctggggtttacccggg

SEQ ID NO: 113828 - DNA, 751 bp, Homo sapiens
  misc_feature: GYAE6OF01A46LC.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatacttaaaaggtgtccagtgtgaagtgcgaggtggtggagtcgtgggggagccgttggtaaagccgtggggggtcccttagacgtctccgtgtgtggcctcgtggattcactttcagtaatggactggatggaggtttcgggtccgccaggtcctaccgaggggaaggggtcgtgggaggtggggttggacgtttacaaaaagttaaaagtgtaagtgggtagaagtaaaatagtacgtacggtgaccgacccggtaggaaaaggaagtacttacaacctatactacgaagtagtaattaaacttaacgaaaaaccggtaggtagttaatttacggaactaaaagtacggaaacctaacggaccctaaacgggaaaaaacccggacggtaacccaacggtaaccggtacccgttaaccgttaactttaacccgtaacgtaaacccctaacgtaaggtaacgttacgggaaacgtcgaacgttactaacgggtaaacccggtaaaggggacgttacgtattggttacccttttaggacttacggttcccggcggggtaacccgaaggggtccttaaggttccggg

SEQ ID NO: 113829 - DNA, 876 bp, Homo sapiens
  misc_feature: GYAE6OF01EK2BF.15.86.H09.1.454.CMB.1.raw
  modified_base (194)..(194): a, c, t, g, unknown or other
  misc_feature (194)..(194): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagtcgttggtttccttgctgctatacgttaaaggtgtccagtgtagaanggtcgtaggtggtaggtgggtacgtcggggtaggacgttcggttaaaggaccgttcggggtccggttacgtcgtcgttccgtgtcgttcgcggtctgtagttctacttctagtagtaggtcgtgagttggtacggttacgggtcccggtccggaccggtacggtacccggtaacgggggtaacgggggtacgtaggggggtcccgttttggggggtttaaacggtaaccgggttttttaacggaaaaaaacgggtttttaaacgtaggggttaaaaatggggtaactaaagggttaaacgtacggtaaaacgttaacgggtacctaaccggttaacgggtacgaaaaccggtaaggtaaaccgtaccgtaaccgttacgtaccgtaaagtacggttaaagtaaaccgttaaagggttaaacttaaaaacccgggttgttaaaaccgttacggtttaacggaaactttaaaggtaccggaaaaatcgggttaaaccaaggaaacccgtacgaaacgtaccggtacgtacccgtaactacgttacaacgttaccaacgtacgtaaacgtcggaattaccggtaactagtaaccggtaataaacgggtacgttacgttaggttctacgttagtaccttacgtaccggggttacgtaacggtaacggggtacctaaggggttcccg

SEQ ID NO: 113830 - DNA, 866 bp, Homo sapiens
  misc_feature: GYAE6OF01AJM3G.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatacttaaaggtgtccagtgtgaagtgcgaggtggtggagtcgtggggacgtccgttaggtaaacgtccggtcggggggttaccccttaaggacgttccgttcccgttggtcggttcggtcccttcgtaggtactttcgtaccttttacgaagttaagtcggtcgttaggaacgttgggtaacggtttcggggtcccgtacccgaacgggtcccgttaccgggaaacggggggtaacgggggtccggttaggggtacggggtttacgggggtttaacgggttaaccggtttttaaaacggtaaaaaaggtttaaaaacggtaggtaaggttaggggtaaacgaaaggtaaaaacgtacggtaaccgtaacggtacgaccgtaaccggtaaggaaaacggacgtactacaacgtactacgaacgaaagtaactaattaaaccgtaacgaaaacgttcgggttatttaacgttacgaaaccgtaaagtacgaactaaccgaacccgtaaaggaaaacccgcggtaacctaaccggctaaccgttacttaacgtttaccgaccgttacaacggtaacgttacgttacggaatccgaagtacggtaccggtaaaaggtaacggcgttaacttcggttaacgttgtttaccgtaagttccggtaccgggtcgggaaccccgtagggtaaacgtggtttacccggg

SEQ ID NO: 113831 - DNA, 811 bp, Homo sapiens
  misc_feature: GYAE6OF01DKZU8.15.86.H09.1.454.CMB.1.raw
  modified_base (311)..(311): a, c, t, g, unknown or other
  misc_feature (311)..(311): n is a, c, g, or t
  modified_base (762)..(762): a, c, t, g, unknown or other
  misc_feature (762)..(762): n is a, c, g, or t
tcagtctacgtagccacgaccggtgctcgatttagtgctatagacttggggtttgggggggagaggagccccagccttgggatccccaagtgttttcattcagtgatcaggactgaacacagagactcaccatggagttcgggctggagtcgttgggttttcctgctgctatacttaaaggtgtccagtgtgagtgcgaggtggtggagtcggtggggacgtccgttagggtaacggtccggtcgggggtcccttagtacgtcctccgtgtcggtcggtcctcgtggtacttcgtactttcgagtagtggngtggagtggtaggttccggtcccgacgtaggccgtacgggaagggggtacggggtcgtaggggtaggttacggggttacggttaaccgtttaaaacggaaaaagtaaaaggttggtaagttagggtaaagtaaaacggtaaaaaggttacggtaaccggttacgggtaacggtaacccgtaacgggtaaaggaaaacggtaagtaccttaccaacgtaactacgtaacgaaagtaagtaaacttaaacgtaaacgtaaaaccggtacggttagttaacgtttacgaaaccgtaaagtaccgaaacgtaacgtaccgtaaacgggaaaaccgtggaacccaacgaccgttaccggtaacctttaagttccgaacgtaaccgacggtaataaccgggttacggaagtacagtaaccggtaacggtaaacggtaagggctacgttatccggttnttaacgagttaccggtcggtaacccgggaaccgtagttaagcgttccgg

SEQ ID NO: 113832 - DNA, 847 bp, Homo sapiens
  misc_feature: GYAE6OF01BVWL3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagtcgttgggttttcctgctgtctattacgttaaaggtgtccagtgtgaagtgcgtagggtggtggagtcggtggggacgtaccgttagggtaaacggtcccgggttcggggggttacccttaggtacgttccgttccgttggttcggttcggtcccttcgttaggtactttccttacgtttacgtaagttagtggtcgtaggtagtggtacggttcggacccgcgacggtccgtacgggagggtacgggtcgtgggtagggttacggggttaggtaacgtttaaacgaaaaaggtaagtaggtagtaggtaagaaagtaaagtacgtaacggtacggtaccgtacgaaccgtaaggtaaagacgtactaccaacgtactacgtaacgtaagtaagtaacttaaacgtaacggaaaaccggtttggttaattaacgttacgaaacttaaagtaaccgaaaacccgtaaccggaaaccccgggtaaagaccggaaccctaacggaccgttaacccgtttaattaaccgttaacgtaaccgtaaacccaggttacgtaaaccgtttacgggtaactccggtaacgtaacgggtaacggttaaaacgggagtacccggttaattcggtttagttaaccggtttagacctaaccgggttaccgggtaccgggaacggtacgttaagtacgggtttccggttaccgg

SEQ ID NO: 113833 - DNA, 965 bp, Homo sapiens
  misc_feature: GYAE6OF01DBTWH.15.86.H09.1.454.CMB.1.raw
  modified_base (177)..(177): a, c, t, g, unknown or other
  misc_feature (177)..(177): n is a, c, g, or t
  modified_base (711)..(711): a, c, t, g, unknown or other
  misc_feature (711)..(711): n is a, c, g, or t
tcagtctacgtagccacgaccggtgctcgatttagtgctatagacttgggtttgggggggagaggagcccagccttgggatccccaagtgttttcattcagtgatcaggactgaacacagagactcaccatggagttcgggctgagcgtggttttcctgctgctatacttaaaggtntccagtgtgaagtgcgtaggtggtggaggtcgtgggggagcccgttagggtaaacggtcccggttcgggggggttcccctttaaggacggttaccttcccgttggttggtcggtcccttcgttgggtaactttccgttacttttaccgaaggttaaatcgggtactggggtaattcgggttaacgggtttcggggtccccggaccgtacgggtccgtaaccccgggaaggggggtaagggggtccgttggggtaagggtttcggggggttacggttaaaccggtttttaacgaaaaaaaaggttaaaacttaggtaaggtagggtaacgaaaaaggtaaaaacttaacggtaacggtaaccggtacgaacccggtaaacccggtaaaggaaaaacgggtaagttaaactacccgtaaacccgtgttaacctaacggtaaaaggtaaacgtaactttaaaacgttaaaaccggaaaaacggttccgggtttaagtttaaacgttttcgaaaacctaaagtttaacgggaaaaccnccggtaaacccgtaaaacgggttaaaaaccccgaacgggtaaacctaaccggtaaccggtaccccgttttaacgttaaatttaaccccgttacggtaaaccccgaaggttacggaaccgttttaacgggaactaccggtaactaaccggtaaacgggtaacggtaaaggggtacggtacccttagttccgggttaattttccggaaattccggttaaccgggacggggtacgaacgggtgtaaccggttccggg

SEQ ID NO: 113834 - DNA, 763 bp, Homo sapiens
  misc_feature: GYAE6OF01CWYEA.15.86.H09.1.454.CMB.1.raw
  modified_base (272)..(272): a, c, t, g, unknown or other
  misc_feature (272)..(272): n is a, c, g, or t
  modified_base (599)..(599): a, c, t, g, unknown or other
  misc_feature (599)..(599): n is a, c, g, or t
  modified_base (704)..(704): a, c, t, g, unknown or other
  misc_feature (704)..(704): n is a, c, g, or t
  modified_base (747)..(747): a, c, t, g, unknown or other
  misc_feature (747)..(747): n is a, c, g, or t
tcagtctacgtagccacgaccggtgctcgatttagtgctatagacttggggtttggggggggagaggacgccccagccttgggatccccaagtgttttcattcagtgatcaggactgaacacagaggactcaccatgggagttcgggctggacgcgttgggtttttccttgctgtactagttacgttaaaggtcgtccagtgtgagtgcgagggtggtcgaggtcggtggggagtccgtaggtacgccgggttcggggtccttaagcgttcncctggtcggtcgtacctcgtggtacttcttacttagagtaagtcggtcgtaggtatgggtacggttcgggtccgaccgtacggtccgacggggaagggtaacggggtcttagggggtaccggtttgggggttacggttaacgtttaaacgtaaaaaggttaaatggtaaggttagggagaaaggtaaaacgtcggtaccgtaacggtacgaaccggaacggtaaaggaaacggtactacgttacccaactacgtaacgtacgaaagtactaattaaaccgtaagtaaaacggtcggttaagttacgttaagaacgtaataacgtaanaccgtaacgaacggtaaaccgaaggactaacgacgttaccgtaacttacggtactactacgaacgtagtaggttacgaacgtcaacgtacgtagaacgtaaaggnggttactagtattcggttactggttacgtaccggtcgggaacncgggtatcggttacgg

SEQ ID NO: 113835 - DNA, 822 bp, Homo sapiens
  misc_feature: GYAE6OF01A3EFN.15.86.H09.1.454.CMB.1.raw
  modified_base (379)..(379): a, c, t, g, unknown or other
  misc_feature (379)..(379): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctattacgttaaaaggtcgtccagtgtagagtgcgagggtggtggagtcggtggggacgtccgttagggtaaacgccggttcggggggtacccttaggacgttcgttccgtggtggtcggccgttcgtggtacttacctacgtttcgaagttaagtggcgtaggtattgggtaggttccggggtacccgaccgacgggtccgtacccggggnggggggacggggcggtgggtacggggttggggttacggtaacggtttaaacgaaaaaggttaaaatagtaaggtaggtagaaagtaaaagtacgtacgtacggagaccgtaccggtaaggaaaggtactacgttacactactctaagaacgtaataactaacgtaaacgaaaacgggtacgttagttagttacaactaaagacgtaaacgacgtaaccgtaaacggaaacggactaaaccgacgtaccggtaccttaaccgttaactttacgtaaccggtaacctaagggttacgtaacggttacgggtaaacgcgtaacgtaacggtacggtaaaacgggtaaggtaccggtaacgttagttacggtttacgtttagaaccggttttcggtacccgggggaccggggtaaccgggaacgggttaacggtcgggtttcccggg

SEQ ID NO: 113836 - DNA, 830 bp, Homo sapiens
  misc_feature: GYAE6OF01AO3D0.15.86.H09.1.454.CMB.1.raw
  modified_base (655)..(655): a, c, t, g, unknown or other
  misc_feature (655)..(655): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttcctgctgctatcttaaaaggtgtaccagtgtggaagtgcgtaggtggtggagtcgtgggggtacgccgttagggtaaacgcccggtgggggggttcccctttaaggacgttccgtcccttggtcggtcgggtcccttctgggtactttccaccgttttaccgaagttaagtgggtccgttagggtagttcgggtaacggtttccggggtaccccggaccgtacgggtcccggttaccggaacggggggaacggggtccggtggggtagggtttcggggggtttacgggttaaaccggttttaaccggtaaaaaaaggttaaaaagttaggtaacgtgggttaaacgaaaggtaaaaagtacggtaacgttaaccgggtcgtaccgtaacccgggtaaggtaaaacggaacgtacttaccgaacgtaactcgtaacgaaaggaataacgttaaactaacgaaaacggtacggttaagttagtttagactaaagtacgaanaccgtacctaaacggaaaacggacgacacgactccgtaattagtactacgacaagtacgttacgtagtaagtgacctagtacggaagtaaacgggagtacgttagttacgttcgttttaagacgttacggttacggacccggggtaccaacgggttaaccgttaagggtcccggg

SEQ ID NO: 113837 - DNA, 799 bp, Homo sapiens
  misc_feature: GYAE6OF01D74BQ.15.86.H09.1.454.CMB.1.raw
  modified_base (550)..(550): a, c, t, g, unknown or other
  misc_feature (550)..(550): n is a, c, g, or t
tcagtctacgtagccacgaccggtgctcgatttagtgctatagacttgggtttgggggagaggagccccagccttggatccccaagtgttttcattcagtgatcaggactgaacacagagactcaccatggagttcggctgagtcgttcggttttccttgctgcttatacgttaaaggtcgtccagttgtagaagtgcgtagggttggtggtaggttcggtgggggacgtaccgtttagggtaaacggtcccgggttcgggggttaccctttaggtacgttccgttccgttggttcggttcggtccgttcgttaggtactttaccgttaccgttttacgtaagttaagttcggtccgttaggtagttaggttacggtttccgggtcccgaccgacggtccgtaccggaagggggtacgggtcgtagggttacgggttggggttacggtaacgttttaaagaaaaagttaaaacgtgtagtaggtagaaagtaaatacgacggtacggacgacgtacggtaagaaagtacgtacttaccactacgtacganaaagtaataattaactaaccgaaaggtcgttagttagttagaaataagacgaactaccgaacgtaaacgaaacgacgacaaccgtacgttacctagttacttagtacctaccgagttacgtacgttaacgagtcgaacgttagtaaaccgggtaaacggtaaacggtcgttaacgttagtttaccggtttctttaacggaacttttacggcccgggttacggacccggttaagaccggttaggtcccgg

SEQ ID NO: 113838 - DNA, 701 bp, Homo sapiens
  misc_feature: GYAE6OF01DY6GU.15.86.H09.1.454.CMB.1.raw
  modified_base (272)..(272): a, c, t, g, unknown or other
  misc_feature (272)..(272): n is a, c, g, or t
  modified_base (401)..(401): a, c, t, g, unknown or other
  misc_feature (401)..(401): n is a, c, g, or t
  modified_base (552)..(552): a, c, t, g, unknown or other
  misc_feature (552)..(552): n is a, c, g, or t
  modified_base (582)..(582): a, c, t, g, unknown or other
  misc_feature (582)..(582): n is a, c, g, or t
tcagtctacgtagccacgaccggtgctcgatttagtgctatagacttgggtttggggggagagagcccagccttggatcccaagtgtttcattcagtgatcagactagaacacagaggactcacgatggagttcggctgagctgggttttccttgactgtcgtatacttaaaggtgtcctagtgtacagtgtcgaggtcggtggatcggtacggggagtccgtaggtaaggccgtcggggttcctagtcgtctccgtagtgtcggtacctgngtactctcttagagtagtcgcgtgtagtcgtagttcggacgtccaggtcctaccgtaggggaaggtcctggtacggttagtcggtacgttaacgtaaaggtaaaacttgacgttaggtacaaagtaagngtacgttacggcgacgtaaaccgtaggtaaaaggagtaccgttcaaccgtagttaaccgagtaaagacgttaaataacgtttaacgaaaacgttccggtaattcgttaaacgaacgtaagtaccggaaacttcggaacctacgtaaaacgngaaactccgaacggtacctactacgtaacngtacccaagtactacggtagtagacgactaccgtaagtaacggtacggaggtttccacgtttgtaccttttaggaccttaacggtccgggtacgtacccggacgttaacgcgtttccgg

SEQ ID NO: 113839 - DNA, 831 bp, Homo sapiens
  misc_feature: GYAE6OF01A2F85.15.86.H09.1.454.CMB.1.raw
tcagtctacgtagccacgaccggtgctcgatttagtgctatagacttgggtttggggggaagaggaagactgacggtcccccaggagttcgggctgagctgggttttccttgctgctatcttaaaaggtgtccagtgtgaagtgcaggtggtggagtctgggggagccttaggtaaagccgtgggggtcccttagagtctcctgtgtggcctctggattcactttcagtaatggctggatgtagttcgggtccgcaggctccgagggaagggctggagtgggtgactttcaaaagtaaatgatggtagaagaaaatgacgtacggtgacctaacccgtaggaaaaggaagactttaccaacgtatctacgaaagacgtaattaaacgttaaccaaaaaacgggtccggttaagtttaactttacggaacctaaaagttcgaaaacgtacgtacccgttaaggaaaaccccgagggaacctacgaggtacccctagttaacttaccgtcgtaaacccgtacgtaacggttaacgttacccgggaaagtcggtacccgtaaagttacccggaaacgggtttaaacggggacggttaactttacggttaccgttacgtttttacggaaactttgttacccgggttacgggggaacccccgtaaagggggtaaccttaaacgggttcgggttccgtaacccgggtttctaccgtttaccggaaccgtacccgttacccggaaacccggtacggtaccccctaggttcccccgggtttaccctttacccccggcgggtacccccctaacccgttaccctccgaaaccggtacccgg

SEQ ID NO: 113840 - DNA, 888 bp, Homo sapiens
  misc_feature: GYAE6OF01BJ46K.15.86.H09.1.454.CMB.1.raw
  modified_base (178)..(178): a, c, t, g, unknown or other
  misc_feature (178)..(178): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaagtntcagtgtgaagtgcgaggtggtggagtcgtgggggacgtccgttaggtaaagccgttggggggtcccttaggagtccttccgtgtggtcggacctcgtggtacttactacgtttcaagttaagtcggtacgtaggattaggtacgggtttcgggtcccgacgtacggtcccgtaccggaggggtaagggggcgtgggtacggttggggttacggtaacgttttacgaaaaaaggtaaaaaagttggaagttagggtaaggtaaaagaaaaacggttaagtaaccggttaccgggtagaacccggtaaaccccgggttaaaggaaaaacggggtaaagtaacgtttaacccgaaaccgtaacttaccgtaacgaaaacggtaaagtaaacttaaaacgtttaaaccgaaaaaacgggtcgggtttaaacgttaagttttaacggaactaaaaacgttacgaaaaccgaacgttaaccccgtaaaaggaaaaaccccgggacggaaaacccgacgtaaaccgggttcccgttaacgtaaacgtttacccttaaccgggttaaaccaaccgtaaggttaacctttaacggggaaacgttcgaacgtaacgtacccggtaaaggttaaacgggacgtcgttaaacgttggttacctttagtaaacttcgggtaccgacgggggttacccgaagggaacccgttaaggtaccggg

SEQ ID NO: 113841 - DNA, 792 bp, Homo sapiens
  misc_feature: GYAE6OF01D20BT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagtcgttgggttttccttgctgctatacgttaaaggtgtccagtgtgaagtgcgaggtggtggagtcgtgggggactccgttaggaaacgtccggtgggggtacccttagacgtctccgtgtcgtggcctcgtgtcttctacttcagtaagtggtctggagtggtaggttcgggtaccgccgacggtccgtaccgggaggggagggtcggtgggtagggtttggggttacgggtacgtttaaacgtaaaaagtaaagtagtagtaggtagaaagtaaagtacggacgttacggtacgaccgaacccggtaaggaaaacggtaagtaacgttaccaaccgtaactcgtaaacgaaaggtaaagtaaacgtttaaacgttaaaaccgtaaaaacgggttaccgggtttaaagtttaagtttaacggtaaaacgtaaacgttaaaggaaaccgtaacggtaccgtaaaacggaaaccggacgtaacgaccgtacgtaccgtacttaacgttactaacggtacccgtaagtaaggttaaccgttaggaacgttcgaaccttaaggtaaccgaaagtaaggtaacggttacgtattggtttacttagttaacgtacgtcgggtaccgaccggtacgtacgtacgttaccggg

SEQ ID NO: 113842 - DNA, 770 bp, Homo sapiens
  misc_feature: GYAE6OF01DCZE8.15.86.H09.1.454.CMB.1.raw
  modified_base (720)..(720): a, c, t, g, unknown or other
  misc_feature (720)..(720): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagtctggtttttccttgctgctatacgttaaaggtgtcagtgtgaagtgcgaggtggtggagtcggtggggagtccgttagggtaaacgtcccgggttgggggttccccttaggacgttccttccgttggttggtcggccttcgtaggtacttcctactttcaagttaagtggtcgtggacgttggtacggttcggggtcccgccgacggtccgtaccggaagggggaacggggtcgtagggtaggttggggtttacggtaacgtttaacgaaaaaggttaaaatgtaagtaggtaagaaagtaaagtagaaccgttacggtcgaccgaaccgtaaggaaaagaagtacttaccgactactacgtacgaagtaataacgttaactaaaccggtaaaacgttcggttaagtttagttacgaaaacgtaagtaaagaaacctcggtaaacccgtaaaggaaaaccccggtaagacccgagtaaacccctcggttaaacttttaacgtaccgtaccgtaaaccgtacgtaacggttacgtacggtagtcgaacgttacgtaacgagggtaagacgttnttaggtcgttattgaccgttgtacccggtacggacacgggtattggtcgg

SEQ ID NO: 113843 - DNA, 771 bp, Homo sapiens
  misc_feature: GYAE6OF01EOFBZ.15.86.H09.1.454.CMB.1.raw
  modified_base (638)..(638): a, c, t, g, unknown or other
  misc_feature (638)..(638): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagcttgggttttccttgctgctatacttaaaggtgtccagtgtgaagtgcgaggtggtggagtcggtggggacgtccgttaggtaaacggtccggttacggggggttacccttaaggacgttccttcccgttggtcggtcggtcccttgtggtactttctactttctaagtaacgtggtacgtggtattggtacggtttcgggtccgccgacggtcctaccgggaggggaacggggtcgttaggggtagggttcggggtttacggtaacgttttaaacgaaaaaggttaaaagtggtaaggttggtaagaaaagtaaaagtacgtaacgtacggtacgaccgtaaccggtaagaaaggtaatacgtacactagtccgaagaagtaagtaactaaacgttaacgaaaacgtgtttaagtacgttagaaacgtaaatacgaacgtacgtaaccgtaaacgaaaaccgtcggaactaccgtacggttaaccttntaaacgttccgtaacgtacccgaagtacgtacggttacgaagtcgaacgtaacgtaccgtaaacgggtaaagtccgttatagttgtttcttagacttacggtccggacgggaaccgaggtacgtaggtcccgg

SEQ ID NO: 113844 - DNA, 847 bp, Homo sapiens
  misc_feature: GYAE6OF01EMVQH.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggctgagcttggttttccttgctgctatacttaaaggtgtccagtgtgaagtgcgaggtggtggagtcgtggggagtccgttaggaacgccggttcgggggttacccgtttagtagtccgttccgtggttcgtcggccttcgtggtactttaccaccgtttgacgtcctaacgttacttggtagtgtacgttcgggtcccgaccgacggtccgtaccggtagggggaacgggggcggtcggggtaggggttcggggtacggtacccaacccgtaagtaaaaccgaaaaaagtacggtaaggaacggttacggaacctaacctaaaccgttaagttacggttaaacggtaaccttcggttagttcgggtaacggttcggggtacccgttaaccgttttacccgtaacccgttcccgttacccgaacggaacggtaaacccggtaccgaaaccccgttaaacggtaaccctaccctaaaccttaaacctacgttaccctttaacgaaccgttaaaacgtaccgtaaaacccgtaaccggttaaccgaaggacccgtaccgggaacgaaaccggttccgggaccgtttaggtacgtttaattacggttagttacggtagacgtagtgtttggtacgttcggtcggggttacgggaccgtaacccggggtctccgggtaccctaccggttccctcgtccgaccgtacccccg

SEQ ID NO: 113845 - DNA, 843 bp, Homo sapiens
  misc_feature: GYAE6OF01DMHH4.15.86.H09.1.454.CMB.1.raw
tcagtctacgtagccacgaccggtgctcgatttagtgctatagacttggggtttggggggagaggacgccccagcccttgggactccccaagttgttttcattcagtgatcaggactagaacacaggacggtactccacctagtgggtaggttcgggctgagtcgttcgggttttcctgctgtctattacgttaaaggtctcctagtgtagagtgcgtaggtgggtggtacgtcgggtggggtcgtccgttaagggtaacgtccgggttcggggttacctaggtctccttcgttggtgtccgtacctgtacggtacttacgttacctttcggtaagttaaggtcggtacggttaggtagttaggggttaccgggttccggggtacccgaccggtaccgggtacccgttaacgggggacggggggtaagggtccggttaggggtacggtttacggggtttacggtaacttttaaaacggaaaaagttaaacgtggtaacgtaggtaagaaagtaaacgtacggtacgacggtcaacgtacggaagtaactagtacctacaacctataccgtaagaagtaaacgtataaacgtaacggtaacgtgttcgttaatacggaaataacggactaccaacgtaaccgtaacggaaaccgtagaaccacgtacgtacttactaagttaccgaaccgacctaaagttacggtaacgtgaacggtagaccgtaaagtaccgggtaaaacgtaaggtcgtaaaggtttcttaacggtttctttaagggaccctttaacgggggacccgggttaacgggaaaccccggttagggttaacggttccggttccggg

SEQ ID NO: 113846 - DNA, 880 bp, Homo sapiens
  misc_feature: GYAE6OF01EOZ3A.15.86.H09.1.454.CMB.1.raw
  modified_base (166)..(166): a, c, t, g, unknown or other
  misc_feature (166)..(166): n is a, c, g, or t
tcagtctacgtagccacgaccggtgctcgatttagtgctatagacttgggtttggggggaagaggaagactgacggtccccccaggagttcgggctgagctgggtttccttgctgctatcttaaaaggtgtccagtgtgaagtgcaggtggtggagtctggggganccttggtaaagcctggggggtcccttagagtctcctgtgtggcctctggattcactttcagtaatggctggatgagttcgggtccgcaggctccagggtaagggctggagtgggtgacgtttcaaaagtaaaatgaatgtgagaaatgactacggtcaccgtgaaaggagatcaacagtctcaagtagaataattacgaaaaaaccgaggtacgtaatttacgactaaaacgttggaaacctagggacccctaaaggaaaaaccccggtagggaaacccaaacgtaggtaaccccggtacgtttaacgtttaacccttaggtttaaacccctaaaccgaaggtaaacgttttaacccgggggtaaagttaaacgggcccttaaagttaacccggtaaaacggtttaaaaagggggaaacccgggtaattaacgtttaccgggtaccttttttttaggaaacctttaacggtttcccgttaaggggggcccccccgttaaagggggttaaacccgaaaagttaccggggggttaccgttcccgggttaccgtttaccttttaaacccgggccgtacccccgttacccccggtaaacccgttaaacccgggggaaccccgtacccggttaaccggtttccccgtttaccccccccgttgggggttacccccctaaaccccccgggtacccctttaccccgtaaaacgtaacccggg

SEQ ID NO: 113847 - DNA, 633 bp, Homo sapiens
  misc_feature: GYAE6OF01AICON.15.86.H09.1.454.CMB.1.raw
  modified_base (439)..(439): a, c, t, g, unknown or other
  misc_feature (439)..(439): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtgatggagtcgtggggggagtccgttagggtaaacggcccgtgggggggttcccttaggacgtctccgtggtgtgggcctcgtggtattctacttttcgagtaatggctggatgagttgggtccgccgaggctccggaggggaaggggctgggagtgggttggtaacgtttacaaaagtaaaatggagtggagaagaaatagacgtacggtcgacgaccgtagaaggaagattacacatcncaagagtataattacaaaacgtggtagtattagacaagtagaacagaccagaaaacgaggaacacgacgtcctaacgtattacgtactaccagacgtagttacggaagtcgacacgtacggaacggtaagggtacgtattaagtgttacgttttagacgttacgtcggtaccggggaccgagggtactaacggg

SEQ ID NO: 113848 - DNA, 927 bp, Homo sapiens
  misc_feature: GYAE6OF01EPLII.15.86.H09.1.454.CMB.1.raw
  modified_base (908)..(908): a, c, t, g, unknown or other
  misc_feature (908)..(908): n is a, c, g, or t
tcagtctacgtagccacgaccggtgctcgatttagtgctatagacttgggtttgggggggagaggagcccccagccttgggactccccaagttgttttcattcagtgatcaggactgaacacagaggacctcaccatggagttcgggctgagtcgttgggttttccttgtctgtcttattacgttaaaaggtcgtccagttgtgaagtgacgtagggtggtggaggtcggtgggggtacgtccgttagggtaaacggtccgggttcggggggttcccttaaggtacgttccttccgttggttcggtccggtccttcgttggtactttccgtacttttacgaaggttaaggttcggtacggttaggtacggttagggttacgggttcggggtaccccggaccggtaccgggtcccggtacccgggaaggggggtaacggggtccgggtaggggtaggggttttggggggttaacggttaaaccgtttaaaacgtaaaaaaggttaaaaagtggtaaggttagggtaaacggtaaaagtaaaacggtaccgtaacgtaaccggtcgaaccggtaaccggaaggaaaacgtactaaccgtacctaactaccgtacgtaacgaagtaaactaattaacgtaaaccgtaaacggttcgttaatttaagtacgaaagtaaagtacgaaccgacggtaaccgtaaacggaaaaccgcgaactaccggtaacccgttactttacgttaaccgtaccgttaccggaacctacgtaacggttacggtaacggttacgacgtaccgaagggttaaccgaaaggggttaaaacgtcgggttaactttaacgggtttcctttaaaggtttaaccgtagttacccggggttcgggaacccgggggtaccccggttaaacggnggttaacccggtttccggg

SEQ ID NO: 113849 - DNA, 814 bp, Homo sapiens
  misc_feature: GYAE6OF01EC7VA.15.86.H09.1.454.CMB.1.raw
tcagtctacgtagccacgaccggtgctcgattttagtgctatagacttgggtttgggggggagaggagccccagccttgggatccccaagtgttttcattcagtgatcaggactgaacacagaggactcaccatggagttcgggctgagcttggttttccttgctgctatacttaaaaggtgtccagtgtgaagtgcgaggtggtggagtcgtggggagtccgttaggtaacgtccggtgggggttcccttagacgttctccgtgtgtcggtcctcgtggtacttctactttcagttaatggcgtggattggtaggttcgggtccgcgacggtccgtaccggaaggggaacggggcgttgggtagggtttggggttacggtaacgtttaacgaaaaaggttaaaagtgtaagttagggtaagtaaagtaaaacgtacggaacgttacggtacgtaccgtaaacccggtaaggaaaacgtaacgtaacttaccgaaccgtaattaccgtaacgtaaaggaagttaaacgttaaacgttaaaccgtaaaaaacgggttacggttaagtttaacgtttagtaaactaaagtacgaaacgtaacgaccgttaaacggaaaaccggacggaacaaccggacgtacccgttacttaacgttacgtaacgtaaccgacgtaaggttaacgttacgggtaagtacggacgtaacggtaccggtaaaacggttaaagggaacggttattaggttacggttacgtttagtaacgtacggttaccggtaccggggaacccgtaagggtaccgtaagggttccggg

SEQ ID NO: 113850 - DNA, 922 bp, Homo sapiens
  misc_feature: GYAE6OF01DY6DA.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacgttaaaaggtgtccagtgtagaagtgcgaggtggtggagtcgtgggggagtccgttaggtaaacggtccgtcggggggtcccttaggacgttccttaccgttggttgtcggtcctacgttggtactttctacttttacgagttaagtcggacgtggtattggtaggtttcggggacccgtccgaagggtccgttaccgggaagggggtaacgggggtcgttaggggtacgggtttgggggttacgggttaaccggttttaaaccgaaaaaaaggttaaaaacgttaggtaagttacgggttaagaaaggtaaaaagttacggtaacgttacgggtacgaccgtaaacccggtaaggaaaacgggtaggtaactttacccgaacctaattacccgtaaacgaaaggtaaagttaaacgttaaacggttaaaccgtaaaaaaccgggtaccggtttaaggtttaagttttaacggaaaccgttaaagtaaacggaaacgttaaccgtaacccgtaaacgggtaaaaaccggaaccggtaaacgaaccgttaacccggtaacccggtttcctttaaacgttaaccgtttaaccggtaaccctaacggtaacgttaacggttacgggtaacgtcgaactaacggttaccggaaaacgggtaagggaccgtatttaagggttactttggtttaacggtaattacccgggttcgggtaacccgggccggttaaaacgggacgttaagggttcccgg

SEQ ID NO: 113851 - DNA, 951 bp, Homo sapiens
  misc_feature: GYAE6OF01AE8GC.15.86.H09.1.454.CMB.1.raw
  modified_base (226)..(226): a, c, t, g, unknown or other
  misc_feature (226)..(226): n is a, c, g, or t
  modified_base (804)..(804): a, c, t, g, unknown or other
  misc_feature (804)..(804): n is a, c, g, or t
tcagtctacgtagccacgaccggtgctcgatttagtgctatagacttggggtttgggggggagaggagccccagccttgggatccccaagtgttttcattcagtgatcaggactagaacacgaggacggacctccaccagtgggtaggttcgggctggacgtcgtttgggtttttccgtgtctcgtctaagttaacgttaaaggtcgtcgaggtgtagtaaggtgngtgggtgggtggtggtcgggtggggacgttcggttagggtaaccggtccgggttacggggtcctaggtcgtctcggtgtcggtacgtccgtgtacggtattccttacgttacgtagttacgtggttcgtaggtagtggttcgggttaccggggtccccgtacgtcgggtacccggtacgggggaacggggggtacggggtccggttagggggttacgggttttacggggttaagggttaaacccggttttaaaaagggtaaaaaacgtttaaaggtcgggttaagggttaacgggttaaaaggtaaaaggttaaaacggttaaccggttaacccggggttaacgggtaaccgtaaacccccgggtaaacgggtaaaagggttaaaaccggtaaccggtttacctaacccgtaaacgttaacccttaactaaacgggtaaactaaagtttaaacgttaaaccgggtaaaccggtaaaacggtttcggtttaattacggtacgaaaccgtaaaggtcaaacgtacggaccgtaaaccggaacgtaccgactaccggtcttacctagttaacctccgtaanacgtaacggttacgtaacggtcaggtaccgacgtaaggtaaccgggtaaaggtcgttaaccgttcggtttaaagttccgttaggttccgttaagtcgggtaacccggggaaccggttagggaaacggtcgggtttacgttacccggg

SEQ ID NO: 113852 - DNA, 1064 bp, Homo sapiens
  misc_feature: GYAE6OF01C71TZ.15.86.H09.1.454.CMB.1.raw
  modified_base (718)..(718): a, c, t, g, unknown or other
  misc_feature (718)..(718): n is a, c, g, or t
tcagtctacgtagccacgaccggtgctcgatttagtgctatagacttgggtttgggggggagaggagccccagccttgggatccccaagtgttttcattcagtgatcagactgaacacaggacgtactccaccagtgggtacggttcgggctggacgtcgtttgggtttttcccttggctcgtacttacttaacgttaaaaggtcgtacctagtgtagaagtgcgtaggtgggtggaggtcggtaggggacgtaccgttaagggtaaccggtccgggttaccggggggttacccttaaggtacgttccgttccgttggtcggtccggtaccttcggttaggtactttcttaccgtttacgaagttaagtcggtacgtaggtagtaggttacggttaccgggtccgacccggaggtaccccgtaccggggaagggggtaacgggtccgttaggggagggtttacggggtttacgaaaccggtttaaacgtaaaaaaggttaaaagtcggtaaaggtagggtaagaaaaacggtaaaactacgggttaaaccgtcggtaacgacccggtaaacccggtaagggtaaaacggaacgttaacctacctaaccgtagttaccgtaaacggaaacggttaagtaaaactttaaccgtaaaacgaaaaccggggttcgttttaaagtttcgtaaacgtaaaagtaaaccgtacggtaaaaacccncgggttaaccccgtaaaaacgggtaaaacccgggagtaaccccgtaaacccgggttaaggttacccccgttttaaattaaaaccccggtttaaccgtttccggggaaaaaccccttaacggggtttaagttaaacccggggttttacggaaaacggttttcccgaaaccggttttccgggtaaaaaacccgggaaaccggggggttaaaccgtccgggttaaacgttaggttttaaccggttttaggtttaaaacccggggttacttaacccgggggtttaccccggggtaccccggggtacccggggaaaaaggtttcccggttaaccgggggtttacccccggg

SEQ ID NO: 113853 - DNA, 834 bp, Homo sapiens
  misc_feature: GYAE6OF01BP6L2.15.86.H09.1.454.CMB.1.raw
  modified_base (609)..(609): a, c, t, g, unknown or other
  misc_feature (609)..(609): n is a, c, g, or t
tcagtctacgtagccacgaccggtgctcgatttagtgctatagacttgggtttgggggggagaggacgccccagccttgggatccccaagttgttttcattcagtgatcaggactgaacacagagactcaccagtggagttcgggctgagtcgttggttttcctgctgtactattacgttaaagtcgtcagtgtagagtgcgtaggtggtaggtagtcggtggggactccggttaggtaacggccgggttcggggtaccttagcgtctcgtgtcgtcgtcctgtgtacttctacttacgagttagtggtcgtggtagttggtaggttccggaccgcgtacggtccgtacgggaaggggtacgggcggtgggttacggttggttacggttaaacgttaaagtaaaaaggtaagttggtaaggtagggtaaagaaaacgtaaaacgtaggtaaccgtaggtacgaccgtaaaccggtaaaggaaacgtacgtacctacgactagtaccgaagaactaacgtaaattaactaaaaccggaaacggttggttaagttacgtttaagaaacgtaaagtacgaaacgtaaccggtacgtaaaaccggaaaccggngtaacccgacgttaccgtaccgtttaacgttaactttaacccggtaacccgtaaccaacggggttaacgttaacgggttaactaaccggccgtaaacgttacgggtaaacgaaaaccggggttaatacgggtctttacgtttaaggtttcgttttacgggaaccttttcccggggtaaggggtaccccgggtaaggaaacccggttaggttacgggtttccccgg

SEQ ID NO: 113854 - DNA, 791 bp, Homo sapiens
  misc_feature: GYAE6OF01CHE0L.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcgggctgagcttgggtttcctgctgctatacttaaaaggtgtccagtgtagaagtgcgtaggtggtggagtcggtggggagtccgttaggtaaacggtccggtggggggtcccttaggtacgttccgtccgttaggtggtcggtccttcgttaggtatttcctaccgttttagaacggttaagtacgggtaccgttagggtaattgggtaacgggtttccggggtccccgccggaacgggtcccgtaccggggaaaggggggaacgggggtccgttaggggtaggttggggttacggtaacgtttaaacgaaaaagttaaaagtgtaggtaggtagaaagtaaaagtacggtaacgtaacggtacgtaaccgtaaccgggtaaagaaaaggtacgtaacgttacaactacgtacctaacgaaacgtagtaaacttaaacgtaacgaaaaacggttcgttaagttaatttggaaactaaaagcgaaaccgacggtaaccgtaacggaaaaccggtcaaacgtacgtacgacccgttaattacgtaacgtactaaccaaggtataacgtcgaagtcacgtagtacggtaaaggtagcgtaacttagacgtttcttaagacgttcgaccggtacggacccgaagggacttgggtacg

SEQ ID NO: 113855 - DNA, 755 bp, Homo sapiens
  misc_feature: GYAE6OF01DPDDR.15.86.H09.1.454.CMB.1.raw
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
  modified_base (459)..(459): a, c, t, g, unknown or other
  misc_feature (459)..(459): n is a, c, g, or t
  modified_base (558)..(558): a, c, t, g, unknown or other
  misc_feature (558)..(558): n is a, c, g, or t
tcagtctacgtagccacgaccggtgctcgatttagtgctatagacttggggtttgggggggagaggagccccagccttgggatccccaagtgttttcattcagtgatcgaggactagaacacagaggactcacagtggagttcgggctgagtcgttggttttcctgcgtgtactagtacgttaaaggtcgtacagtgtagtagtgcgaggtggtggagtcggngggacgcgttaggtaacgcggttcgggtcctagngtctcgtgtcgtcggtcctcgtggacttactcgttagtacgttaagtcggtcgtagggtaagtggtacggttccggggtccgaccgtacgggccgttaccgggaggggtagggacgttggggttacggtttacgggttaacggttaacgttaaaagaaaaacggttaaaatgggtaacggtaggtaaacgaaaagttaaacncggtaaacggttcgaacggaccgtaacgaaaggaacgtagcctacgtaacgtaactacgactaaaggactaagtaacgtaacgaagttcgtaatgtaanaacgaataacgactagaaccgtaacgaacggtacaacgacgtaccgtacgtacgttaaacttaccgaaccgtaaccgtaagtacgttaacgtacggtaatacggtacgaacgtaacggtaaccgaaaggtcgttaactggtactttaggttaccaagttccggtaccggacgggacgtacggtaaagtgggttaccg

SEQ ID NO: 113856 - DNA, 834 bp, Homo sapiens
  misc_feature: GYAE6OF01CWN4K.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcggctgagtcgttgggttttcctgctgtactatacgttaaaggtgtcagtgtagaagtcgagaggtggtaggagtcggtggggacgtacgttagggtaaacggtccgggttcgggggtacccttaggacgttcctcgtggtcggtcgccttgtgtacttctacttacaagtagtcggtgtaggtataggtacggttcgggaccgacgacggtcgtaccgggaagggggtacgggtgtacggggtaggtagggttacggtaaccgttaaaagtaaaaaagtaaagtggtaagtacgggtaaagaaaaggtaaaagtaacggtaacgtacgggtacgaacccggtaacggaaaggaaaacggtaatactaccgaactataccgaagaaacgtaaactaacttaaacgtaaaccggaaaacgggttgttaacgtttaagttaacgaaactaaacgtaacgaaaccgtacggtaaccctaaaacgggaaaccgtcggaaacctaacggtacggttaccttaacttaacggttccaaccggtaccaaacgtaggttaacgtaacggtaactacggaactaacggttaaacggaaaacgggtaacggacgttacgtaaggttacggttttcgttaaagaacggtttacccgttaacccgggggacgggtaaacccggaagggttaacgttaccgggtccggg

SEQ ID NO: 113857 - DNA, 815 bp, Homo sapiens
  misc_feature: GYAE6OF01EQJAF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagtcgttgggttttccttgctgctatacgttaaaggtgtccagtgtgaagtgcgaggtggtggagtcggtggggtacgtccgttagggtaaacgtccggttcgggggttacccttagtacgttctccgtgttcggtcggtccttgtggtacttactactttacgagtagtcggtacgtaggagttggtacggtttccgggacccgtaccggtacggtaccgtaccggggagggggaacgggggtcggttaggggtaggggtttacggggttttaacgggttaaaccgttttaaacgtaaaaaaggttaaaagttcggttaaggttacgggtaagtaaaagtaaaacgtacggtaaccggttaaccggtacgaacccgtaaacccgggtaaaggaaacggtaagttaaccgttaacccgtaacttacgtactaaacgaaagtaacgtaaacttaaacgtaaacgtaaaaccggtgttaacgttaagttacgaaacgtaagtaacgtaaacgaccgtaacgtaaccggaaacgacgtaacacgtacgtacccttataaccgtacgtacgtacagttacgtagttacgaagtctacgaaggtacgaaggtagacgtacgttgtagtttcgtagaacttcggtacgggaccggtacgacggtgtacgggttccg

SEQ ID NO: 113858 - DNA, 795 bp, Homo sapiens
  misc_feature: GYAE6OF01ESEVL.15.86.H09.1.454.CMB.1.raw
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (692)..(692): a, c, t, g, unknown or other
  misc_feature (692)..(692): n is a, c, g, or t
tcagtctacgtagccacgaccggtgctcgatttagtgctatagactttgggtttggggggagaggagccccagccttgggatccccaagtgttttcattcagtgatcaggactgaacacagaggactcaccatggagttcgggctgagcttgggttttccttgctgctatcttaaaaggtgtcagtgtgaagtgcaggtggtggagtcgtgggggagtccgttggtaaagccgtgggggtccttagngtctctgtgtgcctctgnttcacttcatagnggctggatggaggttcggtccgcgacggcgtccggaggggaaggggtcgtgggtagggttcggggtggtacggtttaacgaaaaaggtaaaagtgaagttggtagtaaagtaaaatagaaccgtacggtagaccgtaacccggtagaaaacggaagtacttaccgaacctacttacgtaaacctaaggtaacgtaaattaaacgttaaaccgaaaaacgggttacggttagttaacttttaacggaactaaaagtacggtaaactaaccggtaacgtaaaccggaaaaaccggcggaaccgaaccgaacggtcccgtaactttacgttaaccgttacggtaacccctaagtaacgttagttaaccgggaagtaccgtaactacggttaacccggtaaaagggttaaaaccgggngggttaccgtttaaagttaccgggttactttttagggaacttacggtttacccgggtaccgggggtaaaccccgaaggggttaacccgtaaggggttcccggg

SEQ ID NO: 113859 - DNA, 823 bp, Homo sapiens
  misc_feature: GYAE6OF01BTHVO.15.86.H09.1.454.CMB.1.raw
  modified_base (756)..(756): a, c, t, g, unknown or other
  misc_feature (756)..(756): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggaggtcgtgggggagtccgttagggtaaacggtccggttcggggggttaccccttaggtacgtcctcccgtggtggtcgggtcccttacgtggtacttacgtactttcgaaagttaagtcggtcgtggattcggtacggttcggggtcccggtaccgacggtcccgtaccggaagggggtaacgggggcggttggggtacggggttgggggtttacgggttaaaccggtttaaacgtaaaaaaaggttaaaaacggtgtaagttaggggtaagaaaaggtaaaaacgtacggtaacgtaaccggtacggaacccgtaacccggtaaggaaaaggtaaacgtaacttaaccgaacccgtactactaacgaaagaagtaattaaacgtaaccgaaaaacgtcggttaagttagttaacgaactaaacgtacgaaaacgtacggtacctaaacggaaaaccgacggaaccaacgaccgtacctaacttacgtacctagtaacccaacgtaacgttaagttcgaagtcgaacgacgtaccgaaaggtaaacggngtacgttattacggttctttaggaactttacgtacgggtaccgggaccgaaggtacgtagggtccgg

SEQ ID NO: 113860 - DNA, 757 bp, Homo sapiens
  misc_feature: GYAE6OF01AK6KR.15.86.H09.1.454.CMB.1.raw
  modified_base (412)..(412): a, c, t, g, unknown or other
  misc_feature (412)..(412): n is a, c, g, or t
  modified_base (447)..(447): a, c, t, g, unknown or other
  misc_feature (447)..(447): n is a, c, g, or t
  modified_base (548)..(548): a, c, t, g, unknown or other
  misc_feature (548)..(548): n is a, c, g, or t
  modified_base (740)..(740): a, c, t, g, unknown or other
  misc_feature (740)..(740): n is a, c, g, or t
tcagtctacgtagccacgaccggtgctcgatttagtgctatagacttgggtttgggggaggaggagccccagccttgggatccccaagtgtttcattcagtgatcaggactgaacacagacggactcaccgatgggagttcgggctgagctgggttttccttgctgctatacttaaaggtgtccagtgtgagtgacaggtggtggagtcggtggggacgtcgttaggtaaacgtccggtcggggggtacccttaaggtcgtcgttccgtggtgtcggcccttgtaggtacttcgtacttcgagttacgtggtcgtaggattcggtaggttcgggtaccgtccgaggtccctacggaggggacggggtcgtgggtaggtagggttcggtacgtttaacgaaaaggttaaacgngtaacgtggtaggaagtaaagtacgacgtacggtnacggtaaccgaggaacggtaacgcttacgaactagttaccagtaagacgtaataacgtaacgtaaaacgtggttacttagtacgtaaataagtacgaaacngtaaccaacggtaaccgagacctatcggtaaccctcgtaacttacgttaccgaaacgtacctggtaaccgttagaacggtctaaccgggacttaacccggtaaacggggtaaagacggggttaccctaggtttaccgttcgttaacccggaaagttccgtttaacccgggacccgggttacgaaaccgggtnttaccgggttaaccggg

SEQ ID NO: 113861 - DNA, 839 bp, Homo sapiens
  misc_feature: GYAE6OF01EFBQ1.15.86.H09.1.454.CMB.1.raw
  modified_base (121)..(121): a, c, t, g, unknown or other
  misc_feature (121)..(121): n is a, c, g, or t
  modified_base (392)..(392): a, c, t, g, unknown or other
  misc_feature (392)..(392): n is a, c, g, or t
tcagtctacgtagccacgaccggtgctcgatttagtgctatagacttgggtttgggggggagaggagcccccagccttgggatccccaagttgttttcattcagtgatcaggactgaacanagaggactcaccatggagttcgggctgagcgttgggttttccttgctgctatacgttaaaaggtgtccagtgtagaagtgacgaggtggtggtaggtcggtggggtacgtccgttaggtaaacggtccgggtcgggggtacccttagacgttcctccgtgtgtcggtcctgtgtattctactttcagtagtgtcgtgagtgaggttcggtccgaccgtaggcctccggaggggaagggtcgtgggtgggttgggttacggtacgtttaaanaaaaaggttaaactggtaagtggtaagaaataaaagtacgtacgtaggtcgaaccgtaaccggtaaggaaacgggtaactatacccgtacgtactacgtacgaaaagtactaaattaaaccgtaacggtaaaacccgtggttaagttacgttacaaacgtaaatacgaaacgacgtaacgaaccggtaaaaccgggataacccgaaccgtccggttaactaccgttttaaccgaacgtttacccgaaaccgtaacgtaaacgggtttacgtaacgggaacgttacccaagtaaaccggttaaacggtaaaccgggtaaaaaggtcgggtttaaccctaagggtttaaccgttttcgttaaaacgggttacccttacgggttaacccggggttaacgggaaccccccgggtaaggtaaaccgtttcccgggggttttaaaccccgggg

SEQ ID NO: 113862 - DNA, 1005 bp, Homo sapiens
  misc_feature: GYAE6OF01BM9B6.15.86.H09.1.454.CMB.1.raw
tcagtctacgtagccacgaccggtgctcgatttagtgctatagacttgggtttgggggggagaggagccccagccttgggatccccaagtgtttcattcagtgatcaggactgaacacagaggactcaccatggagttcggctgagcgttgggttttcctgctgctatacttaaaggtgtccagtgtgaagtgcgaggtggtggagtcggtggggactccgttagggaacgtccggtgggggttacccttagacgttctccgtgtcggtcggtcctcgtaggtacttcgtactttcgaagttagtcggcgtaggtagtggtacggttccgggtcccgaccgacggtccgtacccgggtagggggaacggggtccggtaggggttagggtttacgggttacgggttaaccgttaaaagaaaaacggttaaagtaggtaggttaaggtaagtaaaacgtaaaacggtacggtaacggttaccggtaccgtaaccggtaacccggtaaaggtaaaacggaacgttaacccgtttaccgaaccgttaaccttaaccggtaacgtaaaaggtaaccgtttaaacgtttaaaacccgtaaacgggtaaaacccggtttacgggtttaacgttttaaaccggtttaaacggaaaaccccgtaaaaggtttaaccggaaaccgttaaccccggtaaaccgggttaaaaaccccgggaaaaccgggtaaaccggtaaccctaaccgggttaacccgtttaacccggtttaaccgttaaaacgtttacccggttaaacccgggtaacctaaaccggttaaaccgggtttaccggtaaaggttaaccggtacgtaaccggttaaaccgggttaaacgggtaaaccgggtaaagggttaccgttacgtttaaggtttacgggttttaccgttaacggtttaccgttacccgggtttcccggggaaacccggggttaaccgggaaaccggtttacgggttaaaccggtttccccgggg

SEQ ID NO: 113863 - DNA, 719 bp, Homo sapiens
  misc_feature: GYAE6OF01CML8X.15.86.H09.1.454.CMB.1.raw
  modified_base (635)..(635): a, c, t, g, unknown or other
  misc_feature (635)..(635): n is a, c, g, or t
tcagtctacgtagccacgaccggtgctcgattttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgagtgcgaggtggtggagtcgtggggagccgttaggtaaaggccgtgggggtcccttaggagtctcctggtgtggcctctggattctactttcagttaatggctggattggtaggttcgggtccgccgaggtcctccggagggggaaggggcgtggggaggttggggttggtacggtttaacgtaaaaaaggtaaaagttggtaagtgggtaagaagtaaaagtagaacgtacgggtacgaccgaacccggtaaggaaaagggaagtacttaccaactacttactacgaaagtaagtaattaaacttaaccgaaaaacgtaccgggttaagttatttagaacgtaaaatagtaaacgacgacccgttaagaaacccggaagaaccgaacgaacgtaccgttaattactttaacgtacgtaccaacgtaagtacgttacggtacgngactagtacgacgtaaaggacgtacgtagttcgttcgtttagtattacgttcggtacgggacccgaggtacgtaaggtttcggg

SEQ ID NO: 113864 - DNA, 974 bp, Homo sapiens
  misc_feature: GYAE6OF01DRVLH.15.86.H09.1.454.CMB.1.raw
  modified_base (182)..(182): a, c, t, g, unknown or other
  misc_feature (182)..(182): n is a, c, g, or t
tcagtctacgtagccacgaccggtgctcgatttagtgctatagacttgggtttggggggaggaggagccccagccttggatcccaagtgtttcattcagtgatcaggactgaacacagaggactcaccatcggagttcgggctgagcttgggttttccttgtctgtctattacttaaaggtntcctagtgtagtagtgcgtaggtggtggagtcggtgggggagtccgttaggtaacgccggttacgggggtcccgttacggtacgttccgtccgtcgtcgtcggtcccgttccgtaggtacttcgtaccgtttacgtaaggttaacgttcggtaccgttaggttagttaggttacggttcgggtaccgacccggaggtcccggtaccgggaacgggggtaaccgggtccggtagggtacgggtcggggttacgggtaacgtttaaggaaaaacgttaaggtgtagtaggtaagaaaggtaaagtacggtacgttaacggacgtaccggtaaccgtaagtaaaacgggaaactttacttacccgaaaccgttacgtaaccgtaaacggtaaaggaaacttaaacggttaaatttaaacccggaaaaaaccgggttccggttttaacggtttaactttaaacggaaaaccgtaaacgtaaaccggtaaaacccgaaccggttaaacccggtaaaacggtaaaaccccgggtacgggtaaaccccaacccgggttaaaccgtaacccgtttaacgtttaaccgttaaaccggtttaccggtaaacccgttaacgggtaacggtttaccggtaacggggttaaacgttccgggaaacgttacccggtaacccgggtaaagttaaaccggggttaccgtaaccgttaggttacccgggtttattttaaccgtaaaggtccccggttttaaggggacccgggttacccgggaaacgggttaccgttacgggttaccggg

SEQ ID NO: 113865 - DNA, 849 bp, Homo sapiens
  misc_feature: GYAE6OF01CS7NG.15.86.H09.1.454.CMB.1.raw
  modified_base (362)..(362): a, c, t, g, unknown or other
  misc_feature (362)..(362): n is a, c, g, or t
tcagtctacgtagccacgaccggtgctcgatttagtgctatagacttgggtttgggggggagaggagccccagccttgggatccccaagttgttttcattcagtgatcaggactgaacacagaggacctcaccatgggagttcgggctggagcttcgggttttccttgctgtctatacgttaaaaggtgtctagtgtagaagtgcgtagggtggtggagtcggtaggggcgtccgttaggtaaacggtccgggtcgggggttacccttaggtacgttcctccgtggtggtcggtcccttcgtggtattccgttactttcgaagttaagtggtcgtaggtagtggtacggttcggggtacccncgacggtccggtaccggaagggggtacgggcgtgggtagggtcggggttacgtaacgtttaaacgtaaaaagtaaaagtgggtaagttaggtaagaaaacgtaaatacggtaaccgtacggtacggaccgtaacccgggtaaggaaacggtaactactacctaactaactaaccgaacgtaaacggtaaataaacgttaaacgttaaaaccgtaaaacggtttcggttaacgtttaacgttaaacgaaactaaaacggtttaacgaaaaccgttaccggaacccgttaaaaacgggaaaacccggtaacggtaacccaaccggtaacgttaccccgttaacgttaacgttaacccgttaagaaacccccttaatacgtttaacggtacgaacgtgtaacgtacgaacgggtaaacgaaggttcgtaactagttcgttcgtttaagcttaaccgggtcggtacccgggataggtaaacggtcgttcgg

SEQ ID NO: 113866 - DNA, 951 bp, Homo sapiens
  misc_feature: GYAE6OF01BSW7V.15.86.H09.1.454.CMB.1.raw
tcagtctacgtagccacgaccggtgctcgatttagtgctatagacttgggtttgggggggagaggagccccagccttgggactccccaagtgttttcattcagtgatcaggactgaacacagagactcaccagtggagttcgggctgagtcgttgggttttcctgctgtcttattaacgttaaaggtcgtaccgtagttgtagtaagtgacgtagggttgggtaggtaggttcgggtaggggacgttaccggttaaggggtaacggtcccgggttacgggggttaccttacggtacgttccgttaccgttggtcggttccggtaccgttacgtcggttactttaccgttaccgtttacgtaaggttaacggtcggtacgttaggaagtttacgggttacgggttcccgggtccccgacggtaccgggtaccggtaaccgggggaacggggggtaacgggcggtttaggggtacggggtttcggggtttaacggttaaaccggttttaaaacgtaaaaaaggttaaaggtggtaaagggttacggtaagaaaaaggttaaacgtaacggtaaccgttaccgggacgtaaccggaaaccgggtaagaaaacgtcgtaaccttacgactactacgtaacgaaagtacgtaaacgttaaagttaacccggaaaggttccgtttaagtaacgttacgaaataaacggtcgaaacgttaacccgaacggtaaaaccggaaacgtaccgtacctaacggtcccgtttaccgttaacctttacggttaaaccgtaaccgtaacctaacggttaacggtttaaccgttaggggaaacctccggtaaagtaccgggttaaaggaaaccgggttaacgttcgtccgttaagttacccgtttgggtaacctacgttacgggtccgggacccgttaacggggatttaacccgggtgtttcccgg

SEQ ID NO: 113867 - DNA, 825 bp, Homo sapiens
  misc_feature: GYAE6OF01DWPVQ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacgccgttcggggggtcccttagagttctccgtgtgtcggcctcgtggtattctactttacaagtaagtggacttggatggtaacggtttcgggtccgacccgaggtcctaccggaagggggaacgggggtcttagggggtagtttcgggggttaggtaaccgttttaaacgaaaaaagggttaaaaatggtaagttagggtagaaaaggtaaaaagtacgaacgtaacggtgacccgaacccggttaaggaaaaacgggtaagtaaacttacccgaaccctagttacctaaccgtaaaaggtaaacgtaaatttaaaaccgttaaaccaaaaaaacgggttcggtttaagttaagttttaacggaaactaaacggtaagtaaaccaacgtaccgtaaacggaaaaacccgggaggaaccaacgaacgtacccgttactaacgtttaacctacgtaaccaaccgtagtaacgttacgggaaagttcgaacgtaacgttacggaaaacggttaaaagggcggtaacttaagggtcttaacttttagggacttaacgttaccgggaccggggtaccgaagggtaacctagggttccggg

SEQ ID NO: 113868 - DNA, 802 bp, Homo sapiens
  misc_feature: GYAE6OF01CE5W4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcacatggagttcggctgagcgttgggttttccttgctgctatacgttaaaaggtgtccagtgtagaagtgacgagggtggtggagtcggtgggggacgtccgttagggtaaacggtccggtacggggggttcccttaggtacgttcctccgtgtggtcggccttcgtggtacttctacgtttacgagttaacgtggtctaggtagtggttacgggttccgggtacccgaccgtacggccgttaccgggaagggggaacgggggtcgtaggggtaggttacgggggtttacggtaacgtttaaaggtaaaaagttaaaaagtcggaaggttagggtaagaaaacggttaaagtaacggtaacgtacgggtaccgaaccggtaacccgggtaagaaaacgggtaactaacgttaccacctaagtcctaaagaaacgtaataaacgttaacgtaaacaaacggtacggtttataaactttaggaaactaaagtaacgtaaacgtacgaacccgtaagaaaacccgtggaaccctacggacgtacccttataactttacgaccctaacgagttaagacgtttaggagttaccacgtagtaacggtaacggtaggaaccgtgttacgtagtttcgtaactagtaccgggttcggaccgggtagaacggtgtaggttcccg

SEQ ID NO: 113869 - DNA, 957 bp, Homo sapiens
  misc_feature: GYAE6OF01A5UIH.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggtttttccttgctgctatacgttaaaaggtgtccagtgtgaagtgcgaggtggtggagtcggtgggggagtccgttagggtaaacgccggttcggggggttaccccttaggtacgttccttccgtggttggtcggtcccctcgttggtactttcctacttttacgtaagttaagttggtcgttagggagttgggtacggtttcggggtccccggaccgtacgggtccgtaccccggaaggggggaacgggggtcggtagggtacggggttgggggtttacgggttaacggttttaaacgaaaaaaggttaaaaagtggtaagttagggttaaggaaaaggtaaaagtaacggtaacggttaccggtacggacccgtaacccggggtaagaaaacgggtaagtaacttaccgaactacttaccgtaacgaaagtaaggtaaattaaacgttaaacccggaaaaacggtaccggtttaagttaacgttaacggtaaactaaaagtacgaaaaccgaccggtaaccgtaaaccggaaaaacggtaccggtaacgaaccgtccggttaacccggtttaacttaaccgtttaaccggtaaccgttaacccgaaacgttaacggttaaccggtttaacgggaacggtttaacgaaccgtttaacgtaaaccgggtaaacggggtaaaagggtaacggttacccggtttatttaacgggtttaccgtttttaagaacggtttaacccggttaccggggttaacccggggacccggtaaaacggggttaaccctaagggggttttccccggg

SEQ ID NO: 113870 - DNA, 866 bp, Homo sapiens
  misc_feature: GYAE6OF01A8N5Y.15.86.H09.1.454.CMB.1.raw
  modified_base (117)..(117): a, c, t, g, unknown or other
  misc_feature (117)..(117): n is a, c, g, or t
  modified_base (201)..(201): a, c, t, g, unknown or other
  misc_feature (201)..(201): n is a, c, g, or t
tcagtctacgtagccacgaccggtgctcgatttagtgctatagacttgggtttggggggagaggagccccagccttgggatccccaagtgttttcattcagtgatcaggactgaacncagaggactcaccatggagttcgggctgagcttgggttttccttgctgctagtacgttaaaaggtgtccagtgtagaagtgcgnggtaggtgagttcgtgggggatccgttaggaacgtccggttcgggggtacccttaggacgttccgtccgttggttcggtacgggtccctcggtgggactttccgtaacgttttccaaggttaatcgggtctagggtattaggtacggtttcggggacccgtacgagggtcccttaccgggaagggggaacgggtccgttaggggtacggttggggtttacgtaacggtttaacgtaaaaaaggtaaagttcggtaaacgttgggtaacgaaaagaaaaacgtttggaacccggttaggttaccgaaccgtaaacccggtaagggaaaacgtaacggtacgtttaccgaaaccgttacttaccggttaaagaaaggttagaaaacgttttaactaaacccgggtaaaaaccgggtttaggtaacgtttttaaggttaccgaaaactaaacggttacgaaacccggacgttaacgttaacccgggaaaaacggtacccgtaacgaacgtaaccgggtaccctttaacgtaacgtttaccgaacccggttacggaactttaccgggttaagtaccgggaaatcgaaccgttaggtacgtaaacgttagggacgtcttagtggtttattaccgagttacgcgggttacgacccgtaggtcgtggttcgg

SEQ ID NO: 113871 - DNA, 966 bp, Homo sapiens
  misc_feature: GYAE6OF01CJY0L.15.86.H09.1.454.CMB.1.raw
tcagtctacgtagccacgaccggtgctcgatttagtgctatagacttggggtttgggggagaggagccccagccttgggactccccaagtgttttcattcagtgatcaggactgaacacagagactcaccagtggagttcggctgagtcgttggttttcctgctgactataacgttaaaaggtgtccgtagtgtagaagtgcgtaggtgggtggaggtcggtggggacgtccgttaggtaaacgtccggttcgggggttacccttagtacggttccttccgttaggttcggtcggtacccttcgttacggtaactttccgtaacctttacgtaaacggtttaagtcgggtaccgtagggtaagttcgggttaacggttccgggtcccgtaccgtacgggtacccgtaccgggaagggggtaacgggtcggttagggtagggttaggggttaacggtaaccgtttaaaagtaaaaaaggtaaagttaggagttaggaacgtaaaagtaaaagtacgtaacgttacggacgaccgtaaaccgggtaaggaaaacggtatacgtaacccacgtacgtacgtaagaaaggtaataaacttaagttaaacccgtaaaaaggtacggtttacgttaagttaacggaaactaaagtaacgaaaacgtaccggtaaaccggtaaaacgggtaaacccgaacggaaaccgtaaccgaaccggttaacccgtttaacgttaacgtttaaccgtaaccgttaaacccgaacggttaacggttaaaccgttaaacgggtaaccggtacgtaaacggtaaaccggtaacggtaaaaaccgggttaaacggggtaacgttaaccggttaacggtttaaggtttaaccggtttttaaccggaaacgttttaaccgggttcccggggttaaaccggggaccccggtaaaacgggggttaccttaacgggggtttaacccggg

SEQ ID NO: 113872 - DNA, 768 bp, Homo sapiens
  misc_feature: GYAE6OF01ADM1R.15.86.H09.1.454.CMB.1.raw
  modified_base (181)..(181): a, c, t, g, unknown or other
  misc_feature (181)..(181): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (696)..(696): a, c, t, g, unknown or other
  misc_feature (696)..(696): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttcctgctgctatacgttaaaggtntccagtgtagaagtgcgaggtggtggagtcggtggggagtccgttaggaacgtccggtcgggggtaccttagacgtctccgtgtgtcgcctntggtnttctacttcagtagtgctggatggtaggttcggccgtaccgacggccgtaccggaggggtaggggtcgtagggtcgggttagggtttacggtacggtttaaacgaaaagttaaaagtggtagttaggtaagtaaacgtaaaagtacggtaaccgttacggtcgaccgtaaccggtaggaaaggacgtactaccgactacgtactaacggaagtagtaacttaaactaaccggaaaacggttgttagtacttagaaacctaagtacgaactaacgaccgtaaacgggaaaccgacgaaccgtcgtacggttacccttaacgttaactttaccggtaacgaaccctaaccgggtaagttaccggtaacggtaaacgtttcggaacctaaggggtaccttaaaccgggtaaagacgggttntaaccggtttcgttaacgtttacgagtttaccggacggggttaccgaacggttacgaaagtcggtttaccgg

SEQ ID NO: 113873 - DNA, 731 bp, Homo sapiens
  misc_feature: GYAE6OF01A1M5W.15.86.H09.1.454.CMB.1.raw
  modified_base (365)..(365): a, c, t, g, unknown or other
  misc_feature (365)..(365): n is a, c, g, or t
  modified_base (676)..(676): a, c, t, g, unknown or other
  misc_feature (676)..(676): n is a, c, g, or t
  modified_base (716)..(716): a, c, t, g, unknown or other
  misc_feature (716)..(716): n is a, c, g, or t
tcagtctacgtagccacgaccggtgctcgatttagtgctatagacttgggtttgggggggagaggagccccagccttgggactccccaagtgttttcattcagtgatcaggactgaacacagaggactcaccatggagttcgggctgagcgtgggttttccttgctgctatacttaaaaggtgtccagtgtagaagtgcgagggtggtggagtcggtgggggacgtccgttagggtaaacgtccggtcggggggtcccttaggacgttccttccgtggtgtcggtcccgtcgtggtattctactttcaagtaagtggtcgtggatggtagttcggggccgcgaggctacgaggggagggcgtggnggtgggtgtacgttaagaaaagtaaatgagtaggtagaaagtaaatggacgtacggacgaccaaccggtaggaaacggagtactaccaacgtactacgtacgaaagtaacgtaattaaagttaaacccgaaaacggttcggttattaagttacgaaacaaaagtgaaaacccgtgttaacccgaaacgggaaacgacggaaccaaccgacgtacccgtttataacttccgtaataaccccgtagtagtaaccgtttcggaacgtctaacgtggtaacccgtaaagggaaaggtacgtcgttagtaccgttnttttaggattaccgggttcgggaccgggacccgtaagggnttaacggttcccggg

SEQ ID NO: 113874 - DNA, 758 bp, Homo sapiens
  misc_feature: GYAE6OF01A9THX.15.86.H09.1.454.CMB.1.raw
  modified_base (142)..(142): a, c, t, g, unknown or other
  misc_feature (142)..(142): n is a, c, g, or t
  modified_base (187)..(187): a, c, t, g, unknown or other
  misc_feature (187)..(187): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttcnccacaggtctctgtgctctcgcctgtgctgactcacgcccccgtntgcattctcgtccttgcgtagggctcctcgatacaacgcctccaccgtcgacctaacccgtaagttacggagacgactacgtacccgaacctaccacctacgtacgtagtacgtactaacaacgaacgaacgaccggaaccggtacccgtacccgtagtaataagtaagtaaggtaaagtaagagtagtacgcgacgacgaccgaacggaacgggaacggggaccggtaccgtacccgtacgtaccgtacgtacgtacggtcggtccgtacgtacggtcgggtcggtaccgtaccggtacccgtaccgtacctaccgtaccctaccgtaccctacccgtacccgtaccgtacgtaccgtacgtacgtacgtacggtacgtacgtacggtacgttacgtacgtacggtacgggacggaacggacgaccgaccgtacgtaacgtacgtacggtacggtaccggtacgggtaacggggttacggggttcgggttaccggggtacgggaccgggaaccggtaccggtaccggttaccggtaccggttacccggttacggtccggaccggtacccg

SEQ ID NO: 113875 - DNA, 835 bp, Homo sapiens
  misc_feature: GYAE6OF01BE72G.15.86.H09.1.454.CMB.1.raw
  modified_base (200)..(200): a, c, t, g, unknown or other
  misc_feature (200)..(200): n is a, c, g, or t
tcagtctacgtagccacgaccggtgctcgatttagtgctatagacttgggtttgggggggagaggagccccagccttgggatccccaagttgttttcattcagtgatcaggactgaacacagaggactcaccatggagttcgggctgagtcgttgggttttccttgctgctatacttaaaaggtgtcagtgtagaagtgngagggtggtggaggtcggtgggggagtccgtttagggtaaacggtccggtcggggggttacccttaggtacgttccgttccgttggtcggttcggtcccgttcgtcgggttactttccttaccttttacgtaaggttaagtcgggtcgtaggtagtgggtacggttcggggtcccggccgacgggtccgtaccgggaaggggggacggggtcggtaggggtagggttggggtttacgggtaaacggtttaaacgtaaaaaggttaaaagtgtaaggttagggtaagaaagtaaaagtacgtacgtacggtacgacgtaacccggtaaggaaaggaacgtacttaaccacctaactacgtaacgaaagtaacgtaacttaaacgtaaacggtaaaaaccggtcggttaagtttaattagaaacgtaaagtaacgaacgaacgtaacccgtaaacggaaaaccgaacggaaccaacgtcgtaccgttaacttaacttacgtaaccgtaacgaacgtaacgggaattacgggaacgtcgtacgtaacgtaacggtaaacggaaacggtagtgttagttcggttgtttagaacgtttcggtaccggtaccggggaacgtacgggtaacgtaaggttcgg

SEQ ID NO: 113876 - DNA, 805 bp, Homo sapiens
  misc_feature: GYAE6OF01AR56R.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttccttgctgctatacttaaaaggtgtccagtgtgagtgcaggtggtggagtcgtggggagtccgttaggtaaacgccggtcgggggttacccttagacgttcctccgtgtggtcggtcctcgtggtacttctacgttttcaagttaactggtctggagtggtaggttcggggtcccgaccgaggtccgtaccggtaagggggaacggggtcgtaggggtaggttggggttacggtacgtttaaacgaaaaaagttaaaacgtggtaagtagggtaagaaagtaaaagtacggtaacgttacggtacgaaccgtaacccgtaaggaaaaacggtaacgtaacttaccaaccgtaattcctaacgtaaagaactaaagttaaacttaaccggaaaaaacggttcggttagtttaaaccgtttgaaaaccttaaaagtcgaaaacccgtaggtaacccgtaaaacggaaaaccggtacgtaaaccacgtaccgtacccttaattaacttaaccgtactaacccgagtaacgtacgttaacggactaggacctaagggtaccgaaagggttaaacgcggtccgtttaagttggtacttttacggaatttaccggtcgggacccggggttaaacccagggtttaaactcggttcgg

SEQ ID NO: 113877 - DNA, 828 bp, Homo sapiens
  misc_feature: GYAE6OF01D9AU0.15.86.H09.1.454.CMB.1.raw
  modified_base (205)..(205): a, c, t, g, unknown or other
  misc_feature (205)..(205): n is a, c, g, or t
  modified_base (403)..(403): a, c, t, g, unknown or other
  misc_feature (403)..(403): n is a, c, g, or t
  modified_base (819)..(819): a, c, t, g, unknown or other
  misc_feature (819)..(819): n is a, c, g, or t
tcagtctacgtagccacgaccggtgctcgatttagtgctatagacttggggtttgggggggagaggacgccccagccttgggactccccaagttgtttcattcagtgatcaggactagaacacgaagagactccaccagtggtagttcgggactgagtcgttcggtttcctgctgactagtacgtaagtctacgagtgtagtagngcgtaggtggtaggagtgggtacgggcgtacgttagggtaaccggtccgggttcggggtaccttaggtacgttcgtccgttggtcgtcggtaccttgttacgtacttacttacgttacggagttacgcgtaggttggacgtagggttacggttccggggtccgtacggaccggttcgaacggggacgggggttacggnggtcggttaggggttacggttaacggtaaaggttaaaacgttaaaaagaagttacggtaggtaacgtaacgtaaagtaaacggtacgtaacggtacgtacggaacctaacggggtaaacgaaaggtaacgtactaacgtaccttacggaaccttaaggaaagtaacgtaacgttaaacgtaacccggggaattaacggtttgttaaccgctaaaataacgtaacgaaccacgggtaacaaaccggaaacggtactacgccgggttaaccttaccgattaaacgttcccgaaatcccgaaagtttaccggagtaacgggatacccgaacgttaacgggtaccgaaacgtaagtcgtactttggaacgttttcgaagtacccttcgggtaacccgggcgaaagtttgtaaacccgggntttcccggg

SEQ ID NO: 113878 - DNA, 835 bp, Homo sapiens
  misc_feature: GYAE6OF01EUVQ1.15.86.H09.1.454.CMB.1.raw
  modified_base (827)..(827): a, c, t, g, unknown or other
  misc_feature (827)..(827): n is a, c, g, or t
tcagtctacgtagccacgaccggtgctcgatttagtgctatagacttgggtttgggggggagaggagccccagccttgggatccccaagttgttttcattcagtgatcaggactgaacacagaggacctcaccagtggagttcgggctgagtcgttgggttttccttgctgtctattacgttaaaaggtgtcctagtggtagtaacgtgcgtaggtggtaggagttccggtagggggtactccggttaggtaaacggtccggttcgggggttcccttaggtacgttctccgttggtagtcggtaccttcgtaggtacttcctaactttcgaagttaagtcggtctaggtacgttggtacggtttcggggtccccgaccgtacggtaccgtaaccgggacgggggtaaggggccgggttagggttacgggttaggggttttacgggttaaccgtttaaaacggtaaaaaacggtaaaagtttaggtaaggtttacgggtaagtaaaacggtaaaagtaaccgttaaccgtacggtactaaccgaacgggttaacggaaaaggtacgtaacttaccactaactaccgtacgaagtaagtaacttaacgtaaacgaaacgttacgttattaattacgaataaagtcacgtaacgactaacgtaacgaaccggaacaccgataccgtaccttaacgttacctataccggtaaccagttaacggtacgttagggtaactcgtaactaacgtaccgggttaaaggaacgttcggttattacgtttggttacgtttaagaccgttcggttacggaacccggtccgtaaagggtntaccgggg

SEQ ID NO: 113879 - DNA, 780 bp, Homo sapiens
  misc_feature: GYAE6OF01CSJVE.15.86.H09.1.454.CMB.1.raw
  modified_base (685)..(685): a, c, t, g, unknown or other
  misc_feature (685)..(685): n is a, c, g, or t
tcagtctacgtagccacgaccggtgctcgatttagtgctatagacttgggtttgggggggagaggagccccagccttgggatccccaagtgttttcattcagtgatcgaggactgaacacagaggactcaccatggagttcgggctgagcgttgggtttccttgctgctatacgttaaaaggtcgtcgagtgtaggaagtggacgtagggtgggtggtaggtcggtgggggagtccgttagggtaaacggtccggtcgggggtacccttaggacgttcctcgtgtaggtcggcctcgtggtacttcgtacttcgtaagtagtggtgtggagtggtacggttcgggtcccgcgtacggtccgtacgggaggggtaaggggcgtgggtaggtttgggtacggttaaccgttaaaggtaaaagtaaataggtaggtaggtaagtaacgtaaaagtacggtaacgtacggtacgacgtaaccgggtaagaaacgggtaacacgttacgaacccgtatacctaaggtaaacgacggttaattaaacgtaaaccgtaaaaacgttcgggttaacgttaacgttagaacccgtaaagttacgaaacgtagtaacccgtaaaccggaaacggtaacgaaccgtacgaccgttacggacttacttaacgtcctaacacggtagtactacggtanacggtactacggtacggaaacgtaggtacgtcgttagccgttatttacggactttaggacccggtacggaccgtaacggaccgtaagggttccgg

SEQ ID NO: 113880 - DNA, 763 bp, Homo sapiens
  misc_feature: GYAE6OF01BOGCH.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagtccgttggtaaagccgtgggggtcccttagagtctcctgtgtcggcctctggtattctactttcagtaatggtctggatggtagttcggggtccgccgaggccgtaccggaggggtaagggggcgtggggtaggtggggttagggtaacggtttacgaaaaaggttaaaagtggtaagtaggtagaaagaaaatagacgtacggtagaccgaaccggtagaaaggagacttacacctatctacgaaagtagtaattaacgttaaccgaaaaacggtcggggtttattaagtttacgaaactaaaacgtaggaaaacctaccggtaccgtaaaacggaaaaacccggtaggaaacccaacccggtaacggtaccccttaactttaacgtttaaccctaacggttaaccccaacggtaaggtttaacgtttacgggaagttccgacctaaggtaccggtaaacgggtaaaggacgtacgtattcggttacttttacgagttacggttccgggtaaccggggacctacggggaacctaggttcccggg

SEQ ID NO: 113881 - DNA, 962 bp, Homo sapiens
  misc_feature: GYAE6OF01CROFK.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcggtctgagtcttcgggttttcctgtcctgctatacgttaaaggtgtacctagtgtagaagtgcgtaggtggtggaggtcggtcggggatccgttagggtaacgtccggtcggggtaccttagtcgtctcgtggtcggtacgtcctgtgtacttctacttgtaagtagtggtcgtaggtagttacggtcggttccggtcccggaccgtacggtccgtacgggaacgggggtaacggggtcgttaggggtagggttacggttaacggtaacggtttaaacgtaaaaaaggttaagtaggttaagtagggtaacaaaggttaaaacgttacggtaaccggttaacggtacgacccggtaaacggtaaggtaaaaccggtaagtcccgtttaaccgaaccgttaactaccggttaaaccgaagtttaaacggtaactttaaacggtaaaacccgtaaacgggttacggtttaacggtttaaacgttaacccgttaaaacgttaaagtaaccgggttaaacccgttaaccggtaaaccggttaaaacccggtaaacgggaaacccggtaacggttaaaccccggtaaccggttttaaccgtaaaccggttttaaccggttaacccttaaccgggtaacccttaaacgggtaaccggtttagggtaaacccgtacggttaccggttaaactaacccgggttaaacgggtacccggtaaaaagggttccgtaaccggttttaggttaaccccgtttggtttacccgtaaggttacccggtaccggggtaaccgggtaccggtaaacggttcggttaaacgggttcccggg

SEQ ID NO: 113882 - DNA, 955 bp, Homo sapiens
  misc_feature: GYAE6OF01ECEPN.15.86.H09.1.454.CMB.1.raw
tcagtctacgtagccacgaccggtgctcgattttagtgctatagacttgggtttgggggggagaggagccccagccttgggatccccaagtgttttcattcagtgatcaggactgaacacagaggactcaccatggagttcgggctgagcgttgggtttttccttgctgcttaatacgttaaaaggtgtccagtgtagaagtgcgaggtggtggagtcgtgggggagtccgttaggtaaacgccggttcggggggttcccttaaggacgttccgttccgttggttggtcggtcccttcgtcggtaatttcctacttttacgaacgttaagtggtcgttaggacttgggtaggtttcgggcccgtaccgtacgggcctaccggaaggggaacgggggtcgttaggggtacgggtttgggggtttacggttaaccggtttaaacgtaaaaaaggttaaaaagttggtaagttaaggggttaaggaaaaggtaaaaagttacggtaaccggttaacgggtacgaacccggtaaacccggttaaaggaaaaacgggtaacgtaaccgtttacccgaaaccgtactaccgtaaacgaaaagttaaccgttaaagttaaaaccgtttaaccgaaaaaacgggttcggtttaaaggtttacttttaacggaaataaaacgtaacgtaaaccggtaacgtaacccgttaaacggaaaaaccggaaccggaacccaaccggtaccgtttaaccccgttacgtttaaacgttacccgttaacggtaaccctaagttaacggttaaaccgttacgggtaacggttacgaaccgttaacgtaccgggttaaaacggtaaaggggtacggttaaccgtttaagggttccgtttaaccgttttaagaaccgtttacggttacccgggtacggggtacccggtaaagggtaacccgtaggtttaccgggg

SEQ ID NO: 113883 - DNA, 854 bp, Homo sapiens
  misc_feature: GYAE6OF01D363E.15.86.H09.1.454.CMB.1.raw
  modified_base (537)..(537): a, c, t, g, unknown or other
  misc_feature (537)..(537): n is a, c, g, or t
  modified_base (650)..(650): a, c, t, g, unknown or other
  misc_feature (650)..(650): n is a, c, g, or t
tcagtctacgtagccacgaccggtgctcgatttagtgctatagacttgggtttgggggggagaggagccccagccttcgggatcccaagtgtttcattcagtgatcaggactgaacacagaggactcaccatggagttcgggctgagctgggttttccttgctgctatacttaaaggtgtccagtgtagaagtgcaggtggtggagtcgtggggagccgtttaggaaacgtccgtaggggggtcccttagacgtctcctggtgtcggcctcgtggtattctacttacagtagtcggtcgtggatggtaggttcggtccgccgaggacctaccggaagggggtaggggcggtacgggagggttggggttacgggtaaccggtttaacgaaaaaggttaaaaagttgggtaaggttagggtaacgtaaaacgggtaaaaatacgggtaacgttacgggtacggtaccgtaacccgggttaaggaaaacgggtaacggttaactttacccgaaccctaacgtacgtaacgaaaggttaanaaaactttaacgttaaacccggaaaaacgttcggggtaaattaggtttaacgaacgtaaatacggtaaaccgacggtaacccgtaacgggaaaaccgtaacggacctaaccgnttacccccggttattaaccttaacgaccttaaaaccgcgtaaggttaccttacggggtaagtaccgaacgttaggtaaaccgggtaacggtaaagggacgttaccgttacggtttacggtaagtttttccgaaggttaacgttcccgggggtaaaccgggggtaacccctaaagggggttacccctaagggggttttaccccgg

SEQ ID NO: 113884 - DNA, 897 bp, Homo sapiens
  misc_feature: GYAE6OF01DI37X.15.86.H09.1.454.CMB.1.raw
  modified_base (224)..(224): a, c, t, g, unknown or other
  misc_feature (224)..(224): n is a, c, g, or t
tcagtctacgtagccacgaccggtgctcgatttagtgctatagacttgggtttgggggggagaggagccccagccttgggatccccaagtgttttcattcagtgatcaggactgaacacagagacctcaccatggagttcgggctgagtcgttcgggttttccttgctgtacttataacgtttaaaaggtcgtcgtagtgtgaacggtgcgtagggtgggtggnggtggtaggggcgtccgttagggtaacggtccgggtcgggggttaccttaggtacgtccttcgtggtcgtcggtcctcgtgtacttcgtacttcaaggtagtggccgtggtacgtggtacgggttcggtaccggccggtacggtccgtaaccggagggggtacggggtcgtaggggtgggttacgggggttacggtttaaccggttaaaggtaaaaagttaaaacggttaggtaaggttaagggtaaaggtaaaaaggaaaacgttaggtaaaccgtttaccgggtaacgaacccgtaacccgggtaaaaggaaaacggtaacgttaccgtacctaacccgtacttaacgtagaaacgtaaacgttaaactaaacgttaaacggtaaaaccgtggtttaagttacgttaacttaacgtaacgtaagtaaacgtacgtaaccgggtaacgaaaacgtaccggtaaccgtacgaaacccggtccctttaacggtaactttaccgtaacgttaccgaaccgtagttaaccgttaaggaacgtcggtaacgaaccggttaacggtaaaaccgggtaggttaacgtaaccggttttagtacgtttccgttttaagaccggttacgggttacccgggtaacggggtaccccgggttaagaccggttcgggttacccggg

SEQ ID NO: 113885 - DNA, 848 bp, Homo sapiens
  misc_feature: GYAE6OF01DGKRM.15.86.H09.1.454.CMB.1.raw
  modified_base (607)..(607): a, c, t, g, unknown or other
  misc_feature (607)..(607): n is a, c, g, or t
  modified_base (659)..(659): a, c, t, g, unknown or other
  misc_feature (659)..(659): n is a, c, g, or t
  modified_base (710)..(710): a, c, t, g, unknown or other
  misc_feature (710)..(710): n is a, c, g, or t
tcagtctacgtagccacgaccggtgctcgatttagtgctatagacttgggtttggggggagaggagccccagccttgggatccccaagtgttttcattcagtgatcaggactgaacacaggagactcacatggagttcggctgagtcgttgggtttttccttgctcgtcttaagttaacgtttaaaaagggtcgtaccgtaggttggttaggaaggttgacgtaagggttgggtagggaggtcgggtaggggggacgttaccggtttaacgggtaaacggtcccggggttacggggggttaccccttaaggtaccggtttcctccgttggttcggtccggtaccttcgtacggttactttccgttaaccgttttagtaaggttaaacgtcgggtacgttaagggtaacgttgggttaacggggtttccgggaccggtaaccccgtacgggtaccggtaccggggaagggggtaacggggtcgtaggggtagggtttacggggtagtaaacgtttaacgaaaaaaggttaaagtgtaagtaggaagtaaaagaaaagtcggaaacgtcgaaccgaacgtaaccgaaggaaagaactacgtaccaactntacgaagtaagaataactaaagtaacgaaacgtgttaagtattagactaaanaacgaacagaaccgaagaaaccgagacacgtactctagttacaaccgttanactaagtacggtaacttgggaactcgaacttaacggtaacgtaacgggtaaacgggcgtaacctttaaggttcgtttaaacctttaggaacgttacgggtcggtaaccccgggaggttaaacgtacgttacggtcggg

SEQ ID NO: 113886 - DNA, 929 bp, Homo sapiens
  misc_feature: GYAE6OF01D2KHV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagtcgttgggttttcctgctgtacttaattacgtttaaaaggtcgtaccgtagttgtagaagtgacgtagggtggtacggaggttcggtgggggtacgtaccggttaagggtaaaccggtcccgggttcgggggttacccttagtacgttccgttccgtaggtcgtcggtccctgtaggtacttaccgtactttagaagttaagttggtccgtagggtagttagggttacgggtttccgggacccgtaccgtcggggtccgtaacccggggtaagggggaaacggggttcggtagggggttacggtttacgggggttacgggttaaaaccgttttaaaacggtaaaaaaggttaaaagtaggtaaggttaggtaaaggtaaaagtaaaacgtaacggtacggttacggtaccgaacccggtaaccggtaaggtaaaacgtactaacgttaccaaccgttctaacgtaacgaaacgtaagttaacttaaataaaccggaaagttacgttaagttactaacggaaataaagtacgaactaaccggttaacaaacggaaaccgtagaccgacgtaccgttaaccgttactttaacgtacgttaaccctaacgtacgtaacggttaaccggtaacggtaacggtccgtaaaaccgtacggtaaccgggtaaacggtaaacggttcggttaacccgttaggttacgttttacggtttaacgttcggtttaaaccggtcccggggttaaaccggggacccgtaaacggggttaacttacgggttacccgg

SEQ ID NO: 113887 - DNA, 795 bp, Homo sapiens
  misc_feature: GYAE6OF01AKHH5.15.86.H09.1.454.CMB.1.raw
  modified_base (597)..(597): a, c, t, g, unknown or other
  misc_feature (597)..(597): n is a, c, g, or t
  modified_base (671)..(671): a, c, t, g, unknown or other
  misc_feature (671)..(671): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaggtgtccagtgtgtaagtgctaggtggtggacgtcgtggggagtcgttaggtaaagtcccggtcgggggtacccgttagacgtctcgtgtgtggccttcgtgtacttcgtactttgacgtagtgacgtgagtgtaggtcggccgtccgaggcctacggaagggggaacgggcgtgggtaggtcgggttaggtacggtttaacaaaaggtaagtagtagtggtaggtaaacgaaagttacgacgttaacgggcgtacgtaacccgggaaggtaaaacggtaacggtattccgaaaccttagtaccctaacgtaaaggtacgttaaagttaaaagttaacccgtaaaaaggtcggttaacgtttaattacgggtaaacctagtaagaaccgacggtaacctaacgggaaaccaccggtaaanaccgggtaaactccccgttaagtaacgtttacaaccgttaacccgaagttaacgtacggttaacggtaacgtcnctaaacgggtacgtaaacgggtaaagggtaccggttaattcgtttaacgggtactttttaccgggaaagttttccgaaacggggtttcccgggaaacccgagggtaccgttacccggttaaggg

SEQ ID NO: 113888 - DNA, 1085 bp, Homo sapiens
  misc_feature: GYAE6OF01C18YZ.15.86.H09.1.454.CMB.1.raw
  modified_base (828)..(828): a, c, t, g, unknown or other
  misc_feature (828)..(828): n is a, c, g, or t
tcagtctacgtagccacgaccggtgctcgatttagtgctatagacttgggtttggggggagaggagccccagccttgggatccccaagtgttttcattcagtgatcagactgaacacagagactcaccatggagttcggctgagctggttttccttgctgctatacttaaaggtgtccagtgtagaagtgcgaggtggtggtaggtcgtggggacgtcccgttaggtaaacgtcccggtcggggggtacccttagtacgttccgttcccgttggttcgttcggtcccttacgttaggtactttccttaccttttacgtaaagttaacgtggtaccgttgggtaacgttggttacgggtttcggggtccccggacccgtacgggtacccgttaccccggggaagggggtacgggggttaccgttaggggtacgggtttcggggggtttacgggttaaaaccggtttttaaaaccgtaaaaaaaagggtttaaaaacgttggttaaacggttacgggggttaaaacggaaaagggttaaaaaacgtaacgggttaacccggtttaaccgggttaaccggtaaacccgtaaacccccgggttaaaggggtaaaaacgggttaaaagttacccggtttaaaccctaaccccggttacttaaacccgttaaaccggtaaaaaggttaaaacgttaaaccgtttaaacgttaaaaaaccccggttaaaaacggggttccggttttaaacggtttagttaaccggtaaaaccgtaaaaggttaaccggaaaaccccgagggtaaccccgttaaaaacggaaaaccccggggtaanaacccgtaaaccggttacccgtacccggtttaaactttacgtttaaaccggaaccttaaacccctaaaggtacgtttaacgggttacccggaaaggtttcccgaacttaaacgggtaaacccgggtaaaggggtaaaagtcccggggtttaacttagggttttaaccgtttcggttttaaacgaacttttcccgggtaccccggggtaacgttaccccggggtaaaacggtacccgttaaaggggggtttttccccg

SEQ ID NO: 113889 - DNA, 977 bp, Homo sapiens
  misc_feature: GYAE6OF01DIV66.15.86.H09.1.454.CMB.1.raw
tcagtctacgtagccacgaccggtgctcgatttagtgctatagacttgggtttgggggggagaggagcccccagccttgggatccccaagttgttttcattcagtgatcaggactgaacacagagactcaccagtggagttcgggctggagtcgttcgggtttttcctggtctgcttaattacgttaaaaggtcgtaccgaggtgtagaagtgcgtagggtgggtggacggtcggtgggggacgtaccggttaggtaaacggtccgggttacgggggttacccttaggtacgtcctccgtggtgtcggtcctgtgtacttctactttagacgttaagtggtacgtggtagtggtacgggttccgggtcccgacgcggtccgtaccggggaagggggtacgggtcgtaggggtacggttagggttacggtaacgttaaacgtaaaaaaggtaaatggtaagttaggtaacggaaaagtaaaagtacggtaaccggtaccggtaacgaacccgggtaaaccggaaaggtaaaacgggtaacttaacgtacccgtaaccgtacgttacccgtaaagtaaaacggtagttaaacttaaaccggtaaacgtaaaaacgggttccggtttagttaaaggttttaacgaaacccgtaaagtaaaccgggtaaaccctaacgggtaaacccgtaaaaccgggaaaaacccgggtacgtaaacccggtaaccgtaaacccggttaactttaacccgggtttaaaccctttaaccgggtaacccgttaaacctaacgggttaaaacgttaccggggttaaaccgtaaggggttaccgaaacgtttaacgggaaacccggtaaaggggttaaaacgggtacggttaaccgtttagttaccgggttttaaccggttaaagtacgggtttaaaccgcccggggggttaacggaacccccgggtaagggtaaccgtttggtaaccccgggg

SEQ ID NO: 113890 - DNA, 592 bp, Homo sapiens
  misc_feature: GYAE6OF01DJST2.15.86.H09.1.454.CMB.1.raw
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (460)..(460): a, c, t, g, unknown or other
  misc_feature (460)..(460): n is a, c, g, or t
  modified_base (535)..(535): a, c, t, g, unknown or other
  misc_feature (535)..(535): n is a, c, g, or t
  modified_base (582)..(582): a, c, t, g, unknown or other
  misc_feature (582)..(582): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcaggtggtggagtctggggggagccgttggtaaagcctggggggtcccttagagtctctgtgtggcctctggattcactttcagtaatggctggatgagttggtccaccaggctcgaggaagggctggagtgggtgacgttanaaaaagtaaaatgatggtanaagaaaatagactacggtgactacccgtagaaacggaaagatacaccatctacaaagagaataattaacgaaaaacgtcggtagtatttagacaaatgaaacancacgaaaacgagaacacacgcgtatataacctgtacccaagtagatacgaagtcgactaagtccgaagtaaaggngactaatcggtcttttaggacttagtcgtacgggggacccaaggggntaacgtcggg

SEQ ID NO: 113891 - DNA, 948 bp, Homo sapiens
  misc_feature: GYAE6OF01B4TAF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcgtgggttttccttgctgctatacgttaaaggtgtccagtgtagaagtgcgaggtggtggagtcgtgggggagtccgttagggtaaacgtccggtcggggggttcccttaggacgtcgtccgttggtggtcggccgttcgtggtacttcgtactttacgaagtaagtggtcgtaggtagtaggtagggttcgggtacccgccgacggaccgtaccgggaggggtaacgggggcggttggggtagggttgggggtttacgggtaaccgggttttaaacgtaaaaaaggttaaaaagttaggtaaggttaggtaaggaaaagtaaaaagtaacggtaaccgttacgggtacgacccggtaaacccggtaagggaaaacggtaacgtaacgtttaacccgaaccctaagtaccgtaacgaaacgtaaacgtaaacttaaacgtttaaaccggaaaaaccgggttcggttaagttaacgttttacgaaaccgttaaaaatcggtaaaaccgtacgggtaaccccgtaaaacggaaaacccgggtaaacggaaccctaaccgggtaaccggtacccgtttaacgtttaactttaaccccggttaacgtaaacccccgtaagttaaaccggttaccggtttaagggaaccgttaccggaaggtaacccgttaacggggtaaaaccgggtaaaacgggtcggtttaacctaagggttttcgtttaacccgttttagtaaaccggtttaccggtccgggggttaaacccgggacccgggtaaacgggtaacgttacggggttacccggg

SEQ ID NO: 113892 - DNA, 764 bp, Homo sapiens
  misc_feature: GYAE6OF01DJ638.15.86.H09.1.454.CMB.1.raw
  modified_base (561)..(561): a, c, t, g, unknown or other
  misc_feature (561)..(561): n is a, c, g, or t
tcagtctacgtagccacgaccggtgctcgatttagtgctatagacttgggtttgggggggagaggagccccagccttgggatccccaagttgttttcattcagtgatcagactagaacacagaggtactacaccagtggtagttcgggctgagtcgttgggtttcctgctagtctagtacgttaaagtcgtacgtagtgtagtagtgagtaggtggtggtaggtcggtagggagtcggttaggtaacgtcgggtcgggttacctagtcgtctcgtggtgtcgtacgtcgtgtactctacgttagaagtagtcgtgtaggagtgtacgggtcgaccgcgcgtacggtaggaacggggtaggtcggtggtacggttaggtacgtaacgttaaagtaaaagtaagtggtaagtacggtaaagtaaaggtaaactaggtacggtacgtacggaacccgaaggtaacgaaaacggtctaacctacgaccttaagtaccgaagtaacgtaagtaaactaaagtaacgaaacgttagttacgtaagtaagtaactaaagacggtaaanaccgaaacgggtaaccgaaacggccaaacgaccgttaacggaactttagtaaccttacggtaacacggtaccgtaaggttaacgaacggtttaacccgtaaacgggtacgaacgggtaaacgtaagtagggtttacctaaggtttactttccgggaattaacccgaggttaccggtaggacccgggtaatcgggtaacgtcgg

SEQ ID NO: 113893 - DNA, 802 bp, Homo sapiens
  misc_feature: GYAE6OF01BKV13.15.86.H09.1.454.CMB.1.raw
  modified_base (269)..(269): a, c, t, g, unknown or other
  misc_feature (269)..(269): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttcctgctgctatacgttaaaaggtgtccagtgtagaagtgcgaggtggtggagtggtggggagtccgttaggtaacgccggtcgggggttcctaggtcgtcctccgttagngtcggcctcgtgtacttaccgtactttacgagtaagtggtacgtaggatggtaggttcgggtacccgcgtacggtccgtaccgggaagggggtacggggtcgtagggtagggttacggggttacggttaactttaaacggaaaaagtaaaacgtggtagtagggtagtaaaagaaagttacgaacgttacggtacgaccgtaaccggtaaggaaacggtataacgttaccgaaccttagtaacctagtaaacgaagtaacttaaacgttaaaccgaaaaggttcggttaagtttaacgttaacgtaactaaagtaaccgtaaaccgtaacggtaacccgtaaaacggaaaccggaccggaaacctaacggtaccgttacggttaacttaacgttaccgtagtaaaccgacgtaagttacgtaacggtatacgtacgtaacgacggtaaacggtaacggtacgtacgttagttacggttcttacggtagttaccgttgggtacccggaaacggtcggtaaacgtgggttaccgg

SEQ ID NO: 113894 - DNA, 808 bp, Homo sapiens
  misc_feature: GYAE6OF01AT8MB.15.86.H09.1.454.CMB.1.raw
  modified_base (147)..(147): a, c, t, g, unknown or other
  misc_feature (147)..(147): n is a, c, g, or t
tcagtctacgtagccacgaccggtgctcgatttagtgctatagacttgggtttgggggggagaggagccccagccttgggactccccaagttgttttcattcagtgatcagactgaacacagtgactcaccatggacgttcggctgngtcgttgggttttcctgctgctatacttaaaggtctcagtgtagaagtgcgtaggtggtacggtggttcggtcggggatccgttagggtaaacggtcccggttcggggggttacccttagcgttctccgttggtcgtcggccttgtaggttacttccgtactttacgagttaacggtggtacgtggagtaggtacggttcgggtcccgacgacgggtcctaccgggaggggacggtcgttgggacggttgggttaggtacgttaaacgaaaagtaagtgacgtaggtagaaagtaagtcgaacgtacggacgaccgacggaagtaagacgtactaccgactaagcctaacgaaagtacgtaacttaaaccgtaaagaaaccggttgtttaattaacgttacgaaacgtaaacgtacgaaaaccgagtaaacccgtaaaccggaaacgaccgtacaaccggaaccgtttacgttacttaaccgtttaccgaacgtaacccgtaagtaaccggttaacggtacgggaacgttcgaacccgttaaggtaaacccggggtaagtaacgtacggttagtttacgtacggtttttaacgttacgtaacggttccggtaaccccggtacggggtaaacccctgggtaaaacccgttgggttaacccgg

SEQ ID NO: 113895 - DNA, 798 bp, Homo sapiens
  misc_feature: GYAE6OF01EPOEN.15.86.H09.1.454.CMB.1.raw
  modified_base (652)..(652): a, c, t, g, unknown or other
  misc_feature (652)..(652): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaggtgtccagtgtgaagtgcgaggtggtggaggtcgtgggggagtccgttagggtaaacggtccggttcggggggttaccccttaggacgttccgtccgttggttcggtcgggtcccttcgttgggttactttcctacttttacgaagttaagtggtacgttggattggtaggttcggggtcccgccgacggtcctccggaagggggtaacggggtcgtggggtaggttgggggttacggtaaccggtttaaacgtaaaaaggtaaaaacgttgggtaaagttagggtaaggtaaagtaaaaagttacggtaacggtacggtacggaccgtaacccgggtaaggaaaacggtaacgtaacttaccacctaacgtacctaacgtaaagaactaagttaaacttaacgaaaaaccggtgggtttaattaacgtttagaaactaaagtacgaaactaccgtaacctaaggaaaacccgngaaccacgacgtaccgttactaacgttccaacggtacccacgtaagtacgttacggagttcgactacgtacggtaaggtaacggtgtactaagttcttcgtttacgtattccgtacggggtacggaccctaagggctaggtccggg

SEQ ID NO: 113896 - DNA, 735 bp, Homo sapiens
  misc_feature: GYAE6OF01DFN3O.15.86.H09.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (415)..(415): a, c, t, g, unknown or other
  misc_feature (415)..(415): n is a, c, g, or t
tcagtctacgtagccacgaccggtgctcgatttagtgctatagacttgggttttggggtccactgggcagtctcgaatagagctcttggaagtccctccaaccatggcctgggtctccttctacctactgcccttcattttctcacaggtctctgtgctctgcctgtgctgactcacgccccccgtctgcatctgccttgcgtgggncctcgatcaanctcacctgccacctaagtagtgagcactcgaacctacacccatcgaatggtatacaacagaacgacgaacgggacctacccccagtaacgtaataagttaagtaaaaggttaagagtagatggcagaccacgaaccggaaggggaccggacgtcccgagtcgtaccttacgcggtcggcctaccgtacggttccggngggtccgtacggacccgtccgtaccctaccgaccctaccgttcctaacccctacccgttccgtacgttcgttaccggaacgacggttacggagggtaccgtacgtaacgttaacgtaccttacgggtttacggagggtaacggaagacccgaccgtaactaacgtagttacggaacggttcgggaaacccgtaacggggttcggggttttacggggttacggggtttaccggggacggggaaacccgggtaaccggtaaccgggtaccgggttaccgggttaccccggtaaccggttacgggtacccggaaaccccgggg

SEQ ID NO: 113897 - DNA, 1076 bp, Homo sapiens
  misc_feature: GYAE6OF01DZK2L.15.86.H09.1.454.CMB.1.raw
tcagtctacgtagccacgaccggtgctcgatttagtgctatagacgttgggtttgggggggagaggagccccagccttgggatccccaagtgttttcattcagtgatcaggactgaacacagaggactcaccatggagttcgggctgacgtcgttgggtttttcctggtctgcttattacgttaaaaggtcgtaccagtgtaggaagtcggacgtagggttgggtcggtaggttcgggtgggggaactccggtttaagggtaaaccggtccgggttcggggggttacccttaggacgttccttcgttggtcgtcgcccgttgtagtacttaccgtacgtttacgtaagttaacgtcggtacgttaggtagttacgggttcgggttccggtacccgtaccggtacgggtacccgttaccgggggaaagggggtaaccgggggttcggttagggggttacggggtttacgggggtttaacggttaaaccggtttttaaaaagaaaaaaaggttaaaaaggttggtaaggtttaagggtaaacgtaaaaaggtaaaacgttacggtaaccggtaaccggtaccggtaaacccgtaacccgggtaaagggtaaaacggtacgtaacccgtttaaccaaccggttactaaaccggttaaacggaaacgtaaacggttaaaactttaaaaccgtaaaacccggttaaaaacgggtttccggtttaaggtttaaaccgtttacgggaaaattaaaccggaaaccggtaacggtaaacccggtaacccggttaaaaccgggaaaaaccgggtaccgtaaaccggttaacccgtaaggtttaaccccggtttactttaaacggttaaccccgttaacgttaaaccccgaaaggtttaccgtttaaacggtacgggtaacccgggttataaaccggttaacgggttaacgggaaaacgggttaaacggtcggttaaccgtttttaacggtttaacgttttaggttaccgtaaaacggttcccggggttaaccgggtaaccccgggggaaacgtttaaaccggtccggtttaacggggttacccggg

SEQ ID NO: 113898 - DNA, 854 bp, Homo sapiens
  misc_feature: GYAE6OF01ENDZP.15.86.H09.1.454.CMB.1.raw
  modified_base (679)..(679): a, c, t, g, unknown or other
  misc_feature (679)..(679): n is a, c, g, or t
tcagtctacgtagccacgaccggtgctcgatttagtgctatagacttggggtttgggggggagaggagccccagccttgggactccccaagttgttttcattcagtgatcaggactgaacacagacggacctcaccatggagttcgggctggagtcgttcgggttttccttgctcgtcttattacgttaaaggtcgtccgagttgtagaagtgtcgtagggttgggtagggtacggttcggtgggggacgtccgttagggttaaacggtccgggttacgggggttacccgttaggtacgttccttcccgttggttcggtcggtccgttcgtggttacttcctactttactaagttaagtggtacgtaggtagtggtacggttcgggtcccgtaccgacggtccgtaccggacgggggtaacggggtcggttaggggtacgggttacggggtttacggttaaccggttttaaacgtaaaaggttaaaacgttaggtaggttagggtaacgtaaaggtaaaagtaacggtaccgttacggtacgaccgtaaccggtaaggaaacggtaagtaactacctacctacgtactaacgaagtaagtaacgtaacttaaaccggaaacggttacgttagttacgttagaaccgaagtaacgaacgtaacgaccgtaacggaaacgngaaccgacaggtaccctttataacgtttaccgccgttaaccacgtaagttacggttacgtaggtacgtaccgtacggttaacggtaacgggtaaagtcggtacctttagtacgtttcgtttagtacttaccggtacggggtacccgggacccgtagggtaccctgggttccccgg

SEQ ID NO: 113899 - DNA, 879 bp, Homo sapiens
  misc_feature: GYAE6OF01B1EHU.15.86.H09.1.454.CMB.1.raw
  modified_base (253)..(253): a, c, t, g, unknown or other
  misc_feature (253)..(253): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttagggtaaacgccgtggggggttcccttaagngttcctccgtggtgtcgggcccttcgtggactttcctaccttttacgaagttaagtgggcgttggacgttggtagggtttcggggtccccggccgaacgggtccgttacccggaaggggggtaacggggggtccgttagggggtaggggtttacgggggttacggggttaaccgttttaaacggaaaaaggttaaaaaagttggtaagttaggggtaacgaaagtaaaaagtacgggtaacggttacgggtacggaccgtaacccggtaagggaaaaaggtacgtaacgttacctaacccgtaacttaccgtaacgaaggtaagtaatttaaacgtaacgaaaaaccggtagggttaacgttagtttacaaactaaagtaccggtaaactaccggtacccgtaaacggaaaaccggacggtaaccacgaaccggtcccgttaacgttaacgttaccgtacgtaacccgtaacgtaaggttaccgttaacggtaacgtcggtaacctacgtaaccgggtaaacggtaaagggtaccggtacgttagttaccggtttacgtttacgaagttaccggttaccgggtacccggggtacccggtaaacggtaacggttacggttaccgggg

SEQ ID NO: 113900 - DNA, 790 bp, Homo sapiens
  misc_feature: GYAE6OF01DBQNW.15.86.H09.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttgggctgagtctgggttttccttgctgctatacgttaaaaggtntccagtgtagagtgnaggtggtggagtcggtggggacgtccgttaggaaacggccggtcgggggtaccccttagagttcctccgttggttgtcggtccttcgtagggactttcgtacctttacgtaggttaagtggtccgtaggtacgtaggttggttccggggtcccgaccggagggtccgtaccggaggggtaacgggggtcgtggggtacggtggggttacggtaaccggttaagtaaaaaagttaagtagtaagtgggtaagaaagaaagtacgacgttagacgaccgtaaccggagaaagtaacgtataccgactacgtcgtaacgaagtataagtaactaaacgaaacggttaggttaacttaacgttagaacgttaaagagttaaaccgacggtaaccgtaaccgggaaaaaccgacgggtaaaccaccgtaacgtaccggttaaccgttaacgttacgttaaccgtaacgtaaacgtcgttaacggttaagtaacggtacgccgtaaggtaccggtaaacggtaaagggtacgtacttagttcgtttacgtttagtagtaccggttccggaccgggtacgacggtacgtaggttacccggg

SEQ ID NO: 113901 - DNA, 753 bp, Homo sapiens
  misc_feature: GYAE6OF01BL5YX.15.86.H09.1.454.CMB.1.raw
  modified_base (605)..(605): a, c, t, g, unknown or other
  misc_feature (605)..(605): n is a, c, g, or t
  modified_base (641)..(641): a, c, t, g, unknown or other
  misc_feature (641)..(641): n is a, c, g, or t
tcagtctacgtagccacgaccggtgctcgatttagtgctatagacttggggtttggggggggagaggagcccccagccttgggatccccaagttgttttcattcagtgatcaggactgaacacagaggacctcaccatggagttcgggctgagcttgggtttcctgctgctatacttaaaggtcgtccagtgtagaagtgcgtagggtggtggagtcggtgggggacgtccgttagggtaacggtccggttcggggggttcccttaggtacgttctccgttggtgtcggtcctcgtggtattcctactttcgagttagtggtcgtggtagtggtacggttcgggtcccgacgtaggtccgtacgggaagggggtacgggtcggtggggtagggttcggggttaacggtaacgtttaaacgaaaaaaggtaaagttggaaggttagggtaaagaaaggtaaaagtacggtaacggtacggtacgaaccgtaccgggtaaaggaaggtaagtactaccactactactaacgtaagataactaactaaacggtaaacgttcggtatttaatcggaaacaagttacgaacctacgtacgaaaggaacgnaacgcaacgtcgtaacctatacacgtacagtacgtntaacggatcggacaacggtacggaaaggtaacgggatcgtttacgtacggttagttacgtaaagttccggttaccggaaccgggttacggacggttaaactcgggttcccgg

SEQ ID NO: 113902 - DNA, 905 bp, Homo sapiens
  misc_feature: GYAE6OF01EE5AW.15.86.H09.1.454.CMB.1.raw
  modified_base (861)..(861): a, c, t, g, unknown or other
  misc_feature (861)..(861): n is a, c, g, or t
tcagtctacgtagccacgaccggtgctcgatttagtgctatagacttgggtttggggggagaggagccccagccttgggatccccaagttgttttcattcagtgatcaggactgaacacagagactcaccatggagttcgggctgagcgttgggtttttccttgctgtcttattacgttaaaaggtgtccagtgtgaagtgcgaggtggtggagtcggtgggggacgtccgttaggtaaacggtccgggttcggggggttacccgttaaggtacgttccgttccgttggtcggtcggtccttcgtcggtactttcctacgttttcgaagtttaagtcggtcgtaggagttcgggtacggtttccggggtaccccggcccgtaacgggtcccgtacccgggaagggggggtaacgggggtcggttagggggtaggggtttaggggggtttacggttaacggttttaaaaccggtaaaaaaggttaaaaagtgtaagttagggtaagtaaaaagtaaaagtaacggtaacggttaccggtacgaccgtaaacccggtaaggaaaaggtaacgtacttaccgaaccgtaactacgtaacgaaagtaacgtaaattaaaacgttaaccgaaaaacggttacgggtttagttttaaacgtttacgaataaaaacgttaacggtaaaccgaaccggtaaccgtaaaaccgggaaaaaacccggtacgaaccccgaaaggtcccgttaacccggtttacttaaacgttaaccgtacgtaaccctaacgtaggttaacgtttaccggaaagttcggaactacggtaacgtaaacgggtaaaggcgttaccgttagttcgtttacgtttnaaggtttcccggtcgggtaccgggaccgtaggtcgtaggttcgg

SEQ ID NO: 113903 - DNA, 790 bp, Homo sapiens
  misc_feature: GYAE6OF01EN4EU.15.86.H09.1.454.CMB.1.raw
  modified_base (665)..(665): a, c, t, g, unknown or other
  misc_feature (665)..(665): n is a, c, g, or t
  modified_base (727)..(727): a, c, t, g, unknown or other
  misc_feature (727)..(727): n is a, c, g, or t
tcagtctacgtagccacgaccggtgctcgatttagtgctatagacttgggtttgggggggagaggagccccagccttgggatccccaagttgttttcattcagtgatcaggactgaacacagaggacctccaccatggagttcgggctgagcgttgggttttccttgctgcttatacgttaaaaggtgtccagtgtagaagtgcgaggtggtggaggtcggtgggggagtccgttaggtaaacggccggttcggggggtacccttagacgtctccgtggtgtcggtcctcgtggtacttcctactttcgtaagttaagtggtcgtaggtagttggtaggttccggggtcccgaccggacggtccgtaccgggaagggggaacggggtcggttggggtaaggggttgggggttacggttaaaccggtttaaagaaaaacggttaaaagttgtaaggttagggtaaggaaagtaaaagtacggtaacggtacggtcgaaccgtaacccggtaaggaaaaggtaacgtaacttaccgaaccgtaactacctaacgaaagtaacgtaaataaacgttaaacgaaaacccggttggttaacgttaatttagaaactaaagtacgaacgtaccgaaccgtaaacggaaaccgagaccacgtacgtaccgtntaacgtacgtatacccgagtacgtagttacggagtcgtaacacgtaacggaaagtaaacggngtaaccttagtccgttagttacgagttacggtcggtaaccgggctaagggtactggttaccgg

SEQ ID NO: 113904 - DNA, 843 bp, Homo sapiens
  misc_feature: GYAE6OF01CSSF4.15.86.H09.1.454.CMB.1.raw
  modified_base (738)..(738): a, c, t, g, unknown or other
  misc_feature (738)..(738): n is a, c, g, or t
  modified_base (788)..(788): a, c, t, g, unknown or other
  misc_feature (788)..(788): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccatggagttcggctgagcgttggttttcctgctgtctattacgttaaaaggtcgtacctagtgtagaagtgcgaggtggtggtacggtcggtggggacgtccgttagggtaaacggtccggttcgggggttacccgttaggtacgttccgttccgttggtacggtcggtacccgttcgttacggtacttaccttaacgtttacgtaacgttacgtggtcgtagggtaacgtcggttacgggttaccgggtccccgaccgacgggtcccgtaaccggggaagggggtacggggtacggttaggggtacgggtttacggggtttacggttaaccggtttaaaacggtaaaaaaggttaaaaggtacgggtaaggttagggtaaacggaaagtaaaaacgtacggttaaccggtacggtaccggtacccgtaacggtaacggtaaagtaacgtacgtacctaaccgtacgtacgtaacgaaagtaacgttaagttaaacgtaaaaccggaaacgggttacgttaagtttattaacgaaactaacgtaacgaaacgttacggaaccgtaaacggaaacgcgactacgtacggtcttaacgtacgtacctanaacccgagtacgtagttcgaatcgaaacttagtacggaacgtaggtcgtnttaagtgttaacgttgaacgttcggaccggacggacctagggtaactggtcccgg

SEQ ID NO: 113905 - DNA, 884 bp, Homo sapiens
  misc_feature: GYAE6OF01DEQZE.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttccttgctgctatacttaaaaggtgtccagtgtagaagtgcgaggtggtggagtcgtggggagccgttaggtaaagccggtgggggtcccttagagtcttccgtgttcgtcggccttacgtggtatttccgtaacttttaccgaaggttaaagtcgggtccgtagggaagttacgggttaacggtttccggggtaccccgccgtaacgggtccccgttaaccggaggggggtaacggggccgttaggggtaaggttcggggttacggtaacggttttaaacaaaaaaggttaaaaattggaagttagggtaacaaaagggtaaaacttaacggtaacggttaaccggtacgaacccgtaacccgggttaaaggaaaaaggtacggtaacttaccgaacccgtattaccggaacaaaggagtaaacgttaacgttaaaccgaaaaacggtcgggttattaaaccgtttaggaaacccaaaagtttccggaaaacctacggtaacccttaaaggaaaaaacccgggtcggaaaccctacgtaaacccgttccggttaactttaaacgtcccgttaaccgtacccgtaaaccggtagtttaaacggttcccggaaagttaccgaacggttaactaccggggaaaacggtaaaaggtcggtacctttaagtcgttaccggtttaaacgttacgtccgggtacccgggacgtaaggtaaccgtaaggtttcggg

SEQ ID NO: 113906 - DNA, 738 bp, Homo sapiens
  misc_feature: GYAE6OF01B4GEX.15.86.H09.1.454.CMB.1.raw
  modified_base (333)..(333): a, c, t, g, unknown or other
  misc_feature (333)..(333): n is a, c, g, or t
tcagtctacgtagccacgaccggtgctcgatttagtgctatagacttgggtttgggggggagaggagccccagccttgggatcccccaagtgttttcattcagtgatcaggactgaacacagaggactcaccatggagttcgggctgagctgggttttccttgctgctatacttaaaaggtgtccagtgtgaagtgcaggtggtggagtcgtggggagccttggtaagccgtgggggtcccttagagtctcctgtgtggcctctggtattctactttcagtaagtggctggatgaggttgggtccgccaggctccgaggggaaggggcgtggnggtggggttggaccgtttacgaaaaagttaaaaatgaagtgggtagaagaaaaatagtaacgtacggtgacaaccccggtaggaaaaggaagagttaccaaccagtacctacaagtaagaattaaactacgaaaaacggtaccggttagttaagtttagactaaaagtacgaaacacggaacccgtaacgggaaaacccgaacgggtaaacccgaaaccgttaaccggaccccgtttaccttaacgtttaccgttaaccgtaaccccaagtaaccgttaagttaaccggtaaggttcggaactacggtaaccggtaaacggtaaagggacggtattagaggtttccgttttagaagtttacgtcggtacccgggggtaccgacggggaaacgtaaggttaccggg

SEQ ID NO: 113907 - DNA, 953 bp, Homo sapiens
  misc_feature: GYAE6OF01AJB1H.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagtcgtgggttttccgttgtctgtcttacttacgttaaaggtcgttacctagtggtagtaaggtgcgtagggttgggtggaggttcgttgggggacgtccgttagggtaaacgtccggttcgggggttcccttaggtcgtcgtctgtgtcggccgtctggtagttcttacttctacgtagtggtcgtggtactggtaggttcggtccgtccgaagggtccgtaccgggacgggggtaacgggtcggtagggtaggttacgggggttacggtttaacggtttaaaccggtaaaagtttaaaagtgggtaacgtacgggtaaggtaaaggaaagttaacggacggttaacggttaccggaccgttaaaccccgggttaaggaaaacgtacggttaaaacctccgtaaacgtaccgtttaacgaaccggtaaagttaaacgaacgttaaaacgttaaaaccggtaaaacgggttaacgggtttactaacggtttacgaaaacggttaaacgttaaacggaaacgtacccggtaaaaccggttaaacccggtaaaaacgggaacccgtaaaccggtaacccggtaacccgtttaacccgtttaaacccggtttaaaccgtttaacgttaaaccggacccgtaaaacgttaacgggtaaaccccgttaaggttaaacggtcccgtaacgtaaacgggttacgggtaaaacccggttaaagggcgggttaaaatttcccgttgggtttaaacgttattacggtttacgtaaccggggttggtaaaaccccgggtagaccggttaaggtttccgg

SEQ ID NO: 113908 - DNA, 914 bp, Homo sapiens
  misc_feature: GYAE6OF01CS7JA.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtcagtgtgaagtgcgtaggtggtggagtacgtgggggacgccgttaggaaacgtccggtaggggggtcccttaggacgttcctccgtggtcggtcggtccttcgttaggtactttccgtacgttttactaaggttaagtgggtccttagggacttgggtaacggtttcggggtccccgaccgtaacgggtcccgtacccggaaaggggggaacgggggtccgttaggggtagggttacggggtttacggtaaaccggttttaacgaaaaaaaggttaaaaagtggtaacggttaagggtaaggaaaaaggtaaaaaagtaacggtaaccggttaacgggtacgtaacccgtaaacccgggtaaaggaaaaaacggggtaactaaccgtttaaccaaacccctacttaaccggtaacgtaaaaacggtaacggtaaaacttaaacgtttaaaccgaaaaaaaccgggttccgggtttaaagtttaaacggttttaacggaaaaccttaaaaggtaaccgaaaaccgtaacggtaacccgttaaaacggaaaacccggaacggtaacccgaacgtaccggtaacccgttactttaacgttaccgtaccggtaacctaaacggtgttaacgttaacgggaagttgaaccgtagaccggtaaagtaagggacgttcttagtcgttagtttacgaacttaggtcccggtacgggaacgacgggtagtaacggtttcgg

SEQ ID NO: 113909 - DNA, 725 bp, Homo sapiens
  misc_feature: GYAE6OF01C8DJZ.15.86.H09.1.454.CMB.1.raw
  modified_base (142)..(142): a, c, t, g, unknown or other
  misc_feature (142)..(142): n is a, c, g, or t
  modified_base (175)..(175): a, c, t, g, unknown or other
  misc_feature (175)..(175): n is a, c, g, or t
  modified_base (181)..(181): a, c, t, g, unknown or other
  misc_feature (181)..(181): n is a, c, g, or t
  modified_base (189)..(189): a, c, t, g, unknown or other
  misc_feature (189)..(189): n is a, c, g, or t
  modified_base (211)..(211): a, c, t, g, unknown or other
  misc_feature (211)..(211): n is a, c, g, or t
  modified_base (358)..(358): a, c, t, g, unknown or other
  misc_feature (358)..(358): n is a, c, g, or t
  modified_base (451)..(451): a, c, t, g, unknown or other
  misc_feature (451)..(451): n is a, c, g, or t
  modified_base (479)..(479): a, c, t, g, unknown or other
  misc_feature (479)..(479): n is a, c, g, or t
  modified_base (624)..(624): a, c, t, g, unknown or other
  misc_feature (624)..(624): n is a, c, g, or t
  modified_base (640)..(640): a, c, t, g, unknown or other
  misc_feature (640)..(640): n is a, c, g, or t
tcagtctacgtagccacgaccggtgctcgatttagtgctatagacttgggtttggggggagagagccccagccttgggatccccaagtgttttcattcagtgatcaggactgaacacgagaggactcaccatggagtcggcngagcgtggtttcgtgagtgctatacgtaaggtntcagtntagagtgnagggtggtgacgtcggtagggngtaccgtaggtaacgtccggtcggggtcctagacgttcctccgtgtcgcgtacctcgtaggacttcttaacgttctaagtagtcggacaggtaagtggtaacggttccggccgacggacgtcgtaccgggtaaaggggccggtttgnggttacggtgggttaacgtaacgttaataaaaaggtaagtagtacggtgaaagtaagtaaaactcggaacgtacggtacaacgtacgggtaanaacgggtaaacgtctacgtactacgtanaacggtaataaacgtaattaaaccgtaaacgtaaacgagttaacgttagttaacaacgtaagaacgtaacgacgtaacgtaaccgaacgtacgaacacggtactacgtacttacgtacctaatacaacgtatacgtacgacgtanactacaaccggttaanacggttaacggtactaggttacgttaacgttttagaagttcgggtaaaccgtacgggaaccggtaccggttagtccggtttacgg

SEQ ID NO: 113910 - DNA, 826 bp, Homo sapiens
  misc_feature: GYAE6OF01B71VB.15.86.H09.1.454.CMB.1.raw
  modified_base (147)..(147): a, c, t, g, unknown or other
  misc_feature (147)..(147): n is a, c, g, or t
  modified_base (208)..(208): a, c, t, g, unknown or other
  misc_feature (208)..(208): n is a, c, g, or t
  modified_base (696)..(696): a, c, t, g, unknown or other
  misc_feature (696)..(696): n is a, c, g, or t
  modified_base (807)..(807): a, c, t, g, unknown or other
  misc_feature (807)..(807): n is a, c, g, or t
tcagtctacgtagccacgaccggtgctcgatttagtgctatagacttgggtttggggggagaggagccccagccttgggatccccaagtgttttcattcagtgatcaggactgaacacagacggactcaccatggagttcgggctgngtctgggtttccttgctgctatacttaaaaggtgtcctagtgtagaagtgacgaggttggnggtagtcgtagggggacgtccggttaggtaacggcccggttcggggggttacccttaggacggttccttccgtggttcgtcgggtcccttacgtgggtactttaccgtaccttttacgaagttaagttcgggtacgtaggtagtgggtacggttcggggtcccgaccggcggtaccgtaccgggaggggggtaacgggtcgtggggtaggtcgggggttacggttaccggttttaaaagaaaaaggttaaaacgtggtaggtttaggaagaaacgtaaaagttacgaacggttaccggtacgaaccgtaccgaagggtaaacggaatacctacgacctaactacgtaagaaagtacgaaatttaaccgtaaaccgaaccggtttagggttattaggttaaacgctaaaggtcaaacgtcgtaacccaaaggaaacgcgtacacgtacgtcgtaattccagtaccaaccgtagtatacggttaacgggntaggaacctaccgggttaagaaacgggtaaacggtcggtaaactttccggtaatttttcggttaagaaccgtttccggtccgggggttaacccgggaaccgtaacggggtntccccgggggtttaacggg

SEQ ID NO: 113911 - DNA, 767 bp, Homo sapiens
  misc_feature: GYAE6OF01CN4Y4.15.86.H09.1.454.CMB.1.raw
  modified_base (692)..(692): a, c, t, g, unknown or other
  misc_feature (692)..(692): n is a, c, g, or t
  modified_base (746)..(746): a, c, t, g, unknown or other
  misc_feature (746)..(746): n is a, c, g, or t
tcagtctacgtagccacgaccggtgctcgatttagtgctatagacttgggtttgggggggagaggagcccccagcccttgggatccccaagtgttttcattcagtgatcaggactgaacacagaggactcaccatggagttcggctgagcttggttttccttgctgctatacgttaaaaggtcgtaccagtgtgaagtgcgtaggtggtggagtcggtggggacgtcgttagggtaaacgtccggttgggggtacccttacggtacgtcgttccgtcgtggtcggtccgtccgttaggtacttacgttaccttacgttagtagttaggtcgtgtaggtgtaggttcggtcccgccgtacggtccgtacggaacggggacggggacggtggtagggtgggttagggtaaccgttaaagtaaaacgtaaaagttaacggtagtacggtaaggaagtaaaaggtaacgtaaccggtacgtacgtaccggaacccgtaacggaaagtaacgtacgtacgtacccaactacgtaacaagtaacgaattaaacgtaaaccgtaaaccgggtaagtttcgtaaacgtttacaacgtaagttaacggaacaacccggtacgtaaacccgggtaaaagaaccccgtagaacccacgtcgtttaacctagttacctaacgacctacgtagacgttacgacgngtaacgtgaacgttagaaacggtgtacttgtacgttgtagtaactggtaccggnggtaccgagtagtaggttccg

SEQ ID NO: 113912 - DNA, 779 bp, Homo sapiens
  misc_feature: GYAE6OF01DF8GD.15.86.H09.1.454.CMB.1.raw
  modified_base (217)..(217): a, c, t, g, unknown or other
  misc_feature (217)..(217): n is a, c, g, or t
  modified_base (295)..(295): a, c, t, g, unknown or other
  misc_feature (295)..(295): n is a, c, g, or t
  modified_base (732)..(732): a, c, t, g, unknown or other
  misc_feature (732)..(732): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagtcgttgggtttttcctgctgacttagttacgttaaaaggtcgtccagtgtagaagtgcgtaggtggtggnggtcggtggggactccgttagggtaacgtccggtcggggtcctagcgtctcgtgtgtcgcctcgtgtacttctacttnagtagtggtcgtggtagtggtacggttcggccgccgacggtccgtacgggaaggggtacgggcgttagggtgggttggggtttacgtaacgttttaaacgaaaagttaaaagtggtaagtagggtaaagtaaaagtaaaacgtacggtaaccgttacgggactaacccgaacggtaaggaaacggtaaataccttaaccgactacgtacgtaagaaacgtaacgtaaattaaaccttaaacggaaaacgttacggtttagttaagttacgaaactaagtaacgaacgtacgaaccgtaaccggaaaaccggacgtacctacggtacctacccgttattaacggccgttaacaacccgtgtaaaggtccgttaaggatcgtaaacgtaaccggtaagggaaacggttaggcgttaacttaggtttacttagggtttanaacggttcccggtaagggtccgggtaccgaaagttcgtaggttaccg

SEQ ID NO: 113913 - DNA, 861 bp, Homo sapiens
  misc_feature: GYAE6OF01DRIEA.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtcagtgtgaagtgcaggtggtggagtcggtgggggagtccgttaggtaaacggtcccggttgggggggtcccctttaaggtcgttcctccgtggtggtcggtcctacgtggtacttctactttcaagttagtggtcgtggtagtggtaggttcggggtcccgaccgtagggcccgttacccgggaaggggggtaaacgggggtcggtaggggtagggttcgggggtttaggtaaccggttttaaagaaaaaacgttaaaaagtaggtaagttaggtaaggaaagtaaaaagtagtaaccgtaacggtcgaaccgtaacccggtaaggaaaaggaacgtaacgtttaaccaacctaacgttaccgtaacgaaagtaacggtaaattaaaacgtttaaacccgaaaaaacgggtacggtttaagttaacgttttaacgaacgttaaaaacggtacgaaaccgaagtaaacccgtaaacggaaaaacccggaacggaacctaacgtaaccgtacccgttaccttaactttaccgtaacgtacccaacgtaaggttacgtaacggtaggtacgaacgtaacggtacgtaaaccgggtaaagtcggtacgttagtttacggttacttttagaacgttacggtccgggtaccgggaccgtaacgggtaacgtaacgggttccggg

SEQ ID NO: 113914 - DNA, 895 bp, Homo sapiens
  misc_feature: GYAE6OF01A42VQ.15.86.H09.1.454.CMB.1.raw
tcagtctacgtagccacgaccggtgctcgatttagtgctatagacttggggtttgggggggagaggagccccagccttgggatccccaagtgttttcattcagtgatcaggactgaacacagaggactcaccatggagttcggctgagcgttgggttttccttgctgactatacttaaaaggtcgtccagtgtgaagtgcgtaggtggtggaggtcgtggggacgtcgttaggtaacggtccggtacgggggttcccttagacgttctccgtggtcggtcggcccttcgtaggtattcttacctttacgaagttaacgtggcgtaggtacgttagggtacggttcgggtcccgaccggtacggtaccgtacccggggaagggggtaacgggggtcgtggggtagggttggggttacggttaaccgtttaaaacgtaaaaaaaggttaaaagtcggtaagtagggtaaggaaagtaaaaagtacggtaacgtaacggtcggaacccgtaaccggaagggaaaaggtaacgtaaccttacgaaaccttacgtacccgtaaacgaaacggtaaacgtaatttaaaaaccggaaaccggtaaaaccgggtggtttaacgttaaagtttaccgaaaagtaaacgtacggaaacaaaccgggtaacccgtaaaacgggaaaaccgtaggaacccctacgtaacgttacccgtttaataacggttttaacccggacctaaaccggaaactttcggtaccggttaagggaaacgtccttacgggtaaagtacccggggtaaaaagggtaggtaccggtatttaggttaccgtttcgttttaagaactttcccggggtacgggttacccggggaacgtacggtaacccgtaggggtttccccgg

SEQ ID NO: 113915 - DNA, 822 bp, Homo sapiens
  misc_feature: GYAE6OF01AL4QP.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacgttaaaacggtgtccagtgtgaagtgcgtaggtggtggagtcgtgggggatccgttaggtaaacgccgtgggggtcccttaggacgtctccgtgtgtcggccttcgtggtacttctacgtttacgagttaaatgggtactggtacgttaggtagggtttccggggtacccgaccgaacggtccgttacccggaagggggtaaacgggggtcgtacgggtacggtttaggggttacggtaaccggttttaacgaaaaaagttaaaaacgtggtaagtggtaaggtaaagaaaagttaggacgtacggtcgacgtaaccccggtaaggaaaacggtaagtacgttaccgaacccgtagtaccctaagaacgtaagtaaacttaaacgttaacccgaaaaaggtaccggtttaagtaacgtttagaacgtaaagttaaccgaacgtacgaacccgtaaacggaaaaccgacggtaacaccggtaacggtacccttaacgttaacgtttaacgtaccgtaaaccgtaacgtaaggttaacgttacggtaagttcgaactccgtacggaaacggtaacggaggtacttacgttacggttacttaggtattacgttaccgggccgggtaacgtacggtaaccgtaagttcccgggg

SEQ ID NO: 113916 - DNA, 802 bp, Homo sapiens
  misc_feature: GYAE6OF01AIXL8.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctggagcgttgggtttttccttgctgctatacgttaaaaggtgtccagtgtgaagtgcgaggtggtggagtcggtgggggacgtccgttagggtaaacggtcccggttcggggggttacccttaggacgttccgttccgttggtcggtcggtcccttcgtggttacttcctacttttcgaagttaagtgggtacgtggtagttggtacggttccggggtcccgccgacggtccgtaccgggaagggggaacggggtcgtagggtagggttcggggtttacggttaaccggttttaaacgaaaaaaggttaaaagttggtaagtagggtaagaaaaggtaaaagtaacggtaacgtaacgggtacgaaccggtaaccggtaaggtaaaaggtactacgttacccaactaacgtacgtaacgaaagtaagtaaacttaacgtaaaccgaaaacggttcggtttaagttattacgaaactaaaagtacgaaacgtacgaacccgtaaacggaaaccgagaaccacggtacgtacccttaatacttaccgtacacctaagtagtacgttacggaagtcacgtacgtacggtaaaggtaagcgtactagttcgttagttacgaacttcggtccggtacgggaacccgtaggtacgtcgggttcgg

SEQ ID NO: 113917 - DNA, 823 bp, Homo sapiens
  misc_feature: GYAE6OF01ECENR.15.86.H09.1.454.CMB.1.raw
  modified_base (203)..(203): a, c, t, g, unknown or other
  misc_feature (203)..(203): n is a, c, g, or t
  modified_base (539)..(539): a, c, t, g, unknown or other
  misc_feature (539)..(539): n is a, c, g, or t
tcagtctacgtagccacgaccggtgctcgatttagtgctatagacttgggtttgggggggagaggagccccagccttgggatccccaagtgtttcattcagtgatcaggactgaacacagaggactccaccatggagttcgggctggagtcgttgggttttcccttgctgctatacttaaaggtgtaccgagtggtgaagtgngaggtggtgaggtcggtgggggacgtcgttaggtaacgtccggtcgggggtcccttaagagtcctccgtggtcggtcggtccttcgtaggtacttccttactttcgaacgttaagtcggtcgtgggacttaggtaggttccgggtcccgcgacggccgtaccggaggggtaacgggtcggtgggtagggttcggggttacggttaaacggtttaacgtaaaaaaggttaaaagtgtaacggtagggtaaaggtaaaacggtaaaagtaccgtacggtaacggtcgacgtaacccggtaggaaacgacgtactaccgactacgtactacgaagtaanaagttaactaaacggaaacgttacggtaagttacgtaacgagtaaacgacgtaagtaaccgaccgtaaaccgaaaacgacgaccaacgtaccgtaaccgtaccgtttaacttaccgaattaaccccgtagtaacggtttacgttaaccggaaaggcgttaacgttaaacgaacccggggtaaggtaaaaccgggtcgttaacggtactttaacggtttcgtttagaccggttaacggtcgggtacccggggaaacgtcgggttaaacggtggtttcccccgggg

SEQ ID NO: 113918 - DNA, 817 bp, Homo sapiens
  misc_feature: GYAE6OF01EEDAH.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtagaagtgcgaggtggtggagtcgtgggggagtccgttaggtaaacgccgtggggggtcccttaggacgtctccgtgtgtcggcctcgtggtacttctactttcagtaatggctggatggtagttgggtccgcgaggctaccggaggggaacggggtcgtgggtaggttggggttaggtaacggttttaacaaaaaggttaaaaagtggagttagggtaggtaaacgtaaaaagtacggtaacgttacgggtagacccggtaacccggttaagggaaaaggaaacgtaactttacccgaacctaacgtacctacgaaaagacgtaaattaaacgttaaaccgaaaaacggtacggttagttaattttacgaactaaaagtacggaaactaacgtaccgtaaacggaaaaccggtacggaaccaaccggacggtacccttacttaaacgtttaccgtaacgtaaccctaagtactttaacgttaccgggtaagtacggaccgtaaacgttacccggaaaacgggtaaaacgggttcggtaactttaggttcgttaacgttttacgtaacgttacggttacccgggttacggggaacccctaaggggtaaccgtaacgggtttcccgggg

SEQ ID NO: 113919 - DNA, 849 bp, Homo sapiens
  misc_feature: GYAE6OF01CY2OT.15.86.H09.1.454.CMB.1.raw
  modified_base (574)..(574): a, c, t, g, unknown or other
  misc_feature (574)..(574): n is a, c, g, or t
tcagtctacgtagccacgaccggtgctcgatttagtgctatagacttgggtttgggggggagaggagccccagccttgggatccccaagtgttttcattcagtgatcgaggactgaacacagagactcaccatggagttcgggctgagcgttgggttttccttgctgcttattacgttaaaaggtgtccagtgtagagtgcgagggtgggtggtaggtcggtgggggacgtccgttagggtaaacggtccgggttcggggggttcccttaggtacgttccgttccgtggttcggtcggtcccttcggtggtactttcttactttcgtaagttaagtggtcgtaggtaagtgggtacgggtttcggggtcccgacccgtaacgggtcccgtaccggggaagggggtaacgggggtcgttaggggtagggtttcgggggttacggtaaccggttttaaaacggaaaaaaggttaaaagtagggtaaggttaagggtaacgaaaagtaaaagtaggaaccgttacggtacgaacccgtaaccggtaagaaacggaactactaccgaactatacgaanaagataattaacgtaaccgaaacggtcgttaagttaacgttagaactaaagtacgaaacgaccgtaaccgtaacggaaaaccgtacgaaccaacgtacgttacctaacgttaactaccgtaaccgtaacctagtacggtaacgttacggtaagtaccaacgtaacgtaaccggaaaaggtaagggtaccgttacgttaagttttaacggttacgtaacgtttacggccgggttacccggggaacccgtaagggtaaccttgggtttccggtaccg

SEQ ID NO: 113920 - DNA, 740 bp, Homo sapiens
  misc_feature: GYAE6OF01EQUAK.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtcagtgtgaagtgcaggtggtggagtcgtggggagtccgttggtaaacgccggtgggggtccttagagtctccgtgtgtcggcctgtggacttcactttcaggttaatggtctggacgttggtacggtttcggggtcccgccgaggtcctaccggaagggggtaagggtcgtggggtaggttgggggttagtaaccgtttaacgaaaaaggtaaaatggtaagtggtaagaaagtaaaagtacggacgttacggtcgaccgtacccggtaagaaaacggtaacgtacgttacaaccgtagtactaacgaaagtagtaacttaaactaacgaaaaacgtacggtagttaacgtttacgaactaaagtacgtaaacgacgaccgtaacgaaaccggagaaccacgacgtaccgttactaattactacgtacacgtagtaacgttacggaacgtcgtaacgtacgtaacggtaacgtaaacggtacggtacgttagttacgttgtttaacagttacgtccgggttacgggaaccccggtagggtaaccgtaagggttccgg

SEQ ID NO: 113921 - DNA, 642 bp, Homo sapiens
  misc_feature: GYAE6OF01EAN29.15.86.H09.1.454.CMB.1.raw
  modified_base (347)..(347): a, c, t, g, unknown or other
  misc_feature (347)..(347): n is a, c, g, or t
  modified_base (420)..(420): a, c, t, g, unknown or other
  misc_feature (420)..(420): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtcagtgtgaagtgcaggtggtggagtcgtgggggagtccgttggtaaagccgtggggggtcccttaggagtctcctgtgtggcctcgtggtattctactttcagtaatggctggatgtagttggtccgcaggctccgagggagggctggaggtgggttggacgttanaaaagtaaatgatggtagaagaaatagacgtacggtgacgacccgtagaaaggagtattacacatcacaaganataatacaaaacgtcggtatattagaataagtagaacacgacctaagaaaaccgacggaacacgacgtccgtacgttaattacctacgtaccaacgtagtacgttacggaagtcgacgtactaccggaaacgggtaaagggacggtaacgttagtcggttcgttttagaatttacggttacccgggtacgggggaccctaacggggtaactaggttaccggg

SEQ ID NO: 113922 - DNA, 804 bp, Homo sapiens
  misc_feature: GYAE6OF01AEC8L.15.86.H09.1.454.CMB.1.raw
  modified_base (734)..(734): a, c, t, g, unknown or other
  misc_feature (734)..(734): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtctgggttttcctgctgctatacgttaaaggtcgtcagtgtagagtgcgtagggtggtggagtcgggtgggggacgtccgttagggtaaacggtcccgggttcggggggttacccttaagggtacgttcctccgttggtcggtcggtccttcgtggtacttctacttacgagttaacgtggctggagtggtacggttcgggtcccgcgacgggccgtacgggagggggtacgggtcggtagggtacgggttcggggttaacggttaacgttaaacgaaaaaggttaaaagtggtaaggtaggttaaaggaaaagtaaaacgttacggaaccggttacggtaccggtaacccgtaacccgggtaaaggaaaacggtaacgttactaacctaccgtactaccgttaagaaggtaaagtaaactttaaacgtaaccggaaaacgggttgtttacggttaacttacggaaactaagtaccggaacctaacggtaccgaaacgtaaaccggagtacccaacgtccgaccgttactacttacgacgacaagtagttacgtaggtagacgacgtaagtaggaaggtaacggtnttcgtatttcggtatttacgaacgttacgggtacccgggtaggaacccggtggtaacgttgggttcccgg

SEQ ID NO: 113923 - DNA, 887 bp, Homo sapiens
  misc_feature: GYAE6OF01B8ZSO.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttcctgctgctatacttaaaggtgtaccagtgtgaagtgcgaggtggtggaggtcgtggggagtccgttaggtaaacgccggtgggggtacccttagtacgtcctccgtgtgtcggcctcgtggtacttctactttcgagtaagtggtcgtggagttggtacggttcgggtccgaccgacgggtccgtaccgggaaggggaacggggtccgtaggggtacgggttaggggttacggtaaccggtttaaagaaaaacggttaaaagtcggtaagttgggtaaagtaaaggtaaaacgtacggtaaccggttacggtacgtaacccgtaaccgggtaaggaaaacggtaacgtaacgtttaccgaaacctagtaaccgtaacgtaaaggtacgttaaatttaaaccgttaaaacgaaaacgggttacggtttagtttaacgttacgaaacgtaaagttacgaaaacgtaccgtaacccgtaaaggtaaacccggacgtaaaccgtaccgtacggttacccgttaaccttaagttacccgtaaccgtaaccgtaccgtaaaggttaccggttaacgggtaacgtcgtaaccgttaaccggttaacgggtaaaacgggtaaaccggacgggttaccgtttaaggttcccgggtttacctttacggtaacgttaccgggttaccccggggtacgggttaaaccccggaagggttaaccgttcgggtttacccgggg

SEQ ID NO: 113924 - DNA, 1040 bp, Homo sapiens
  misc_feature: GYAE6OF01BIPN6.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccagtgggaggttcgggctgagtcgtttgggttttcctgctgtacttatacgttaaagtgtaccgtagtgtagagtgcgtaggtggtggtagtcggtggggacgtaccgttagggtaacggtccgggtacggggttaccctagtacggtccgttccgtggttcggtcggtccgtcgttacggtactttacctacgtttacgtaaggttaacgtggacgttaggtacgttagggtacggtttccggggtacccgtaccggtaccgggtacccggtaccggggtaacggggggtacgggggtccgttagggggttacgggttttacggggttaacggtttaaccggttttaaaaaggtaaaaaacggttaaaagttacgggtaagttaagggtaaaggtaaaacggtaaaacgttaacggtaaccgggttaaccggtacggtaaccccggtaaacgggtaaaggtaaaacggtaaacgttaaccttaacccgtaacgttaacgttaacaacggtaaagtaagtaaacgttaaaaccgttaacccggtaaaaacgggtttcgggtttaactttaaaggtttacgaaaaacgttaacggttaaaaccggttaaccgaacggttaaacccggtaaaaccggtaaaaccgggtaccggaaaccgttaacctaacccgggtttaccgttaaactttaaaccgttcccgttaaacgttaacccgaaccggtttaacggtaacggttaccgggtaacctacggtaaaccggttaaccggtaaacgggttaaacggggaaacgggttaccggttaacgtttacggtttacggtttaacctttacggtaagttttacccccggggaaccgggttaaccgggtaaccccgggtaaagggttaacccggtttggtttacccggg

SEQ ID NO: 113925 - DNA, 747 bp, Homo sapiens
  misc_feature: GYAE6OF01AEAZV.15.86.H09.1.454.CMB.1.raw
  modified_base (181)..(181): a, c, t, g, unknown or other
  misc_feature (181)..(181): n is a, c, g, or t
  modified_base (696)..(696): a, c, t, g, unknown or other
  misc_feature (696)..(696): n is a, c, g, or t
tcagtctacgtagccacgaccggtgctcgatttagtgctatagacttgggtttgggggagaggagccccagccttgggatccccaagtgtttcattcagtgatcaggatgaacacagaggactcaccagtggacgttcgggctgagtcgttgggttttcctgctgactatacgttaaaggntaccgagtgtagaagtcgcgtagggtggtcggtaggtcggtaggggacgttacgtagggtaaacggtccggtcgggggttcctagcgttctccgtgtcggtcggaccttcgtacggtacttcgtacgttacgtaagtaacgtgggtcgttggagttcgggtacggttccggtccggaccgtggtacctacggggaggggtacggtcggtaggtggttacgggttagtaacgttaaacggaaaataagtcgtagtagtataaggtaataacgtaggtacgtgaacccggtaggtaacgaaggtactacgttacaactctaccggtagaacgtagtaactaacgtaagtaaccgtggttagttatacgaagtaacgtacgaacgtccggtaaacgaaacgaccgggaactacgaccgttactacgttacctaaacgtttccgaaacgtacccgaagtagttaccgtagacgtagaccggaagttaacccgggaagtcggtactaggtcgttacggtnttagggtactcccggtccggggaagtacccgtaaggtccgtttggtaaccg

SEQ ID NO: 113926 - DNA, 771 bp, Homo sapiens
  misc_feature: GYAE6OF01AJCZ1.15.86.H09.1.454.CMB.1.raw
  modified_base (637)..(637): a, c, t, g, unknown or other
  misc_feature (637)..(637): n is a, c, g, or t
  modified_base (712)..(712): a, c, t, g, unknown or other
  misc_feature (712)..(712): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatctaaaaggtgtccagtgtgaagtgcaggtggtggagtcgtgggggagtccgttggtacgaggccgtgggggggtccctggagtactccgtccgtgtgccagtccgtcgaggtacttcggtccctttcgctattctagttcgccgtaagtcggacccgttcggggtcccccgtacccggtaacgggtccgttaccccggaaggggggtaaaccgggggtcggttacggggtaagggtcgggtaacgttcccgttaacgaggtaccgttaaggtttaagggtggggttagggtaggggtttacggtacgggttaagaaaaaccgtacgtaaagttaacgtttaacggacgtacgggtccgttaccgggtaggaacggggcccggttaccttaccgaccacgttaccgacccgaagacgtaaactaactacccgtaaaacaaaccgtacttaacctttactaccgtttaanaaaaccgttgaaacgtacgtacccgtagaccgggaacgacccggtagaacccgtacggtcctaaatccgtgtcgnggacgtacgatcgtaggacgacgggtcggttcggacgtcccgttgaacgtcgggacggg

SEQ ID NO: 113927 - DNA, 753 bp, Homo sapiens
  misc_feature: GYAE6OF01CWLN1.15.86.H09.1.454.CMB.1.raw
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
tcagtctacgtagccacgaccggtgctcgatttagtgctatagacttggggtttggggggggagaggagccccagccttgggatccccaagttgttttcattcagtgatcaggactgaacacagaggactcaccagtggtagttcggctggagtcggttcggtttcgtgacgtgatagttacgttaaaggtgtactggtgagtagcgngtaggtggnggtagtggngggtctcgtagggacgtcgggtcgggtacctagtctccgtntaggngcgccttgngtacttcgtacttgaagtgcggtagtaggacgttacggtaggttccggccgacgtacggtccgtacggggaaggggtacggtgtagggtaggtcgggttagtaacgtaaagtaaaatacgtagtaggtagtaagaaacgtaaggtcgtaacacggtcaacgtaacggaaggtaacgattcaccaatctacgtaanagtaactanaagttaacaaaggtgtaactattacgaatacgaagtacgactaacggtaacgaaaccgacggtaacgtaccgtaacggtcttaaacgactttaaccaaccggtactaacgggtacgtaacggtaccggtacgttagaaccgttaacggtaaaccggtgggaaaaccggttcgtaacggtttaagtaccggttttaacgttaccgttaagggttaccgggtaaaccgggttaacgggggttcctaaacggggacttggggggttacccc

SEQ ID NO: 113928 - DNA, 926 bp, Homo sapiens
  misc_feature: GYAE6OF01CVUI8.15.86.H09.1.454.CMB.1.raw
  modified_base (346)..(346): a, c, t, g, unknown or other
  misc_feature (346)..(346): n is a, c, g, or t
  modified_base (809)..(809): a, c, t, g, unknown or other
  misc_feature (809)..(809): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctggagcgttgggtttttccttgctgtactattacgttaaaaaggtgtccgtagtgtgaagtcgcgagggtggtggaggtcggtagggggagtcgtacgggtaacggtccggtaggggggttacccttaggtacgttcctccgttgttacgtcgggtacccttcgttaggtacctttcttaacgttttaccgaaggtttaaacgnggtacggttggtaaagtttcggttaacgggtttccggggaccccgtacccggaacgggtaccccgtacccgggtaaggggggaacgggggtaccgggttacggggtaacgggtttaggggggtttaccgttaaaaccgggttttaaacgtaaaaaaaaggttaaaagtagggtaagttaaggggtacggtaaaaagtaaaaatacggtaaaccggttagggtaacccgaaccgtaacccgggtaaaggaaaacgggttaacgtaaccttaccgaaacccttagttaacgtaaacgaaagtaagttaactaaacgttaaaacgaaaacccggttggttaacgttaataacgtaaacaaagttaaacggaaactacgaaccgtaaacggaaaacgtacggaaccaacacggttcccgaattacgttaactaccttaaacgccgttaagaacgtttacggaaggtnaaactcggttaaacccgagggtaaacgttacggcgttaggtaccggttagtttaacgtaagttaccggtacccggggtaaagggtaacccgaggggttaaaccaaggggttcccggg

SEQ ID NO: 113929 - DNA, 837 bp, Homo sapiens
  misc_feature: GYAE6OF01CAB0P.15.86.H09.1.454.CMB.1.raw
  modified_base (215)..(215): a, c, t, g, unknown or other
  misc_feature (215)..(215): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtgtcagtgtagaagtgcaggtggtggagtcgtggggngaccttggtaaacgcgtggggtccttagagtctctgtgtgctgtggattctattcagtaagtggacgtaggtagtggtaggttcgggtacccgcgtacggccgtaccggaggggggtacgggtccggtaggggtaggtcgggtttacggtaacgtttaaacgaaaaagttaaaaagtggaagttagggaagtaaagaaaacttaggaacggtacggtcgaaccaacgggtaacgaaaagggaacgtacttacgaaaccgtatacgtaacgtaaagaacgtaaacgtttaaacgttaaacgaaaaacgggttaccgttagtttaacgttaagaacggtaaaattcggaaaccgttaacggtaaccgttaaacggaaacccggtaacgaccgtaagtcccggtacgttaacttacgttaacctacgtaacccgttaagacgttaacgtttacgggaattaccggaaccgtacggtttaaacgggaaaccggttaaacggacgggtttactaaaccggtttcgttttaaaccgttttaacgggaaactttttcccgggggttaaaagggtcccccgggggtaaacccgaaaacgggggttaaagttacccgggttttcccggggg

SEQ ID NO: 113930 - DNA, 640 bp, Homo sapiens
  misc_feature: GYAE6OF01AHW0Y.15.86.H09.1.454.CMB.1.raw
  modified_base (359)..(359): a, c, t, g, unknown or other
  misc_feature (359)..(359): n is a, c, g, or t
  modified_base (477)..(477): a, c, t, g, unknown or other
  misc_feature (477)..(477): n is a, c, g, or t
  modified_base (494)..(494): a, c, t, g, unknown or other
  misc_feature (494)..(494): n is a, c, g, or t
tcagtctacgtagccacgaccggtgctcgatttagtgctatagacttgggtttgggggggagaggagccccagccttgggatccccaagtattttcattcagtgatcaggactgaacacagaggactcaccatggagttcgggctgagctgggttttccttgctgctatcttaaaaggtgtccagtgtgaagtgcaggtggtggagtcgttgggggagccgttgggtaaacggccgtgggggggtccccttaggacgtctccgtgtgtggcctctggtattcacttttcagttaagtggctggatggaggttggggcccgcaggctccgaggggagggctggagtggttgtacgtttanaaaagtaaatgatggtagaagaaaatgacgtacggtgaccgtacccgtaggaaacggagacttcacctatctacaagatactaatacgaaaacgtcggttatattagataaatgaacncgaccgtaagaaaccgngacacgacgcctatacttactacgtaccagtagtacttcggaatcgactacgacggtaaacggaaaggtacggtacttagttacggttcgtttagaacgttacgtccgggtacggggaacccgaaggggtaccgtaaggttccggg

SEQ ID NO: 113931 - DNA, 841 bp, Homo sapiens
  misc_feature: GYAE6OF01EFLPX.15.86.H09.1.454.CMB.1.raw
tcagtctacgtagccacgaccggtgctcgatttagtgctatagacttgggtttgggggagaggagccccagccttggatccccaagtgtttcattcagtgatcaggactgaacacagagactcaccatggagttcggctgagcgttggttttccttgctgctatacgttaaaggtgtcagtgtagagtgcgtaggtggtggagtcggtggggacgtccgttaggtaacggccggtggggtacccttagacgtctcgtgtgtcgcctgtgtattcgtacttgagtagtgcgtgagtgtacggttcggccgacgacggtcctaccggaacggggaagggtcgtaggggtaggttacggggttaggtaacgttaacgaaaaggttaaacgtgtaggtaggtaagtaaagtaaaagtacgtaacgtacggtacgtacccgtaaccggtaaggaaacgtaacgtaacgtacccgaaacccgtaagtaccgtaacgaaagtaactaagttaaacccgttaaacggaaaaacggttccggtttaagttactttaaaccgtaacgtaaaacgcgtaaaaaccggtccgtaaacccggttaaaccggaaaaaccggacgaaccccttaaggacccgttaccttaacgttacttaaccggttcccaaaaccgtgtaagggttacctaacgggtaacgtactaaccggtaaggtaaccggtaaaaagggtaccgggtacgtttaaccgttaaaggtttttgttaaccccgtttaaggtaacccggttttacgggacccgggttaaccggggaaccccgggttaaagggacccgtttaagggttcccccgggg

SEQ ID NO: 113932 - DNA, 974 bp, Homo sapiens
  misc_feature: GYAE6OF01BFMDT.15.86.H09.1.454.CMB.1.raw
  modified_base (168)..(168): a, c, t, g, unknown or other
  misc_feature (168)..(168): n is a, c, g, or t
  modified_base (185)..(185): a, c, t, g, unknown or other
  misc_feature (185)..(185): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcttgggttttccttgctgnttatacgttaaaaggtntccagtgtagaagtgcgagggtggtggagtcggtagggggacgtccgttagggaaacggccggttcggggggttacccttaaggtacgttccgtaccgtggttggtcgggtcctgttggtacttccgtacttttacgaagttaagtcgggtcttcgggaagttgggtacgggtttcggggtaccccgaccggtacggtccgtaccgggaacgggggacgggggtcggtagggtacggggtttaggggtttacgggtaaccggttttaaaacgaaaaaaggttaaaacgtgtaaggtttagggtaagaaagtaaaacgtacggtaacgttaccggacgtaccgaacccgggttaaagggaaaacggtaacgtactttaacccaaccggtacgttaaccgttaacgaaaacggtaacgtttaaaacgtttaaacccgttaaaaccgggaaaaaaccgggttttcggttaaacgggttttaaactttacgggaaaaccgttaaaacggtaacccggtaaaaccgtacccggtaacccgggtaaaaccgggaaaacccccgggtaaacggtaaccccgaccggtaaaaccccgggtttccttaaaccgggtttaacttaacccggttaaaccggttaaacccgtacggtaaacgtttaaccggtttacggtaacggtccggtaaacgtaacggttaacggaaacggtttaaagggacgtactttagacggtttccgtttaagtaggttacccggtcgggtacccggaaacgtttggtaaaccgtgggttccgg

SEQ ID NO: 113933 - DNA, 817 bp, Homo sapiens
  misc_feature: GYAE6OF01C10TZ.15.86.H09.1.454.CMB.1.raw
  modified_base (131)..(131): a, c, t, g, unknown or other
  misc_feature (131)..(131): n is a, c, g, or t
  modified_base (722)..(722): a, c, t, g, unknown or other
  misc_feature (722)..(722): n is a, c, g, or t
tcagtctacgtagccacgaccggtgctcgatttagtgctatagacttgggtttgggggagaggagccccagccttggatccccaagttgttttcattcagtgatcaggactgaacacagagactcaccagnggtagttcggctgagtcgttgggttttcctgcctgtctagttaacgttaaaggtcgtaccgtagtgtaggtaacgtcgagtagggtgggtcggtaggtcggtcggggacgtaccggttaggtaaaccggtcccgggttcggggttacccttaggacgttcttccgtggtcggtcggtccttcgtggtactttaccgttacgtttaccgtaaggttaagtcggtgtggtatggttacggttcggtcccgcgacggtcgtaccgggaagggtaacgggtggtagggtagggtttcgggttaacggttaaccgttaaaagtaaaaaggttaaagtagtagtacggtaagaaacgtaaagtaccgtaacggtacggtacgtaccgaaccgggtaagtaacgaagtacgtaccgaactagttaccaagtaaacgtaataacttaaacgtaaggtaaaaccggttgttaacgttacgttaacaaagttaacgaacgaacgtaagaacccgtaaacggaaacccgtacggacctaccgtacgttacgttaaccgttaacgttacgtaacctaaccgacgttaacggtagtaacggtanacggtactaacgtaacggtaacggaggtaccgtgttaagtcgttgtttactagttccggtaccgggaccggaggtacggtacggttaggtcccgg

SEQ ID NO: 113934 - DNA, 588 bp, Homo sapiens
  misc_feature: GYAE6OF01C9CJX.15.86.H09.1.454.CMB.1.raw
  modified_base (185)..(185): a, c, t, g, unknown or other
  misc_feature (185)..(185): n is a, c, g, or t
  modified_base (376)..(376): a, c, t, g, unknown or other
  misc_feature (376)..(376): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctcgatcaagctcacctgcaccctaagtgtgagcatcgaactacaccatcgaatggtatcaacagacgaccagggacgtcccccagtactaataatagaaagttaagagtgatggcagccacaccgaaggggacggacgacccgatcgcttcgagtggctccgagttcgnggggctcgaccgtactacctacacctagtcctaccaaccctccagtctagacgatgaggctagagtactcacgtggtaggagagacgaccacaactagttgtaagtccgggaaccgtaagggtcggggttacgggttacgggttcggggaacgggacgggtaacccgaacggtccgtaacggcccgttaaccggtcggtaccgtaacccggg

SEQ ID NO: 113935 - DNA, 725 bp, Homo sapiens
  misc_feature: GYAE6OF01DRF4V.15.86.H09.1.454.CMB.1.raw
  modified_base (134)..(134): a, c, t, g, unknown or other
  misc_feature (134)..(134): n is a, c, g, or t
  modified_base (137)..(137): a, c, t, g, unknown or other
  misc_feature (137)..(137): n is a, c, g, or t
  modified_base (179)..(179): a, c, t, g, unknown or other
  misc_feature (179)..(179): n is a, c, g, or t
  modified_base (469)..(469): a, c, t, g, unknown or other
  misc_feature (469)..(469): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccanggngtcgggctgagcttggttttcctgctgctatacttaaaggtntccagtgtagagtgcagggtggtggagtcggtggggagccgttagggtaaacggccggttacggggggttcccttaggacgttcctccgtgtgcggcctcgtggtacttctactttcaagtagtggctaggatacggtaggttcggccgccgaagtcccgtacggaaggggagggtcgtagggtaggtggggttaggtaacgtttaacgaaaaagtaaattggacgtaggtacgaaaagaaagtagacgtacgtgaccgtaccggaagaaaggtactacgttcaaccgtntacaacgaaagtagaaattaactaactaaaacggtcggtaagttagttaagataaacgtaacaacgtacgaacgtaacggaaaccggagtaaccacgtacgtaccgtaaccgtagtttaacaccgtaacgtacgtacgtaggttacgaacgttaggaacctaacggttaacgaaacgggtaaggacggttaactagttacggttacttagtacgtacggttacggtacggaacccggtaggacgtaaacggtccgg

SEQ ID NO: 113936 - DNA, 891 bp, Homo sapiens
  misc_feature: GYAE6OF01E2W5J.15.86.H09.1.454.CMB.1.raw
tcagtctacgtagccacgaccggtgctcgatttagtgctatagacttgggtttggggggggagaggagccccagccttgggatcccccaagttgttttcattcagtgatcaggactgaacacagagactccaccagtggagttcgggctggagtcgttcgggtttttccttgctgtcttattaacgttaaaaggtcgtaccgagttggtagaagtgacgtagggttgggtaggtacggttcgggtgggggacgtccggttaagggtaaacggtcccgggttcggggggttaccttaggtcgttcctccgttggtggtcggtccgttcgtggtactttcctacgtttacgtaaggttaacgtggtacgttggtaagttgggtacgggtttcggggcccgaccggtacgggtccgtaccgggtaagggggtacggggtcggttaggggtacgggtttggggttaacgggtaacgtttaaacgaaaaaaggttaaaagtggtaaggtagggtaacggaaaaggtaaaagtacggtaaccggtacggtacgtaccgaccgggtaaggggaaaacgtaacgtactaaccgtacctaagtaccgtaagtaagtaaacgtaacttaaacgtaaacccggtaaaacggttacggttacgttaagtttacgaaacgtaaacgtaacgaaccgttacgaaacccgtaaagaaaccccgggtaacgaacgtaccgtaacggttacccgttacttaacgtaccgtaacgttaccgaagttacgggtacgtacggaagtcgaggaacgttaacgggtaagtaaggtacctaggttacgttacgtttacgttagacgttacgggtcggtaaccgggacggaaacgggttcgtaacggtttccggg

SEQ ID NO: 113937 - DNA, 787 bp, Homo sapiens
  misc_feature: GYAE6OF01A9WSJ.15.86.H09.1.454.CMB.1.raw
  modified_base (715)..(715): a, c, t, g, unknown or other
  misc_feature (715)..(715): n is a, c, g, or t
tcagtctacgtagccacgaccggtgctcgatttagtgctatagacttgggtttggggggagaggagccccagccttgggatccccaagtgttttcattcagtgatcgaggactagaacacagaggacctcaccatggagttcgggctgagcttgggttttcctgctgctatacgttaaaggtgtccagtgtggaagtgcgaggtggtggagtcggaggggacgtccgttaggtaacggccggttcgggggttacccttagacgtcctccgttgtggtcggccttcgtaggtacttcctactttacgaagttaagtggtcgttggtagttggtacgggttccggggtcccgccggtacggtccgtaccgggaagggggaacgggggtccggttagggtagggttggggttaacgggttaacgtttaaacgaaaaaggttaaaagtgtaagtacgggtaagaaagtaaaagtacgtaaccggttacggacgaccgtaaccggtaaaggaaaacggtacgtactacgaaccgtactacgtaacgaagtaaagtaactaacgttaaaccgaaaacggtcggttattaacgttacgaataaagtacgaaactacggtaacctaaacggaaaccgtcgaacctacgtacgtacccttagttaactacgtactaacgagtatacggtaccgaagtcgaacgtacgtaacggaaacggtaagnggtaacgttagttcgttccgttaagaccggttactcggggtaccgggaaccgtagggtaacctcggggttcg

SEQ ID NO: 113938 - DNA, 895 bp, Homo sapiens
  misc_feature: GYAE6OF01CKLXU.15.86.H09.1.454.CMB.1.raw
tcagtctacgtagccacgaccggtgctcgatttagtgctatagactttgggtttgggggggagaggagcccccagccttgggatcccccaagttgttttcattcagtgatcaggactgaacacagagacctcaccatggtagttcgggctggagtcgttcgggtttttccttgtcttcgtacttattaccgttaaaaggtcgtaccgtagttgtggaagtggcgtaggtgggtggagtcggtgggggacgtccgttagggtaacggtccggttcgggggttacccttacgttacttccgtccgttggtcggtcggtcccttaggttacggtacttccttacctttcgtaagtaaggtcgtcggtggtagtggttacggttcggtcccggcgtaccggtcgtaccggaggggacgggggtcgtggggtaggttggggtaacggtacgttaaacgtaaaaaggttaaagtgtaaggtgggtaacggtaaagtaaacgtaacggtacgtacggtacgtaccgtaacccggtaaacggtaaagtaaacgtacgtactaacctacgtaccgtaaacgacgtaagttaacgtaacgtaaaccgtaaacggttacggttatttaacgttacgaattaaacgacgtaaaccgacgtaacccgtaaagaaacccggacgaaccggtaactacccggtacttactaaccggttactaccggtaaccacggtttaacggtagtttaaccgggacgttacgaacccggttaagtaacccggtaaggggtaacgtacggtttaaccgttaccgttttagggtttaccctttaaacggaagggttttccggtacccggggttaaccccggggagtttacccgggtacggttttacccgggtttaccggg

SEQ ID NO: 113939 - DNA, 837 bp, Homo sapiens
  misc_feature: GYAE6OF01A0VAC.15.86.H09.1.454.CMB.1.raw
  modified_base (247)..(247): a, c, t, g, unknown or other
  misc_feature (247)..(247): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcggctgagcttgggttttccttgctgctatacttaaaaggtgtccagtgtgaagtgcgaggtggtggagtcgtggggagccgttggtaaagccgtggggtccttagngtctctgtgtcgcctctggtacttctactttcaggtaatcggctggagtggtaggttcgggtacccgcgacgggtcctaccggaaggggaacggggcgtagggtaggttggggtttacggtaaccgttttaaacgaaaaaggttaaaaagtaggtaagtagggttaacgaaaggtaaaagtacggtaacgttaacggtcgaacccggtaaacccggttaaggaaaagggaacgtaacgttacccgaaccaacttacccgtaaacgaaaagtaacgtaaagttaaaactttaaacccggaaaaaacggtttacgggttttaacgttaagttttaacggaaactaaaaacggttacgaaaccgtaacgaacccgtaaacggaaaaacccggtacgaaaccgaacacgggtaccctactttaacttaccgtaaactacccgtaagaagttaccgggttaacgaaggtcgtaaagacggttaaacgggaaaccgggttaaagggaccgtacgtttagtttacggtacgtttttagacctttaacgggtacccgggtacggggaccccgaaagggtcccgttaacggtttacggg

SEQ ID NO: 113940 - DNA, 815 bp, Homo sapiens
  misc_feature: GYAE6OF01DN6S1.15.86.H09.1.454.CMB.1.raw
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
tcagtctacgtagccacgaccggtgctcgatttagtgctatagacttggggtttgggggggagaggagccccagccttgggatccccaagtgttttcattcagtgatcaggactgaacacagagactcaccatggagttcgggctgagtcttgggttttccttgctgtctaatacgttaaaaggtgtaccagtgtagaagtgcgaggtgggtggagtcggtagggggacgtccgttagggtaacgtccggtcggggggttacccttaggtacgtctccgtggtgtcggtccttcgtggtacttcctactttanagttagtggcgtaggtatggtacggttcggggtcccnccgaggtccgtaccggaaggggggacgggggcgtggggtagggttgggggtttacggtaacgttttaaacgaaaaaggttaaaagtggtaaggtagggtaagaaaaggtaaaagtacggtaacgttacgggtacgaccggaacccggtaaggaaaacgggtaataacttaccaacctataccctaagtaaacgtaagtaatttaaactaacggtaaaaaccggtcgggtttaagttaattacgaaacgtaaagtaacgaaaccgtacgaaccgtaaacgggaaaaccgacggaacccacggtaaccgtaccgttacttaacttaccgtaacgtaaccgtaagtacgttaacggtaacgtacgacgtaccgaagtacccggtaagggtaaaggacgtacgttagttcggtttactttaaggtcttaacgtcggggtacgggaccgtaacgggtacgtggttacggg

SEQ ID NO: 113941 - DNA, 815 bp, Homo sapiens
  misc_feature: GYAE6OF01BBOBU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttggtttccttgctgctatacttaaaggtgtcagtgtgaagtgcgaggtggtggagtcgtgggggactccgttaggtaacgtccggtcgggggttacccttagacgttcgtccgtgtggtcggtcccttcgtggtacttccgtacgttttacgtaaggttaacgtgggtccttgggagttgggtacggtttcgggggtcccgccggaacgggtccgtacccggaaggggggaacgggggtcgttagggtagggttacggggttacggtaaccgttttaacgaaaaaggttaaaacgtggtaagtagggtaagtaaaggtaaaagtacgtacgtacggtccggaccgtaaccggtaaggaaacgacgtactaccgactacgttacgaacggaagacgttaacttaacgttaaacgaaaaccggtcgggttaatttaacgttagaaacccgtaattacggaaaccgtacgtaacccggtaaaggtaaaccccggagaacccgacgtacggtaccctttaactacgttaccgtaacgtaccaacggagttacgttaacggacgtggaaccgtaggtaaccggttaacgggaaagggtccgttacttcggttaaggttccttaaggacttacggtccgggtaacggacccgtaggttacgagggttccgg

SEQ ID NO: 113942 - DNA, 770 bp, Homo sapiens
  misc_feature: GYAE6OF01D3TVP.15.86.H09.1.454.CMB.1.raw
  modified_base (325)..(325): a, c, t, g, unknown or other
  misc_feature (325)..(325): n is a, c, g, or t
  modified_base (518)..(518): a, c, t, g, unknown or other
  misc_feature (518)..(518): n is a, c, g, or t
tcagtctacgtagccacgaccggtgctcgatttagtgctatagacttggggtttggggggggagaggagccccagccttgggatccccaagttgttttcattcagtgatcaggactgaacacagagactcacatggagttcgggctgagtcttgggttttcctgctgtctatacgttaaaggtgtacagtgtagagtgcgtaggtggtggtagtcggtagggggtactacggttagggtaaacggtccgggttacgggggttaccctttaaggtaccgttctccgttggttcggtccggtccttagtggtactttcctactttanaagttagtggtacgtggtagtggtacggttcggcccgtaccgagtaccgtacgggaggggtaacggtcgtggggtagggttgggttacggtaacgtttaaagaaaaacgtaagtggtaagttaggaagtaaagtaataggtacgtacggtacgtaccgaacgtaaggaaagactactaccgaactcgtaacanaaaggtacgttaaactaacgtaaacgtaaacggtagttagtaacgtacgtaataagtaacaacgtaccgtacgtaaacgaaccggacgaactaccggtacgtaccttaacgttaacgttacgtaaccgtaacgtagttaacgttacgtacggtaataccgtaagtaacccgggttaaggaaaccggtaacggttagtaccgtttagttacggttcgtagtcgtacgtcgggtacgacgaggttgtaggttcg

SEQ ID NO: 113943 - DNA, 742 bp, Homo sapiens
  misc_feature: GYAE6OF01BNG4D.15.86.H09.1.454.CMB.1.raw
  modified_base (416)..(416): a, c, t, g, unknown or other
  misc_feature (416)..(416): n is a, c, g, or t
  modified_base (449)..(449): a, c, t, g, unknown or other
  misc_feature (449)..(449): n is a, c, g, or t
tcagtctacgtagccacgaccggtgctcgatttagtgctatagacttgggtttaggggggagaggagccccagccttgggatccccaagtgttttcattcagtgatcaggactgaacacagacggactcaccatggagttcgggctgagtcttgggttttccttgctgcttatacgttaaaaggtgtccagtgtgaagtgacgtagggtggtggacgtcggtgggggataccgttaggtaaacgtcggtcgggggtcccttaggcttctccgtggtgtcggcctacgtggtattcctacgtttcgagttaacgtggtactaggtatgggttacggttcgggaccccgtcgaaggtcgtaccgggaggggaacgggtcgtaggtggggtgggttagtacgtttaagaaaaggtaaangtagtaggacgaaataaacgtcgacgttacggnaccgtaacggtaggaaaggacacttacgactagtctaagaaggataacttaataacgaaacggtacgttaggttaattacgaataaagtacgaaaccgtacgaccgtaaagaaaccggtagaaccacgtacgtacctttaagaacttcgtaacgtaccgtaactagtacggttaagggactacgtaacgtagtaacggtaaccgaaagggtgtaaacccttaggtttacttaccgttagacggttaacccgcgggggttacccgacgggaaacgggtattacggggttcccgg

SEQ ID NO: 113944 - DNA, 938 bp, Homo sapiens
  misc_feature: GYAE6OF01AC758.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacgttaaaggtgtccagtgtgaagtgcgaggtggtggagtcggtgggggacgtccgttaggtaaacggccggtacggggggtacccttaggtacgttccgttccgtgtggtcggtcccttcgtggtactttctaccgttttacaaggttaacgtgggtaccgttagggtagttcgggtaacgggtttccggggaccccgtaccgtaacgggtcccgttacccggaaggggggaaccgggggtcgttaggggtagggttcggggttacgggtaaccgttttaaacggaaaaaaggtttaaaagtcggtaaggttagggtaacgtaaaggtaaaacgtacggtaaccggttacgggtaccggtaacccgtaaacccgggtaaggaaaaacgggtaacgtaacgtttaacccgaaccgtaacgttacccgtaacggaaaaggtaacgttaaacgttaaaccgttaaacgaaaaaccgggtcgggttttacgttaaacgtttacgaaaacccggttaaaagtaccggtaaaccgtaccggttaaccccggtaaacgggtaaaaacccggccgggtaaaccctaccggtaaccggttacccgtttaacgttaacgtttaccgtaaccggttaaccccaaggttaacggtacgttacgggaaacgtcgaaccgtagttaccggaaacgggtaacggtacgttctaaggttacggttatttaccgtaagttacggtacccgggtaccgggaaccgtacgggtactagggttcccggg

SEQ ID NO: 113945 - DNA, 846 bp, Homo sapiens
  misc_feature: GYAE6OF01ADRJ2.15.86.H09.1.454.CMB.1.raw
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggacgtcgttaggtaaagtccggtcgggggtccttagacgtccgtccgtgtggtcggccttcgtggtacttctactttcgaagttaagtggtcgtggagttggtacggttcgggtcccgacgtacggtccgtacccggaagggggaacggggtcgtagggtaggttcggggtttacggtaacgttttaaaacgaaaaagttaaaaacgtaggtagtagggtaagaaaggtaaaacgtacggtaacggtaacggtccgtaccgtaacccggtaaggaaaaggtaacgtaacttaccgaacctaagtacctaacgaaagtaagtaacttaaacttaaaccggaaaacggtcggtttaagttaacgtttacaaagtaaacgtaacgaaccgtaacgtacccgtaaaacgaaacccggacggaaaccacggtaaccgaccgtttaacttaacgttaacccgtacgtaaacccgacggttaaaccggtaacggttaccggtaaacgtcgtaaaccggtaacgtaaccgggtaaaaccggttaaacgggtccgtaaattacggttaccgtttaccgttttagtaaaccggttacgttaccggggaccgggtaaccctagggtaaacgtgggttacccggg

SEQ ID NO: 113946 - DNA, 744 bp, Homo sapiens
  misc_feature: GYAE6OF01AT3IX.15.86.H09.1.454.CMB.1.raw
  modified_base (513)..(513): a, c, t, g, unknown or other
  misc_feature (513)..(513): n is a, c, g, or t
  modified_base (534)..(534): a, c, t, g, unknown or other
  misc_feature (534)..(534): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttcctgctgctatacttaaaggtgtccagtgtagaagtgcgaggtggtggagtcgtgggggagtccgttagggtaaacgccggtcggggggttcccttaggacgttcctccgttggtcggtcggtccttcgtggtacttccgtactttacgaaggtaagtggtcgtaggtagtggtacggttcgggtccgccgtaggccgtaccggagggggaacgggtcgtagggtacggttggggttacggtacgttaacgaaaaagttaaaagtcggtagtgggtaagaaagtaaaagtagtaaccgtacggtacgaccgtaaccgtaaggaaaggtagtaataccgacctatacctagaacgtanaattaacgtaacgtaaacggnggttactaagttacaacaaagtcaaacgtacgaacccgtaaaggaaaccggagacccgtaacgacgtaccgttacttaacgttaccgaacggttaacccagtacggtacttacggaatcgtaaccgacggttacggaaaggtaacgggtacgtacgttcgtagttcttagtactacggttcgacgggaacccgaggtaaccgtgggtacg

SEQ ID NO: 113947 - DNA, 864 bp, Homo sapiens
  misc_feature: GYAE6OF01AX5MZ.15.86.H09.1.454.CMB.1.raw
  modified_base (207)..(207): a, c, t, g, unknown or other
  misc_feature (207)..(207): n is a, c, g, or t
  modified_base (563)..(563): a, c, t, g, unknown or other
  misc_feature (563)..(563): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcggctgagcgtgggttttcctgctgctatacttaaaggtgtccagtgtgaagtgcgaggtggtaggngtcggtggggagtccgttaggaacgtccggtgggggttcccttaggacgttctccgtgtggtcggcctcgtgtactctacttcagtagtgacgtggatggtacggttcgggtcccgacgacggtccgtaccgggaggggacgggtcgtaggggtaggttagggttacggtaacgtttaacgaaaaaggttaaatggtaagtaggtaacgaaagtaaagtacgtaccgtacggtacgaccgaaccgtaagggaaacttagtacttacaaccttactaccgtaacgtaagaacgtaattaaaccggttaaacaaaccgggttgggttaatttacggttacgaaacttaaaacgggtanaaacccgaaggtttaacccggaaaccggaaaacccggaggaaacccgtacgaccggttaacccccggtttaattaaccggtttaaccccgtaagttaaaccccaacgggtaaaccgttaaacggtttacggggtaagaccgttaaccggaaaggtttaaacccggggtaaaaccgggaaacgggttggacccgtttaattagggtttcgttttaaccgggtaagtaccccgggttaaaccgggggtaccccgggaaccccggttttaaggggaaaccccgttttaggggtttaacccgggg

SEQ ID NO: 113948 - DNA, 920 bp, Homo sapiens
  misc_feature: GYAE6OF01D4L4C.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaggtgtaccagtgtgaagtgcgaggtggtggagtcggtggggagtccgttggtaaacgcccggtcgggggtcccttagagtctccgtgtggtcggtcctcgtggtacttctactttacgagttaagtggtcttaggattgggtaggtttcggggtcccgacccgtacggtcccgtaccgggaagggggtaacggggtccgtggggtagggtttggggttacgggttaaccgtttaaacgtaaaaaggtaaaacgtggtaaagttagggtaaggaaaagtaaaagtaacggtaaccgttacgggtacggtaacccgtacccgggtaaaggaaaaagggtaagtaacctttaccgaaccctacttaccgaacgaaagtaaagttaaacttaaaacgttaaaccggtaaaaacggtacgggtttaatttaacggtttaacggaaacgtaaaattaacggaaacgtaaccggtacccgtaaaaccggtaaaaacccgggaccggtaaaccgtaacccgaccggttaacccgttacttaaacgtttacccgtaaccgtaacccgtaaacgtacggttaaccggtttacggaaacggtcccgtaaacgtaaccggttaaccggggtaaaaccgggtaaaaggggtaccgtaaacggtttacgttaggtttacgtttttacggaactttaccgggttccccgggggtaacggggaccccggtaaaggggttaacccgtaggtttacccgggg

SEQ ID NO: 113949 - DNA, 854 bp, Homo sapiens
  misc_feature: GYAE6OF01B0EUX.15.86.H09.1.454.CMB.1.raw
tcagtctacgtagccacgaccggtgctcgatttagtgctatagacttgggttgggggagaggagccccagccttgggatccccaagtgtttcattcagtgatcaggactgaacacagaggactcaccatggagttcggctgagcgtgggttttcctgctgctatacgttaaaaggtcgtaccagtagtgaagtgacgaggtggtggagttcgtgggggactccgttagggtaaacgccggtcgggggtcccttaggacgtcgtccgtggtcgtcggtacctcgtggtacttctaacgtttcaagttaagtcggtctaggtagtaggtaggttccgggaccgtccgacggtccgtaccgggaaggggtaaggggtccgtagggtcggttacgggggttacggtaaacggtttaacgaaaaaacggttaaaatccggtaagtaaggtaaggtaaaagtaaaacggtaggaaccgttacgggaccgtaacccgtaacccggtaaggaaaacggtaccgtacttaccgaaccctaagtaccgtaataaaccggaataacgttaaactaacggaaaacgtccgggttaagttaagtttaccgaaactaaacggtcgtaaaacggaccccgttaaaccggaaacgggaaaaccgtacgggaaaaccctccgtaaaacggtcccccgtttaagttaaccctcgttaaacccggaaccccaagggttaccgtaaccggtttaacggggaacctggtaaccctaagggtaacccggttaaaggtaaaccgggtacggtattaccggttgttaacgttagactttacgccgggttaccggaacgacggtaagttaggtcccggg

SEQ ID NO: 113950 - DNA, 742 bp, Homo sapiens
  misc_feature: GYAE6OF01A8YZH.15.86.H09.1.454.CMB.1.raw
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
tcagtctacgtagccacgaccggtgctcgatttagtgctatagacttgggtttgggggggagaggagccccagccttgggatccccaagtgttttcattcagtgatcaggactagaacacagaggactcaccagtggagttcgggctgagtcgttcgggtttttccttgcttgcttaatacgttaaaaaggtgtaccagtgtagaagtgcgtagggtggtggagtcggtggggggtactccgttaggtaaacgtccggtcgggggttacccttaggtgttcctccgtggtcggtcgtcccgtgttggtacttactacgtttacgagtaagtggtcgtaggatggtacgttcggccgacgacggctacggaggggtagggcgttgggaggttcgggttagtaacgtttaaanaaaagttaaagngtagttaggaagtaaaagtaaagtanaacggtacggtacgacgaccgtaaggaaaagtagtacgtaccaacgattacgaagaaagaataaattaactaaaccgtaaaggtacggttaagttatacggaaataaacgtaagaacgaacgtaaccgaaacggtaaacgaagtaaccgacgtacgtaccttacgtaacgttacaacgactaagtacgtaacgtacgaagtacacggtaatacggtaacgtaaaggagtacgttaagttcgttaagttgtaaacgtcgtacccgggtgggtaaccgagtacgtggttacccgg

SEQ ID NO: 113951 - DNA, 683 bp, Homo sapiens
  misc_feature: GYAE6OF01A9AH6.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttagggtaaagccgtggggggtcccttaggagtctcctgtgtggcctctggatttacttcagtaatggctggatggagttcggccgcaggctccgagggaggggctgggagtgggttggtacgtttacgaaaagtaaaatgagtggtagaagtaaaatagactacggtgaccgaccgtaggaaaggagtactacaccatctagaagagtaataacttaacgaaaacggtcggttagttattacgactaaaagtcgaaactacggtacctaacgggaaaacccgtagggaacctaaccggtacggtcccgtttacttaacgttaccgtacgtaacccagtaagtacgttacgggaagttgaccgtaacgacggtaaacggtaaagggacggtacttaggttagttaccgttttagaacttagtccgggtacgggacccgtaaagggtaccttaggtcgggttcccgg

SEQ ID NO: 113952 - DNA, 934 bp, Homo sapiens
  misc_feature: GYAE6OF01BDHU2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtgtccagtgtgaagtgcgaggtggtggagtcgtgggggagtccgttagggtaaacgccggttcggggggttacccctttaggacgttccgtcccgtggtcggtcggtcccgttcgtgggtactttcctaccgttttcgaaggttaacgtgggtccgttagggtattggtaggtttcgggggtacccgcccgacgggtcccgtacccggggaagggggtaacgggggtccggttaggggtaggggttacggggttttacggtaaaaccggtttttaaacgtaaaaaaaggttaaaagttggaaggttagggttaaggaaacgtaaaagtacggtaacggtacggtacgacccgaacccggtaaggaaaaggtaacgtacgttaccaaccgtacgtaccgtaacgaaacggtaagtaaacgttaaacgttaaaaccggaaaaaccgggtttacgggtttaagtttaaacgtttacgaaacgtaaaaagttacggaaaacccgtaacggtacccgttaaaacgggaaaaacccgtacggtacccaaaccggtcggttaacccctttagttaaccgtttaccgtaccgtaaccgaacgtaggttaacgttaccgggaagtcgaccgtagtaaccggtaaacgggtaaacgggtcgtaaccgttagttcggtttacgtttaacggaaaccgttttcggttacccggggtacccgggggaaccccgtaaaggggtttaaacccgtggggttttaccccgggg

SEQ ID NO: 113953 - DNA, 841 bp, Homo sapiens
  misc_feature: GYAE6OF01E1HWJ.15.86.H09.1.454.CMB.1.raw
  modified_base (368)..(368): a, c, t, g, unknown or other
  misc_feature (368)..(368): n is a, c, g, or t
  modified_base (769)..(769): a, c, t, g, unknown or other
  misc_feature (769)..(769): n is a, c, g, or t
tcagtctacgtagccacgaccggtgctcgatttagtgctatagacttggggtttggggggggagaggacgccccagccgttgggatccccaagttgttttcattcagtgatcaggactgaacacagaggacctcacagtcggagttcgggctgagtcgttcgggttttcctgctgcttataacgttaaagtcgtactagtgtacgtagtgcgtaggttgggtgtacggtggtggggactccggttagggaacggtccgggttacgggggttaccttaggtcgttcctccgtggtacgtcgtcctgtagtactttccgactttacgaaggtaacgtggtcttaggacgttgggtaggttccgggtaccnccggaacggtccttaacgggggaacgggggacggggtacggttacgggtggggttaccggggttacgtaaacggtttaacgaaaaaaggtttaaactggtaagggtttagggtaacgaaaagttaaacgtaggtaccggtaccggacgtaaccccgaagggttaaacgaaaacgggtactttaaccggtaaccaccggttaacctaaacgaagtaaacggagtaaccttaaaacgtaaccggtaaacggttacgtaggttaactaagtaaaccaaacgttaaggaaacctaccggtaaaccgaacggtaaacccgagtaccgaactacgtcgttacttaacgtccttaccgtaacagtacgtaagcggtaacgtgactacggtaacggtaggaacgtacgngtttattacgtatttacggtaacgtacggtacccggggaaccgtaccggaaggtaccgttaggttccccggg

SEQ ID NO: 113954 - DNA, 660 bp, Homo sapiens
  misc_feature: GYAE6OF01A2BBZ.15.86.H09.1.454.CMB.1.raw
  modified_base (213)..(213): a, c, t, g, unknown or other
  misc_feature (213)..(213): n is a, c, g, or t
  modified_base (542)..(542): a, c, t, g, unknown or other
  misc_feature (542)..(542): n is a, c, g, or t
  modified_base (564)..(564): a, c, t, g, unknown or other
  misc_feature (564)..(564): n is a, c, g, or t
  modified_base (585)..(585): a, c, t, g, unknown or other
  misc_feature (585)..(585): n is a, c, g, or t
  modified_base (650)..(650): a, c, t, g, unknown or other
  misc_feature (650)..(650): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccagtggagttcgggctgagtcgttgggttttcctgctgcttattacgttaaaggtctctagtgtagaagtgcgtaggtggtggnggtcggtggggtacgtccgttagggtaacggtccggttcggggttacctagtcgttcttcgtgtgtcggccttgtggtcttctacttcgagttagtgtacgtaggtataggtcggttcggccgcgcggtcgacggaggggtacggtcgttagggtaggttcggttacggtaacgttaaacgaaagttaagtcgtagtaggtaagaaagtaagtaacgacgtacgtcgaccgtaacgaagtaacgactactacactactacagaagtataactaacgtaaccgaaagttgtttagtactaagaataacgtacgacgtacacgaacgaacngtacacgtgaccttagtacttnaacgtcaagtcgtacgtagantaacgagtacggataaaggcccttagtattccgttatagtacgacgtcgggtaccgaagtcggtnttaggtcccg

SEQ ID NO: 113955 - DNA, 765 bp, Homo sapiens
  misc_feature: GYAE6OF01AF5E1.15.86.H09.1.454.CMB.1.raw
  modified_base (148)..(148): a, c, t, g, unknown or other
  misc_feature (148)..(148): n is a, c, g, or t
  modified_base (209)..(209): a, c, t, g, unknown or other
  misc_feature (209)..(209): n is a, c, g, or t
  modified_base (333)..(333): a, c, t, g, unknown or other
  misc_feature (333)..(333): n is a, c, g, or t
tcagtctacgtagccacgaccggtgctcgatttagtgctatagacttgggtttgggggggagaggagccccagccttgggatccccaagtgttttacattcagtgatcaggactgaacacagaggactccaccatggagttcggctgnggcgttgggttttcctgctgctagtacgttaaaggtgtccagtgtgaagtgcgaggttggnggagtcggtggggacgtccgttaggaaaccgtccggtcgggggttaccttaggtctccgtctggtcgtcgtcccgtgtggtattcctacttctagtaagtggcctggatggtagttcgggtccncgcggtccgtcggagggagggtcggtaggcgggttggttaaggtaaccgtttaaagaaaagttaagtagtacgggtaaggataaaaggtaactacggttaacgtacgaccgtaaccgttaacggaagaaaagtacgtaccgttaacacgttacaacgtaacgaagtaaagtaacttaaacggtaaacgtaacgtaggttaacttagtaacgtaaataaggtaacaaccgttaacggaaccgtaaacggaaccgtaacgacgtacccgtacgtacctttactaaccgttaccgtaacccgtaacgaacgttagaacgttacgtaggactaacgtaacgtacggtaaacggtagggacgttaaccgttgtttaagttcccgttaagtaccgttaccggtacggaccgggacgtagtacccggttagggtccccg

SEQ ID NO: 113956 - DNA, 793 bp, Homo sapiens
  misc_feature: GYAE6OF01DJMF6.15.86.H09.1.454.CMB.1.raw
tcagtctacgtagccacgaccggtgctcgatttagtgctatagacttgggtttggggggagaggagccccagccttgggatccccaagtgtttcattcagtgatcaggactgaacacagagactcaccatggagttcggctgagctggttttcctgctgctatacgttaaaaggtgtccgagtgtgaagtcgcgaggtggtggacgtcgtggggactccgttaggaaacgtccggtcgggggtccctaggtacgtcctcctgtgtacggtcctgtgtacttcgtacttacgaagttaatggtcgtggtacttggtaggtttcggtccgccgtaggccgtaccgaagggggtaacgggtcgtagggcggttcggggttacggtaaccgtttaagaaaaaacggttaaaagtacggtaagtacggtaagaaagtaaaacgtagtacgtacggtacgaccgtaaccggtaaggaaacggtaacgtacctaccgacctagtcctaacgaaagtaacgtaacgttaaacgtaacgaaaaaccggtggtttaacgttaagtttaacgaaactaaagttaacggaaactacggtaacctaaggaaaaaccggtcgaaccgtacgtacggacccgttactacgttaactcgtaaacctcgtaacggttgttaacgggtaagtcgtacgaaacgttacggaaacgggtaaacgacgggtttactaaggttcctttaaggttttacaagttaccgggtcggttaaacccggggcccgtaaaagggtaccttcgggttaccggg

SEQ ID NO: 113957 - DNA, 685 bp, Homo sapiens
  misc_feature: GYAE6OF01BI950.15.86.H09.1.454.CMB.1.raw
  modified_base (541)..(541): a, c, t, g, unknown or other
  misc_feature (541)..(541): n is a, c, g, or t
  modified_base (623)..(623): a, c, t, g, unknown or other
  misc_feature (623)..(623): n is a, c, g, or t
tcagtctacgtagccacgaccggtgctcgatttagtgctatagacttgggtttggggggagaggagccccagcccttgggatccccaagtgttttcattcagtgatcaggactgaacacagaggactcaccatggagttcgggctgagcgtgggttttccttgctgctatacgttaaaaggtgtccagtgtgaagtgcaggtggtggagtcgtgggggagccgttggtaaacggccgtgggggtcccttagagtctcctgtgtcggcctcgtggtattcactttcagtaatggtctggagtggtacggttcggggtcccgccgaacggtccgtaccggaagggggaacgggggtcgtgggtaggttggggttacggtacgtttaacgaaaagtaaaatgtagtgggtagaagaaatagtacgtacggtcgaccgtaccgtaggaaaggaagtactacacctactactacgaagagtaataagtaccgaaaaggtcggttagttaattacgaactaaagtcgaactacgactaagaaaccgngacacgtagtcctaactattaccacgtaccgatacgtagttacggatacgacgtgtacggaaaggaggtagtcttaagggtntttacgttacgaattccgggttacgggaccggggaaccctagggtaaccgtaggttcccggg

SEQ ID NO: 113958 - DNA, 863 bp, Homo sapiens
  misc_feature: GYAE6OF01DR80I.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagtcgttcgggtttttccttgctgcttattacgttaaagtgtccagtgtgaagtgcgtaggtggtggaggtcggtggggacgtccgttaagggtaaacggtccggttcgggggttacccttaggacgttccgtccgttggtgtcggtcctgttggtactttctactttacgtaagtaacgtggacgtggtagttaggtcggttcggtcccgacccgtaggtccgtaccgggagggggaacgggtcggtaggtacgggtggggtttacggtaaccgtttaacggaaaaaagttaaagtggtagtagggtagaaacgtaaagtagacgtacggtcaccgtaacgtaaggaaacgtagtacgtacaacctatactaagaaacgtagtaaacgttaacgtaaaccgaaaacgggttcgtttaagtttaagtaacggtaaaactagtaaaccggtaaacgtaccgttaacccgggaaaagaaaacccggagtaccaaacccggtgtttacccccttattaaacgttaacccgttaccgaaacgttaaacgtaccgggtaaatttacgggaacggttcgaacgttaaaccggtaaaccgggtaaacgggtaaacggagtttccccttaagtttttcggggttacttttaaccggtattttacccgggtcccggggtaagggtaaccccccggggttaagaaccggggttttacgttacccgggg

SEQ ID NO: 113959 - DNA, 737 bp, Homo sapiens
  misc_feature: GYAE6OF01B1GTO.15.86.H09.1.454.CMB.1.raw
  modified_base (301)..(301): a, c, t, g, unknown or other
  misc_feature (301)..(301): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcgtgggttttccttgctgctatacttaaaggtgtccagtgtagaagtgcaggtggtggagtcgtggggagccgttggtaaagccggtgggggtcccttagacgtctccgtgtgtcgtcgtctggacttcactttcagtagtggtcgtggatggnggttcgggtcccacgaggccgtccgaaggggagggtcgtgggtaggttgggttaggtacgtttaacgaaaaagttaaaagtcggtaagtggtaagaaaggtaaaatacggtaacggtacggtcgacctaacccgggtaagaaaggacgtactaccaaccgtactacgtacgaaagtagtaacgttaaactaaccgaaaaacgtcgggttaattacgtttacgaaactaaacgtaagaaccctaaggtaccctaaagggtaaacccgaacggtaacaacgtacgtacccgtaattacgtacctacgtaccgaacgttacgtaagttacggtactagacctaggtaaccgtacggaaagggttcgacgttattcggttacgtttagaacgttcggtaccggttcggggaaccgttaacgggtaaacgtcggtttccgg

SEQ ID NO: 113960 - DNA, 824 bp, Homo sapiens
  misc_feature: GYAE6OF01BOGSM.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagcgttgggttttccttgctgctatacttaaaaggtgtccagtgtagaagtgcgtagggtggtggaggtcgtgggggtacgtccgttagggtaaacgtccggttcggggggtacccttaggacgttcctccgtggtgtcggcctgtggtacttcgtacttttcgaagttaagtcggtacgtggaagtggtaaggttcgggtcccgcgacggcctacggaaggggtacggggtcgtagggtacggttggggttacggtaacgtttaacgaaaaaggttaaaagtcggtagtaggtagtaaaaggtaaagtacgtaacgttacggtacgaaccgaaccggtaaagaaacggaatcttaaccgactagtactacgaaagtaacgtaagttaacttaaaccggaaaacggttcggtaacgtttattaacgaagtaaacgtacgaacgtaaccgaaccgtaaacggtaaacccgaggtaaccgaaccgtaacggttacccttaacttaacttacccgtaacgttaacccgaagtaacgtttaaccggttaacggaacgtcggtaacctaacggttacgggtaaaacggtaaacggttggacccgtttagttcggtttaacgtttacgaagttaccgtaccggggaccggggtaaccgaacgggttaccgtaaccggtttcgggg

SEQ ID NO: 113961 - DNA, 899 bp, Homo sapiens
  misc_feature: GYAE6OF01BFTMJ.15.86.H09.1.454.CMB.1.raw
tcagtctacgtagccacgaccggtgctcgatttagtgctatagacttgggtttggggggagaggagccccagccttgggactccccaagtgttttcattcagtgatcgaggactgaacacagagactcaccagtggagttcgggctgagtcgttgggttttccttgctgtacttataacgttaaaaggtcgtacctaggtgtagaagtgcgtagggtggtggtaggtcggtggggcgtccgttaagggtaaacggtccgggttaccgggggttaccttaggtacgttccgtccgttggtcgttcggccttacgtggtactttcctagtttacgaagttaaggtcggtcgttaggtagttagggtacggttccggggtccgaccggtccggtaccggaccggggtaagggggtaacgggtacgttaggggttacgggttaggggtttaacggttaaaccggtttaaaaacgtaaaaaagggttaaaagggtaggttaaggttaacggggtaaaggtaaaaagtaaaacggttaccgtaaaccggggttacgggtaacgtaaccggtaaacccgggtaaaggtaaaacggttaccgtaaccgtttaccaaccgtacgtaaaccgttaagaaaagttaacgttaagtttaaaaaccgtaacggtaaaccggtttagggttaactttaaggttaacaacgtaaaagtaccgtaacgacgtaacgaaacggtaaaccgacgtactaccgtacgtacttaacttacttacgaactaccgacgttagtaacggtactgaacgcggaacgtacggtaagggtaaacgtgttacgttgttaaacgtttcgttaaagggtaccctaggtacccgggacgggtaacgaacgggttagtcggtttcccggg

SEQ ID NO: 113962 - DNA, 895 bp, Homo sapiens
  misc_feature: GYAE6OF01A6K01.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtggggggacgtccgttagggtaaacggtcccggttcgggggggttacccctttaaggacggtttccgtcccgtttgggttggtcgggtccccttcgttagggtactttccgtaccgtttttaccgaaggttaaaagttggggccgttaggggacgttaggggttaaccgggttttccggggggtccccggaccccggtacggggtacccgttacccgggaacgggggggtaaacggggggtccggttagggggtaccgggtttaggggggttttacgggtaaaccgggtttttaaccgaaaaaaaggtttaaaaagttgggtaagttaggggtaagaaacggtaaaaagtaacggtaaccgttaacgggtacgacccggtaacccgggtaaagggaaaaaggtaacgtaacgttaccgaaccctagttacctaacgtaaaggaacgtaaactttaaacgtaaacccggtaaaacgttcgggtttaagttaacgtttacggaaacttaaaacgtacgaaacgaccgtacgtaaccggaaacgaccgtaacacgacgtaccgtatacttacgacgtacagtacgtacttaggacgtacgcgtaagtacggtaaacgtaagggcgtaccgttagttcgttacgtttagacttcgtacgggcccgggacccagggtacctaggtccgg

SEQ ID NO: 113963 - DNA, 1013 bp, Homo sapiens
  misc_feature: GYAE6OF01BIURF.15.86.H09.1.454.CMB.1.raw
  modified_base (186)..(186): a, c, t, g, unknown or other
  misc_feature (186)..(186): n is a, c, g, or t
  modified_base (207)..(207): a, c, t, g, unknown or other
  misc_feature (207)..(207): n is a, c, g, or t
tcagtctacgtagccacgaccggtgctcgatttagtgctatagacttgggtttggggtccactgggcagtctcggaatagagctcttggaagtccctccaaccatggcctgggtctccttctacctactgcccttcattttctccacaggtctctgtgctctgcctgtgctgactcagcccccgtntgcatctgccttgctgggacncctcgatcaagcctccacctgacctacctaagtagtgaagtcgaactcgaacctacaccatacgaatggtatacaacgagacgaccgtaacgggaacctaccccccgaagttaactaagttaagtaggaaaacggtttaaaggacgttaggaacgttacgggacctaagaccccgaaacgtaacccgggtaaacggggggaaccggggtaaccgttaaccccccggtagttacccggaccgttttaccgaacggttacgggggtaccccttacccggttaacgtttcccgggttaacggggtccccgtttccgggaacccggtacccgtttaaacccccgtacccgtaaaacccccgttaaccgttaccccgttaaaccccccccggtttaaaacccccgtcccccgtttaaacggggtttaccccgttaaaccgggtaaaccccgggtttaaacgttaaccggggttaacgggttacccgttaaccggtaaacggtttaaccgttaacccgttaacccggggttagggttaaccggggttaaaccgggaaccgggtaacccgggtaaccctaaaacccggttaaaccggtaaacggttttaacccgggtaaacggttacccggggttaaaaccgtaaaaccggggttttaaccgggggtttaccgggggtttaaccgggggtttaacccggggggtaccgggggtaaacccgggggtaaccccggtaaacggggtaacccggtttaccgggaaaccccgggttttaccccggttaaacccgggggtacccttaaaaccccggggg

SEQ ID NO: 113964 - DNA, 837 bp, Homo sapiens
  misc_feature: GYAE6OF01DSJG2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccagtggacgttcgggactggagtcgttgggttttcctgctagtctattacgttaaaaggtcgtaccgtagtgtagaagtgacgagggtgggtggaggtcggtgggggacgtccggttacgggtaaacggtccgggttcggggggttaccccgttaagcgttccgttccgtggtcggtcggtaccgtcgttaggtactttctacgtttcgtaagtagtggtcgtaggtacgtggtaggttcggggtacccgcgtacggcccgtacgggaagggggaacgggtcgtagggggtacggttgggttacgggttaacgtttaaaaaccggtaaaaaagttaaaacggtggtaaaggttgggtaaaacggtaaacgttaaaagtaacggtacggttaaccggtacggacccgttaaacggtaaggaaacgaacgttaccgtacaaccgtaactaccgttaagaaaggtaacgtaattaaaccgtaaacgtaaaaacggttcgttaaacgtagtttaaacgaaattaacgtaacgtaaccgaaccgttaacgaaacgaaaccggtagacgaaccgtacgacgttaactctaaccgtagtacccgacgaagttaccgtagggaactacggaccagggtaacctaagggtaacgtccgtataaggttcttagttagtacgtagtaccgggcgaacgggaacgtgttaagtcccggg

SEQ ID NO: 113965 - DNA, 734 bp, Homo sapiens
  misc_feature: GYAE6OF01DJILY.15.86.H09.1.454.CMB.1.raw
  modified_base (639)..(639): a, c, t, g, unknown or other
  misc_feature (639)..(639): n is a, c, g, or t
  modified_base (682)..(682): a, c, t, g, unknown or other
  misc_feature (682)..(682): n is a, c, g, or t
  modified_base (701)..(701): a, c, t, g, unknown or other
  misc_feature (701)..(701): n is a, c, g, or t
  modified_base (719)..(719): a, c, t, g, unknown or other
  misc_feature (719)..(719): n is a, c, g, or t
tcagtctacgtagccacgaccggtgctcgatttagtgctatagacttggggtttgggggagaggacgccccagccttgggatccccaagtgttttcattcagtgatcgaggactgaacacagagactcaccagtggagttcggctgagtcgttggtttcctgctgtactagttacgttaaggtctacgagtgtagagtgcgaggtggtggagtcggtggggcgtcgttaggtaacgtccgggtcggggttccctaggtcgtccttgtggtcggtcgtcctcgtgtacttctacgttatagttaggtggtagtaggttagtaggttcggtccggtcccgaccgtacggaccgtacgggaggggacggtcggtagggtggttacgggtttaggtaaccgttaaagaaaaagttaaggtgtacggtaggtaaacgaaagtaacgacggtacctacggacgaccgtaacggaagaaacgtactactaccgatcgtaacgacaaggtactaagttaactaaacggtaaaccggtgtttaagtttaccgtaagaacgtaaacgtacgaacgtaaccgttaaccggaaacggtaaaccgacgaacctacgtacgtaacccgttataacgttacgtccctaaacggntaaacggtcgtagtaacgcgtaaacgtcgtaaacgtaacgggngtactgttgtacgtgttancgttacggtggacggacncgggtactgttccgg

SEQ ID NO: 113966 - DNA, 904 bp, Homo sapiens
  misc_feature: GYAE6OF01DS283.15.86.H09.1.454.CMB.1.raw
  modified_base (857)..(857): a, c, t, g, unknown or other
  misc_feature (857)..(857): n is a, c, g, or t
tcagtctacgtagccacgaccggtgctcgatttagtgctatagacttgggtttggggggagaggagccccagccttgggactccccaagtgttttcattcagtgatcaggactgaacacagagactcaccagtggagttcgggctgagtcgttcgggtttttcctgctgtctattacgttaaaaggtcgtccagtgtgaagtgcgaggtggtggagtcggtggggacgtccgttaggtaacggtccggttcgggggtacccttaggtacgttccgtcgtggtcggtcggtcccttcgtagggtactttcgttaacgttttacgtaaggttaacgtcgggtcgtagggtagttagggtacgggtttccgggtcccgacggtacggtacccgtacgggaagggggtaacggggtcggttaggggtagggtttacgggggtttaacggttaaccgttttaaaacgaaaaaaggttaaaagttggtaacggttaagggtaagtaaaagtaaaaacgtacggtaaccggttaacgggtaccgtaaaccgtaaaccggtaaaggtaaaaacgggtaaacgtaaccgttaaccaacgtaaccttacgtaacgaaaggtaaacgttaaacgtttaaaacgtaaaaccggttaaaaccgggttaggggttttaatttaaacgtttacgggaaaaaccttaaaacgtaaccgggtaaaccgtaacggttaaaccccgtaaaaacgggaaaacccgtaacggaaccctaaccggtacttacccgttaattacgtaacgtacccgtaaccaggttacgtaacgtacggatcaacgtagaaacgaggtaaaggtctacgttattacgttnttaagacgtttacgggtacgggccgaaaggtacggaacgtggttcgg

SEQ ID NO: 113967 - DNA, 714 bp, Homo sapiens
  misc_feature: GYAE6OF01BNVLT.15.86.H09.1.454.CMB.1.raw
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (663)..(663): a, c, t, g, unknown or other
  misc_feature (663)..(663): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctggagcgttgggtttttccttgctgctatacgttaaaaggtgtccagtgtagaagtgcgaggtgggtggaggttcgtggggggacgtccgtttagggtaaacggtcccgggttcggggggttccccttaggtacgttccgtccgttggtcggtcggcccttcgtggtactttctaccttttcaaggttaagtcggtcgtaggtagtggtaggtttcggggtcccgccgaggtcctaccggaggggacggggcgtgggtagggttgggttggtacgtttaacaaaaggtaaaatgagtggtagaaagaaatagacgtacggcgacgacggaagaaagagtactcactanctanaagtaagtaactaataacgaaaacggtacggttaagtatttagaactaaagtacgaacgacgaaccgaaacgaacggaacgacaccgtacgctactactaactctaacagtacgtagtacgaagcgaacgtacgacggaaacggtaaggtagtaccgtattacggtttntttaggtaacgttacgtacgggtacggaccccggtagtaccgtagggttcg

SEQ ID NO: 113968 - DNA, 752 bp, Homo sapiens
  misc_feature: GYAE6OF01CSURE.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcggctgagcgtggttttcctgctgctatacgttaaaggtcgtcagtgtgaagtgcgaggtggtggagtcggtggggacgtccgttagggtaaacgccggttgggggttcccttaggacgttcctccgtgtggtcggtccttcgtaggctttctactttacgagttaagtggcgttggagtggtacggtttcggcccgaccgacggccttaccgggagggggaacgggtacgtgggtagggttacgggtttacggtaaaccgttttaaacgaaaaaaaggttaaaagttggtaagttagggtaagaaaagtaaaagagtaaccgtacggtacgaccgaacccgggtaagaaaacggtagtaactacgaacctatacgaacgaaagtaagaacttaacgtaaacgaaaacggtgttagttattaagaacgtaaataggaaacacgtaccgaaacgaaaccggacgacgtacgaccgtccttaacttattaacccgtataacccagtaacgtagttacgaacgtcaagtacgaaccggaaaggttaacgacgtacgtttagttagttcgtttagacgttacggtcggtacccgggaccggtaagtacggtcgttcggg

SEQ ID NO: 113969 - DNA, 771 bp, Homo sapiens
  misc_feature: GYAE6OF01BFXIC.15.86.H09.1.454.CMB.1.raw
  modified_base (612)..(612): a, c, t, g, unknown or other
  misc_feature (612)..(612): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagtcgttgggttttccttgctgtctattacttaaaaggtcgtcctagtgtagtaagtgcgtagggtggtggacggttcggtgggggtacgtccgttaagggtaacggtcccgggttcgggggttcccttaaggtcgttccttcgtggtcggtccggtccttgtggttacttctacgttacgtagttaagtggtcgtaggtatggttaggttccgggcccgaccgacggtccgtacgggaggggagggcggtagggtgggttgggtacggtaacgttaaagtaaaagtaagtgtagtaggaagtaaagtaaagtacgtacgtacggtacgaccgtaacggtaagaaacggtactacgtacctacgtactacaacgaagtaacgtaattaacgttaaccgaaacggttcgttaagttaatacgtaacaagtacaacgtaacgaccgtaaacggaacgacaaccgtancgtaccgtattaacgttccgaacttaccaagtacgttaacggtacgtacgacggtactaaggtaacccggtaaaggtaaccggttacgtgtaccgtttgttttaacgagttccgtaacggtccgggtaccggtaccaggtaacccgttgggttacccgg

SEQ ID NO: 113970 - DNA, 1013 bp, Homo sapiens
  misc_feature: GYAE6OF01EA81K.15.86.H09.1.454.CMB.1.raw
  modified_base (803)..(803): a, c, t, g, unknown or other
  misc_feature (803)..(803): n is a, c, g, or t
  modified_base (842)..(842): a, c, t, g, unknown or other
  misc_feature (842)..(842): n is a, c, g, or t
tcagtctacgtagccacgaccggtgctcgatttagtgctatagacttgggtttgggggggagaggacgccccagccttgggactccccaagttgttttcattcagtgatcgaggactagaacacgagaggtactacaccagtggtacgttcgggctgacgtcgtttcgggttttcctgccgttgtacttaacgtaacgtttaaaaggtcttaccggggggtaattggttaaggtaagtcggtacgtaaggggttgggtagggtacggttcggggtacgggggtacgttaccggtttaacgggtaaaccgggttcccgggggttacccgggggtttacccgttaaggttaccggtttcccgttcgttagggtttccggtcccggtaccgtttcggttacggtttaacctttcccgttaaccttttacggttaaaggttaacggttccgggtagtttacgggtaggttaggtttaccgggttcccggggacccgtaccccggtaacggtaccccgggttaacgggggaaacgggggtacggggttaccgggttgggggttaacggggtttacggggtttaaccgggttaaaccgtttaaaaaggaaaacggttaaagttgggtaacgttaggtaaagaaacgttaaagtcggtaaccgtacggtacaaccggaacggttaaggaagttacaactaccgtacgactacgaacgaacgtataacttaaacgtaaccggtaagttacggttattaacgtaacgtaagtaacgtacgtaaacgaccgttaacggaaaccggaaaccggngaaccgtacgaccgttacctacgttaaccgtaccgtaanaacccgtagttaacggacgttaggaccgtaacggtacgtaacggtaacgggtaaaccgttaggggtaccttacggtttacgtacggtttaacggttacccttagggaaacccgggtttccgggaaccccgggttaacccgggtaagggttaacgttcggtttaaccccggg

SEQ ID NO: 113971 - DNA, 822 bp, Homo sapiens
  misc_feature: GYAE6OF01B3UYT.15.86.H09.1.454.CMB.1.raw
  modified_base (773)..(773): a, c, t, g, unknown or other
  misc_feature (773)..(773): n is a, c, g, or t
tcagtctacgtagccacgaccggtgctcgatttagtgctatagactttggggtttggggggggagaggagccccagccttgggatccccaagttgttttcattcagtgatcgaggactgaacacagaggactcaccagtggagttcggctgagtcgttggttttccttgctgtctagttacgttaaaggtcgtacctagtgtagagtgcgtagggtgggtggaggtcggtaggggtacgtccggttagggtaaccggtccgggttcgggggttcccttagcgttcctccgtgtgtccggtctgtggtcttctactttacgaagttaggtggtacgtggagttggtacggttcgggcccgcggtacggcccggtacggagggggtacggtcggtagggtacggggttggggttacggtaacgtttaaaacgaaaaaggtttaaagtcggtaaggttaggtaagtaaaaggtaaacgtaacggacggtacggtacgaaccccggtaacggggtaaggaaaacggtaacgttcgtaaccaccggtaacttacgtaacggaaaacgtaactaactttaaaacgtaacggtaaaacggtagtttacgttaacgttagaacctaaagtaccgaactaccggaaccgttaaacggaaaccgtaaccgtaaccgtaccgtacggttaccgttaaccttaagtacccgttaaccgtacgaacgttaagttaaccggtagtaagaccaacgtaagtacgggaaagtacgggtactgtttacgngtttagacgtgtaccgtaggtccgggaacgtacgtaacggtgtaccggg

SEQ ID NO: 113972 - DNA, 871 bp, Homo sapiens
  misc_feature: GYAE6OF01EP04P.15.86.H09.1.454.CMB.1.raw
  modified_base (799)..(799): a, c, t, g, unknown or other
  misc_feature (799)..(799): n is a, c, g, or t
tcagtctacgtagccacgaccggtgctcgatttagtgctatagacttgggtttgggggggagaggagccccagccttgggatccccaagtgtttcagttcagtgatcaggactgaacacagaggacctacaccatggagttcgggctaggagcgttggttttccttgctgcttaatacttaaaggtgtaccagtgtagaagtgcgtagggtcggtggacggtcgtacggggggtacgtccggttagggtaaaccggtcccggttcggggggttaccccgtttaggacgttccgtcccgttggttcggttccggtcccttagttcgggtactttaccgtaccgtttcgaagttaagtggtagtagggtatacggtaggtttcgggtcccgaccgtacggccgtaccggaagggggtaagggtcgtagggtaggtacgggggttagtaaccgtttaacgtaaaaggtaaagtgagtaggtagaaaccgtaaagtacgacgttacggcgtaccgaaccggtaagtaaaggacgtaacgttacacctatacctagaaagtataagttactaaacggaaaccggtaggtacgttaacttagaacgtaagtactaacgacgtaaccggtaacggaaacgtgaaccgccgtaacgtccgttaacgtttaacccgtaacgttacgttaaccccgaagttacgggttaaccgtttaacggggacgttaaccgagtaaacccggtaacgggtaaaccggtaaaacggggtccgttaaccccgttaattaacggttttccgggtttaaanccggttttaaccggttacggggtacccgggtaacccccggaaaggggtttacctaaggggttttccccccgg

SEQ ID NO: 113973 - DNA, 839 bp, Homo sapiens
  misc_feature: GYAE6OF01DAWQ6.15.86.H09.1.454.CMB.1.raw
  modified_base (144)..(144): a, c, t, g, unknown or other
  misc_feature (144)..(144): n is a, c, g, or t
  modified_base (506)..(506): a, c, t, g, unknown or other
  misc_feature (506)..(506): n is a, c, g, or t
  modified_base (763)..(763): a, c, t, g, unknown or other
  misc_feature (763)..(763): n is a, c, g, or t
  modified_base (774)..(774): a, c, t, g, unknown or other
  misc_feature (774)..(774): n is a, c, g, or t
tcagtctacgtagccacgaccggtgctcgatttagtgctatagacttggggtttgggggggagaggacgccccagccttgggactccccaagttgttttcattcagtgatcaggactagaacacagacggactcaccagtgggngttcgggctaggacggtcgtttcgggtttttcctgacttgtcttaacttacgtttaaaggtcgtacgtagtggtagaggtggcggtagggttgggtaggtacggtcgggtcgggggtacgtaccggtttaggggaaaccggtcccggggttaccgggggttaccttaggtacgttcgttccgtggtcggtaccgtcgttcgtgttactttcctacgtttacgtaagttacgtggtacgtgggtaacgtggttacgggttccggacccgaccgttcgggtaccgtacgggagggggtaggtcgttacggggtaggtcgggttaacgtaacgttaaggtaaaataagtggtagtacgggtaaanaaacgtaagtacggaccgttacggacacccggttaaggaaggaaacgaacgttacctcaacgtacgtacaacgaagttaagtaacttaaccgtaacggaacgtttacgaagtttaacgtacgaaacgttaaggaacgtaaccggtcaaaccgggtaacaaccgggtactacaccggtttaacgtcttaacctttaacgtccgtaacgaccgttaggactagggttacaggtacagggttaaccaggggtaagacggngttagtttacncggttttattaaggcccgttacggggtcccggtaaagggacccgtaggttccgttaacggtcggg

SEQ ID NO: 113974 - DNA, 967 bp, Homo sapiens
  misc_feature: GYAE6OF01BZE8U.15.86.H09.1.454.CMB.1.raw
tcagtctacgtagccacgaccggtgctcgatttagtgctatagacttgggtttggggggggagaggagccccagccttgggatccccaagttgttttcattcagtgatcaggactgaacacagagactcaccatggagttcgggctgagtcgttgggttttcctgctgtctatacgttaaaggtgtcgagtgtagtagtgacgtagggtggtaggaggttcggtcgggggatccggtttaagggtaaacggtccggttacgggggttaccttaaggtacgttctccgttggtacggttcggtccgttcgttaggtactttcgtactttacgaagtaacgttggtacgttaggagttagggttacggtttcggggacccgtaccggtacggtaccggtaccggaggggggaacggttggtaacggggtaggggtttacgggttacggtaaaccgtttaaaacgtaaaaaggttaaaaagtggttaacggtaagggtaacggtaaaaagttaaaaacgtacggtaaaccggttacggtaccgtaaccgtaaacccgggtaaaggaaaacggtaacgtaacctaaccgaacttacgtaaccgttaacaaaggtaaacgtttaaactaaaaccgtttaaaacgggaaaaccggtttacgggttaagtttaaacggtttacggtaaaaccgttaaaaacgtcgaaaaccggtaaaccgtaaccggtaaaacggtaaaaaccgggacgaaacccgttaaccgaaccggtacccggtttaaatttaacccggttacttaaacccgggaaccttaaaggtacggttaacgtttaacgggaagttcgtaaaccgtacgggttaaaacggtaaccgggaaacggtagttcccgtaagtttcgttaacggtttagtaaaccgttacggttaccgggtaacgggaaccccgaaggttaacccggttaggttacccgggg

SEQ ID NO: 113975 - DNA, 693 bp, Homo sapiens
  misc_feature: GYAE6OF01AR0JM.15.86.H09.1.454.CMB.1.raw
  modified_base (201)..(201): a, c, t, g, unknown or other
  misc_feature (201)..(201): n is a, c, g, or t
tcagtctacgtagccacgaccggtgctcgattttagtgctatagactttgggtttggggggggagaggagcccccagccttgggatcccccaagtgtttttcattcagtgatcaggactgaacacagaggactcaccatggagttcgggctgagctgggtttttcctgctgctatcttaaaaggtgtccagtgtgagtgcnggtggtggagtcgtgggggagccgttggtaaagccgtgggggtcccttagagtctcgtgtgtgcctcgtggtattctacttttaagtaatggctggatggtaggttcgggtccgccgaggcctccggaggggaaggggcgtgggaggttggggttaggtacggtttacaaaaaggtaaaatggaagtgggtagaagaaaataagactacggtgaccgaaccggtaggaaaggacgtattaccacatactacaaagagaattaataacgaaaacgtacggtagttaagtttagaactaaagtagaaactaacgacccgtaaggaaacccggaggaacgtacacggtacccgtattaacgttacttcgtaaaccactaagtaagttaccggaagtcgacgtagtaccggtaacggaaacgggtaggtacttagttacggttcgtttagtacgttgtaccggtacggggacccaagggacgaggttgggtacccg

SEQ ID NO: 113976 - DNA, 764 bp, Homo sapiens
  misc_feature: GYAE6OF01A78O7.15.86.H09.1.454.CMB.1.raw
  modified_base (616)..(616): a, c, t, g, unknown or other
  misc_feature (616)..(616): n is a, c, g, or t
  modified_base (626)..(626): a, c, t, g, unknown or other
  misc_feature (626)..(626): n is a, c, g, or t
  modified_base (652)..(652): a, c, t, g, unknown or other
  misc_feature (652)..(652): n is a, c, g, or t
  modified_base (754)..(754): a, c, t, g, unknown or other
  misc_feature (754)..(754): n is a, c, g, or t
tcagtctacgtagccacgaccggtgctcgatttagtgctatagacttgggtttgggggggagaggagccccagcctttgggatccccaagtgttttcattcagtgatcaggactgaacacagaggactcaccatggagttcggctgagctgggtttttcctgcctgcttatacgttaaaaggtcgtacctagtgtgaagtgcgaggtcggtggacgtcgtgggggactccttagggtaacgtccgtggggggtcccttaggtactctccgtgtggtcggccctcgtggtactttccgtacttttcgagttaagtcggtcgttagggtagttaggtacggtttccgggggtcccgtacccgacggggtccttacccggaaggggggaacgggggtccgtaagggggtgggttacggggtttacgggtaaccggtttttaaacgaaaaaaggtttaaaatagggtaaagtgggtaagtaaaacggaaaagttacggaaccgttacgggtacgtacccgaacccggttaaggaaaacggaacgttaacttaccgaacccgtataccgtaagaaccggtagtaacttaaattacgaaaacgttcggttatactttacganaagtcgaacnccgtacgaacgaaacgaggaccagcncccgtattatccgatccagtaggcttaggactagacacgtagaaacgtaggagtccttaggtacttcgttaaatcgtagttccgggacggacccttaagggntttcggtccg

SEQ ID NO: 113977 - DNA, 723 bp, Homo sapiens
  misc_feature: GYAE6OF01C3Q4H.15.86.H09.1.454.CMB.1.raw
  modified_base (206)..(206): a, c, t, g, unknown or other
  misc_feature (206)..(206): n is a, c, g, or t
  modified_base (320)..(320): a, c, t, g, unknown or other
  misc_feature (320)..(320): n is a, c, g, or t
  modified_base (425)..(425): a, c, t, g, unknown or other
  misc_feature (425)..(425): n is a, c, g, or t
  modified_base (465)..(465): a, c, t, g, unknown or other
  misc_feature (465)..(465): n is a, c, g, or t
tcagtctacgtagccacgaccggtgctcgatttagtgctatagacttgggtttgggggggagaggagccccagccttgggatctccaagtgttttcattcagtgatcaggactgaacacagaggactcaccatgagttcggctgagctggttttcctgctgctatcttaaaaggtgtccagtgtgaagtgcaggtggtggagtcgngggggagccgttaggtaaacgccggtcggggggtcccttaggacgttcgtccgtggtggtcggtacctgtcggtattcacttttcagtaatggctggtgtggaggttcggtccncgtacggcctacggaaggggaacgggcgtgggtacggtgggtaggtaccgtttaagaaaaaggttaaaaagtgaaggtggtagaagtaaaatacgacgttacggngaccgaaccggtaagaaaaggatatacgaccagtccgtanaaagtaagaacttaaagtaaccgtaaaaacggtcggttagttaacgtttaagaactaaaagttacgaacgagacccgtaacgaaaaccggacgaaccgtacaacggtaccgttaacttaacttaaccgacgttaaccctaagtagttaacgttccggaagtacgtacaagtaccggtaacggtaaagggtcggtaattacgtcggttacgtttagaacgttacgtaccggttacggggaaccgtcggaagttaacggg

SEQ ID NO: 113978 - DNA, 784 bp, Homo sapiens
  misc_feature: GYAE6OF01C8ARW.15.86.H09.1.454.CMB.1.raw
  modified_base (307)..(307): a, c, t, g, unknown or other
  misc_feature (307)..(307): n is a, c, g, or t
  modified_base (558)..(558): a, c, t, g, unknown or other
  misc_feature (558)..(558): n is a, c, g, or t
tcagtctacgtagccacgaccggtgctcgatttagtgctatagacttgggtttgggggggagaggagcccagccttgggatccccaagtgttttcattcagtgatcaggactgaacacagaggactcaccatggagttcgggctgagtcgttgggttttccttgctgctatacttaaaaggtcgtaccagtgtagagtgcgaggtggtggagtcggtggggagtccgttaggtaaacgtccggttgggggtacccttaggacgttctccgttggtcgtcggcccttacggtggtacttctacctttnaagttagtggctaggagtggtaggttcggtccgccgtaggccgtacggaaggggggtaacggggtcgtaggggtacgggttggggtttagtaaccggtttaaacgtaaaaaagtaaatggtaacgtaggtagaaaaggtaaatacgtacgtacggtacgacgtaaccgaggtaaaggtaaagtctaacaccgtatcgaacgtaagaacggtaaattaacgttaaacaaaaccggggttcgttaacggtttnttaaacgaataaacgtcggaaaacacggtaccgtaacggaaaacggacgaacgtaccgcgggtaacccttatttaacttaaccgttggaaccctaagggtataccgggttacggaagttcgaccggtaacgtaaggtaaccggggtaagtcgtacgtttaggtacgtttcttaggtaacgttacggtaccggacccgggagtaaacgggtcgttaaaggttccggg

SEQ ID NO: 113979 - DNA, 1018 bp, Homo sapiens
  misc_feature: GYAE6OF01A4D9L.15.86.H09.1.454.CMB.1.raw
tcagtctacgtagccacgaccggtgctcgatttagtgctatagacttggggtttgggggggagaggagccccagccttgggatctccaagtgttttcattcagtgatcaggactgaacacagaggactcaccatggagttcgggctgagcttgggttttccttgctgctatcgttaaaaggtgtccagtgtgaagtgcgaggtggtggagtcggtgggggacgtccgttagggtaaaacggtccgtcgggggggttaccccttaggtagttcctcccgttggtggtcgggtccttcgtagggtactttcgtaccttttcaagttaagtgggtccgtgggtactagggtacggtttcggggtacccggccgagggtccgtacccggaaggggggaacgggggtaccgtgggtacgggttagggggtttacgggttaaccggttttaacgaaaaaacggttaaaaaagttcggtaaggttagggttagggaaaaggtaaaaaacgttaacggaaaccgtttaaccggggtacggtaccccgtaaaccccgggttaaggggtaaaaacgggttaaaacggtaacgtttaacccgaaacccgttacttaacccggtaacgtaaaaggtaacggtaaagtttaaaaccgttaaacccggaaaaaaaccggttacggggttttaagtttaacgttttacgggaaaccgtaaaaaacgtaaccggtaaaccccgtaaacgggttaaccccgtaaaagggtaaaaaccccggtaacgggtaacccgaaaccgtacggtaacccccggtttaagttaaccgtttaccgtttaacggtaaccctaacgaccggttaacggtttaaccgggtaaggtaccggttaccgtaaacggtttaaccggaaaaccggggtaaaaagggtccggtaactttagggtttacccggttaagtttttaccgggtaattaaccggggtttacccggttaccggggggaaccccgtaaaggggttaaccgttaaccgggg

SEQ ID NO: 113980 - DNA, 838 bp, Homo sapiens
  misc_feature: GYAE6OF01BPZLM.15.86.H09.1.454.CMB.1.raw
  modified_base (194)..(194): a, c, t, g, unknown or other
  misc_feature (194)..(194): n is a, c, g, or t
  modified_base (750)..(750): a, c, t, g, unknown or other
  misc_feature (750)..(750): n is a, c, g, or t
  modified_base (789)..(789): a, c, t, g, unknown or other
  misc_feature (789)..(789): n is a, c, g, or t
tcagtctacgtagccacgaccggtgctcgatttagtgctatagacttgggtttgggggggagaggagccccagccttgggatcccccaagtgttttcattcagtgatcaggactgaacacagaggactcaccatggagttcggctgagcttgggttttcctgctgctatacttaaaggtgtcagtgtgaagtgngtaggtggtcggagtcggtggggacgtccgttaggaacgtcggtcgggggtaccttagacgtctcctggtgtcggtcctcgtagtacttctacttttacgagttaagtggtacgtaggagtttggtaacggtttccggggccctccgacgggttcccgttccggggaaacgggggaagggggtcgtagggggttacggtttgggggtttaacggttaaaccgttttaaacggaaaaaaaggtttaaaaacggttggaaggtttacggggtaagaaaaggttaaaaacggtacggtaaccgttaacgggtaccgtaacccggtaaccggtaaaggaaaaacgggtaagttaccttaacggtaacccctaaagttacccgtaaacgaaaggttaactaaaagttaaaccggttaaaccgtaaaacggggtaacggtttaggtaacttttagaaacgtaaagtaaccgtaaacgtaccgaaccgttaaaccggaaacgaacgtaccgaacgtacgtctaacgtactttacgactacctaagtacgtacggttacgtaancgagtaccgacgtaaaggaaccgtgacgttatacggttntttaacgaatttccggccggttagggaccctaggtaacgtacggttcgg

SEQ ID NO: 113981 - DNA, 740 bp, Homo sapiens
  misc_feature: GYAE6OF01AYE2G.15.86.H09.1.454.CMB.1.raw
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (477)..(477): a, c, t, g, unknown or other
  misc_feature (477)..(477): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtcgtgggggagccgtttgggtaaagccgtggggggtcccttaggngtctcctgtgtggcctntggattcactttcagttaatggctggatggtaggttcgggtccgccgaggcctccgagggggaagggggtcgtgggtaggtgggttagggtacgttttaacgaaaaaggtaaaagtggtaagtagggtaggaaagtaaaagtacgacgtacggtcggaccgaacccggtaaggaaacgggtaacgtacttaccgaacctatcccgtaanaacgaagtaataaacgttacgaaaaacgtcggttagtaagtttagtaacgaaacttagaacgtaacgaccgtaacgaaaaccggaacggaaccgaacaacgtccgtacttaacgttacgttacgtacctaacgtaagtagtttaacggacggtacgactacgtacggtaaaccggtaaaggggtaacgacggttaattcggttctttaacgtacgttacgttaccgggtccgggtacgggaaccgggtagtaacgggttcggg

SEQ ID NO: 113982 - DNA, 670 bp, Homo sapiens
  misc_feature: GYAE6OF01A7CFQ.15.86.H09.1.454.CMB.1.raw
  modified_base (629)..(629): a, c, t, g, unknown or other
  misc_feature (629)..(629): n is a, c, g, or t
  modified_base (663)..(663): a, c, t, g, unknown or other
  misc_feature (663)..(663): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcgtggttttccttgctgctatacttaaaaggtgtccagtgtgaagtgcaggtggtggagtcgtggggagtccgttggtaaagccgtgggggtcccttaggagtctcctgtgtggcctagtcggattctacttttcagtaatggtctggatggagttcggggtcccgccgaggctccggaggggaaggggccgtgggtaggtggggttaggacgtttaacgaaaaagtaaaaagtggtaagtgggtagaaagtaaaagtcggtaacgttaacggcgtaccgaacccggtaaggaaaacggtaagtactaccaactacgtctaacgaaagaagtaataacgttaacgaaaacgtacgggttatttaagtttagaacaaattacgaaacaacgtaccgtaaacgaaaaccgaggtaacacgtaggcccttaagtattactacgtaaccacgtagtacgttacgatgactagacgtaaagtaaggngtatagtatcttagatgtccgtcgggacctaggntaggtcg

SEQ ID NO: 113983 - DNA, 987 bp, Homo sapiens
  misc_feature: GYAE6OF01BR3FY.15.86.H09.1.454.CMB.1.raw
tcagtctacgtagccacgaccggtgctcgattttagtgctatagacttggggtttgggggggagaggagccccagccgtttgggactccccaagttgttttcattcagtgatcaggactgaacacagagactcaccagtggagttcgggctgacgtcgtttgggttttccttgctagtctagttacgttaaaggtcgtactagtgtagtaagtggacgtagggttggtagggaggttcgggtggggggtacttaccggttagggtaaaccggtccgggttccggggggttacccttaggtacgttccttccggtggttcggtacggtccttcggttggttactttaccttacgttaagtaagttacgtcgggtacgtaggtaggttacgggttcgggtttaccggggacccgaccggtaccggtccgttaaccgggggaggggggtaaccgggggttcggttacgggggttagggtttacgggggtttaacgggtttaaaacggttttaaaaccggaaaaaaggtttaaaagtggtaacggttacgggaagtaaaagttaaaaccgtaccggttaacggtacgggtaccgaaccgaaccgggttaaaggaacgtaaacgttacctaccgtaacctacgttaaccgtaaacggtaaacgttaacgttaaacgtttaaaaccgtaacggtaaacggttacgggttaactttaacgtaaacgtaaacgtaaacggtaaccgaaaaccgggtaccccggtaaacccgggaaacggaccgtaaccgaaacccgttgtaccgttaacttacccgttagttacccggtaacctaaggtaacgttacgttaccgggtaagtcccgaaggttaacggacgggttaaaacgggtaacgacgggtttacctggttttacgttacgtttaagttacgggttaccggtcccgggggtttaaacccggacgggttaaagcggtttaaccgggtccgttcgg

SEQ ID NO: 113984 - DNA, 861 bp, Homo sapiens
  misc_feature: GYAE6OF01EZRJ7.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacgttaaaaggtgtccagtgtgaagtgcgaggtggtggtagtcgtggggagtccgttaggtaaacggccggtcgggggttcccttagtacgtcgttccgtggttggtcggtccttcgtggtactttcctacgttttacagttaagtggtacgtggagtggtaggttcgggtacccgccgacggccgtaccggagggggaacgggggtcgtagggtagggttggggttacggttaacggtttaaacgtaaaaagttaaaacgtagtaaggttaggtaagaaaggtaaaagtaacggtaacgttacggtacgacccgtaacccggtaaggaaacggtagtaaccgtacctaaccgtactaccgttaacgaaagtaacgtaaagttaaacgttaaacggtaaaaaccggtacggtttaacgttaagttttacggaaactttaaaacgtacggtaaacgaccgtaccgtaaaacgggaaaaacccgtaggaacccctaacggacgtttacccgtaactaacgtttaccaaccgtaacccggtagtaaacggtcgtttacggaagtaccgtacgtaaacgttaacccggggtaaacggtaaaacgggtcggttaacggttagttacggttttaccgtttagtaacgttcgggttaccgggacgggaaccccgtaggggaaccgtagggtttcccggg

SEQ ID NO: 113985 - DNA, 826 bp, Homo sapiens
  misc_feature: GYAE6OF01ARJKI.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtggggagtccgttaggtaaagccgtgggggtcccttagagtctcctgtgtcggcctcgtggattctacttttcaagtaatggcttggattggtaggtttcgggtcccgccgtacggcgtacccggagggggaagggggtcgtaggggtaggttggggtttaggtaaccggttttaacgaaaaaggttaaaaagtggtaaggttagggtaaggaaaagtaaaagtaacggtaacgttaacgggtacgaccggtaacccggtaaggaaaacgggtaagtacgtttaaccgaacccgttacgttaccgtaaccgtaaaggaaacgttaaacgttaaacgtttaaaccgaaaaaaccggttcgggtttaacgtttaaacgtttacggaaactaaaaacggttcgaaaacgtaacggtaaccccgttaaacggaaaaacccgggtagaaccgaacccgtacggtaccgttactttaacggttacctacgtaacccagtaacgtacgttaacggaacgtgacctaaggttaccggtaaaggtaaaacgggtgtcttaagtcggtttactttagacgttacgtaccgggtacggggtaaccctagggtaacgtaggttccggg

SEQ ID NO: 113986 - DNA, 963 bp, Homo sapiens
  misc_feature: GYAE6OF01DCTV8.15.86.H09.1.454.CMB.1.raw
  modified_base (148)..(148): a, c, t, g, unknown or other
  misc_feature (148)..(148): n is a, c, g, or t
  modified_base (938)..(938): a, c, t, g, unknown or other
  misc_feature (938)..(938): n is a, c, g, or t
tcagtctacgtagccacgaccggtgctcgatttagtgctatagacttggggtttgggggggagaggacgccccagccttgggatccccaagttgttttcattcagtgatcgagaactaaacacagaggactcacagtggaggttcggntgagtcgttgggttttccttgctgtacttatacgttaaaggtcgtactagtgtagagtgcgtagggtggtggtaggtcggtgggggtacgtaccggttagggtaaaccgggtccgggttaccgggggttaccttaaggtacgttccgttccgttggtcggtcggtccgttcgttacggtacttaccgttactttacgaaggttacgtcggtcgtaggtagttggttacgggttccgggtcccgccggtacggtaccggtccgggaaagggggtaccggggtgggttaggggttagggtttacggggtttaacggttaaaccgtttaaaaggtaaaaaagttaaaggtaggttaaggttagggtaaaggtaaaagtaaaaggttacggaaaccggttacggtaaccggtaaccggtaaaccgggtaaggtaaaacggtaacgtttaacgtacccgtaaccgttaactaaccgttaaacggaaaagttaaacgttaaaacgttaaaaccggttaaaaacggtaaacccgggttaaggtttaacggtttacgttaaacgtaaaccgtaaaacggtaccgaaaacgttaccccggaaacgtaaaaccgggaaaccgggaaacgtaacccgtaaccgtaccggtaacccttaaccgttacgtttaaacccggaacccgttaaccgaaacggttacggttacgtaaacgggacgttacgaacgtaccggttaaacggtaaagacggttcttaagggtacttcggtttagtagttaccgtcggtaccgggaccggtntaaacggcgttaggtcgttacccgg

SEQ ID NO: 113987 - DNA, 795 bp, Homo sapiens
  misc_feature: GYAE6OF01BCYY3.15.86.H09.1.454.CMB.1.raw
tcagtctacgtagccacgaccggtgctcgatttagtgctatagacttgggttggggggagaggagccccagccttgggatccccaagtgttttcattcagtgatcaggactgaacacagagactcaccatggagttcggctgagtcgttggttttccttgctgctatacttaaaggtgtccagtgtagagtgcgaggtggtggtgtcggtggggagtccgttagggaaacgccgggttgggggtcccttaggacgtcctccgtggtgtcggtccttgtggtacttctactttctaagttaagtggtcgaggtactaggttacggttcgggtcccgtaccgtcggtacccgtaccgggaggggaacgggggtcgtacgggtagggttcgggttacggtacggtttaaacgtaaaaggttaaaagtaggtaagtagggtaagtaaagtaaagtacggtaaccgtaacggtacgacgtaccggtaaaggaacggaactaactaccgaacgtactactaagaacgtaataaacgttaacgttaaacgaaaacggttaccggtttagtttaacgttacgaaacgtaaactaacggaaactaaccggtaaccgtaaacggaaacgaacggaacctacgaacgtaccctagttaccttaagaccgtaacgtacgagttacggttaacgtagtagtaacgtagtaacgtaacgggtaaaggttacggtacgttaacgttgtttacgtttaagtaccgttacggtaccgggtacggacccgggaacggtaacgttccgggtacg

SEQ ID NO: 113988 - DNA, 885 bp, Homo sapiens
  misc_feature: GYAE6OF01D6AFF.15.86.H09.1.454.CMB.1.raw
tcagtctacgtagccacgaccggtgctcgatttagtgctatagacttgggtttgggggggagaggagccccagccttgggatccccaagtgtttcattcagtgatcaggactgaacacagaggactcaccatggagttcgggctgagctgggttttccttggctcgctatcttaaaaggtgtccagtgtgaagtgcaggtggtggagtctgggggacgtccgttggtaaaacgccgttgggggggtacccctttaggagtctccttgtgtcggtcctcgtcggatttctactttcgtaagttagtaggctgggaactggtaagttggggaccctccgtaaggccgttaccggaggggaaagggggtcctggggtaagggttggggttacggtaacggttttacgaaaaaggttaaaagtgtaagttgggtagtaaaggtaaaaaccttaggaaccgttacgggtagtaccgaaccccggttaggaaaaacgggaagtaacgtttaccgaaccctaacgtacgttaaacgaaacggaagggtaaactttaaaactttaaaccggaaaaaacggtccgggttaacgttaagttttacggaacttaaaacgttacgaaacggtaaccgaccgttaaaggaaaacccggtaccggaaaccaacggtaaacgtcccggtttaacttaactttacccgggtaacgtaacccaaacggttaacgacgtttaaacggggacggtttacgaccgttaaacgtacccggtaaacgggttaaaaccggggacgttacgttaacgttacccggttttagtttaaacggttacgtaaacccggtttcgggtaaaccccggggaaccggttaaaccgggaaccgttaaggtaccggggg

SEQ ID NO: 113989 - DNA, 901 bp, Homo sapiens
  misc_feature: GYAE6OF01CZ25H.15.86.H09.1.454.CMB.1.raw
  modified_base (132)..(132): a, c, t, g, unknown or other
  misc_feature (132)..(132): n is a, c, g, or t
tcagtctacgtagccacgaccggtgctcgatttagtgctatagacttgggtttgggggagaggagccccagccttgggactccccaagttgttttcattcagtgatcaggactgaacacagagactcaccanggagttcggctgagcgttgggttttccttgctgtcttatactaaaaggtcgtcgagtgtagaagtgcgtagggtggtaggtagtcggtagggggacgtaccgtttaggggtaaaaccggtcccgggttcggggggttaccccttaaggtacgttccgttccgtggttcggtcggtccttcgttaggtactttaccgttaacttttacgaaggttaacggtggtacgttaggagttacgggttagggtttcccggggtacccgaccggtacggcccggtaccggggaaacgggggtaaggggtccggttaggggtagggtttacggggttttaacgggtaaaccgtttttaaaaagaaaaaaaaggttaaaaactgggtaaacgttaggggtaaagaaaaacggtaaaaaagttacggtaaccggttaacgggtacgtaaacccggaaacccgggaaaggttaaaacggaacgttacttaaccgaacctaataccgtaagaaaagtaagtaaactttaaaccgtaaaacggtaaaaacggttacggttaagtaagtttaagaactaaaagtaacgaacgtaaccgtaaccgaaacggaaaacgacgaactacgacgtacctagttaactaccgtacaaccgtataacgtacgtaacgtaagacgaccgtaagtaccggtaaacggtaaaggacgtacgttgtacgtttatttaacgtacgttacggtcccgggaacggtacccgggaaaggttaccggaaggttcccggg

SEQ ID NO: 113990 - DNA, 709 bp, Homo sapiens
  misc_feature: GYAE6OF01A74Z5.15.86.H09.1.454.CMB.1.raw
  modified_base (352)..(352): a, c, t, g, unknown or other
  misc_feature (352)..(352): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggacgtccttagggtaaacgccgtcggggggttcccttaggacgttcgtcctggtgtcggcctcgtggtatttcctactttcaggtaatggctggatggaggttcgggtccgcaggtcgtccgagggaggggcgtgggnggtgggttggtacgtttacgaaaagtaaaagtgtagtaggtagaagaaaagtagacgtacggtcgaccgacccggtagaaaaggtaacgtacttaccaaccgtactacgtacgaaagaagtaacttaataaccgaaaaacgtacggttagttactttagaactaaatgaaactacgaccgtaacgaaaaccgacggaacacgtacgacccgtagttaacttacgttacgaaccgtaacgtagtacgttacgtaagtcgtacgtactacggtaaccgaaaggtaggtctagttacggttcgtttaagtacgttacttaccgggtaccggggaccgtaacgggtaacgtaggttccggg

SEQ ID NO: 113991 - DNA, 829 bp, Homo sapiens
  misc_feature: GYAE6OF01DW8O2.15.86.H09.1.454.CMB.1.raw
  modified_base (721)..(721): a, c, t, g, unknown or other
  misc_feature (721)..(721): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctgggttttcctgctgctatacttaaaaggtgtccagtgtagaagtgcgtaggtggtggagtcgtgggggactccgttagggtaaacgccggttcggggggtaccccttaggacgttccgtccgttggtggtccggtcccttcgtaggtactttcctacttttacgaaggttaagtggtacgttaggtacgttggttacgggttccgggtcccgccgagggtcccgttccgggaaggggggacggggtcggtggggtagggttcgggggtttaggtaaccggtttaaagtaaaaagtaaaaagtgtaagtaggagaaaagtaaaacgtagtacggtacggtagaccgaaccggtaaggaaaaggtataacgtaaccaccgtatactaacgaaaggtaactaaacgttaactaaaaccggaaaaacggttcggtttaagtatttaacggaaacttaaatacggaaacgtacgtaaccgaaacggtaaaaccgaccggaacaaccggtacgtaccgtttaaccgtttataacccggtttagaaccctaagtacgttaacgttacggaagttccgaanaacgttaagggaaaccggtaaagggtacgtcgttaggttacggtttcgttttaacgagttaccgttcggggaacccgggtaccgagggttacgttaacgggttccggg

SEQ ID NO: 113992 - DNA, 839 bp, Homo sapiens
  misc_feature: GYAE6OF01BM10H.15.86.H09.1.454.CMB.1.raw
  modified_base (186)..(186): a, c, t, g, unknown or other
  misc_feature (186)..(186): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtntgcatctgccttgctgggacgcctcgatcgaacgctcacctgccaacctaagtagtagacgacataccgaaccctacaccagtacgtaagtgtaactacaacgaagaacgaccgaacgggaacccgtccccgtaagtaataacgtaagtaggtaaaacgtttaagagttagagttcggacgtaccgaccgaaccgaaccgggaacggggggaccggaccgtaccccggtatacccggtccttacggaacgggttcggtacccgttaccggtacggtttccgggtacggggtcgttaccggaccccggtacccttaccccggtacccaaccccgttaacttcccccgtaacccgttaaacccccgtaccgttacccggtaccgttaaccggaacgggtaggtccgggtaaccggtcctaaggttaacgttaaccgtaccgttaacggttacgggtaggggaaccggaacgggtaccgtaaccccgaaacgtacgttaacgtttaccggaaggtcccggggtaaaagtaccgggggggtttaacggggtttcggggttacggggtaccggggaaccgggggaaccgggtaaaccggtaacggtccggttaacccgggaccccgttaaccgggtcggggtaaacccaaccccgggg

SEQ ID NO: 113993 - DNA, 798 bp, Homo sapiens
  misc_feature: GYAE6OF01B9GXQ.15.86.H09.1.454.CMB.1.raw
  modified_base (260)..(260): a, c, t, g, unknown or other
  misc_feature (260)..(260): n is a, c, g, or t
tcagtctacgtagccacgaccggtgctcgatttagtgctatagacttgggtttgggggagaggagccccagccttgggatcccccaagtgttttcattcagtgatcaggactgaacacagaggactcaccatggagttcggctgagctgggttttccttgctgctatcttaaaaggtgtccagtgtgaagtgcaggtggtggagtcgtggggagccgttggtaaagccgtgggggtcccttagagtctcctgtgtgcctntggacttcacttcagtaatggctggatggagttcgggtccgcctaggcctaccgaggggaacggggtcgtagggaggttggggttggacggttttaacgaaaaaggtaaaatgaagtggtagaagaaaaagttgaaccgttacggtacgaccgtaacccggtaggaaaaacggaagtaacgtttaccaacccgtacttaccgttaacgaaacggtaagtaactttaaacgtttaaaccgaaaaaaacccggttacgggtttaagtttaacgtttttaacgggaaccttaaaaaagtttacggaaaaccgtaacggtaaccccgtttaaacgggaaaaaaccccggtacggggtaacctaacccgtaacggtaccccggttactttaaacgtttaccgtaaccgttaacccgaacgtagtaacgttcggaacggtcgtaaccgacgttaccgggaacgttaaaaggggcgttacttacgttagttccttttacgaacttgtccggtacgggaacccgtagggaaaccttaggttccggg

SEQ ID NO: 113994 - DNA, 885 bp, Homo sapiens
  misc_feature: GYAE6OF01DV84M.15.86.H09.1.454.CMB.1.raw
  modified_base (831)..(831): a, c, t, g, unknown or other
  misc_feature (831)..(831): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcttgggttttccttgctgctatacttaaaaggtgtccagtgtagaagtgcagggtggtggtaggtcggtgggggacgtccgttaggtaaacggtccgggttcggggggttacccttaaggtacgttccgttccgttggttcgtcggtcccttcgtggtacttctactttcgaagtaagtggcgtaggagttaggtacggtttcggggtcccgacccggtacggtcccgttaccgggaaacggggggtaacgggggtccggttagggggttacgggtttacggggggtttacgggttaaaccggttttaaaacggtaaaaaaggttaaaaagtggtaaggttagggtaaagaaaaggtaaaagtacggtaaaccggttacgggtacggaacccgtaaacccgggtaaagggaaaacgggtaaacgtacgttaaccgaacctaacgttaccgtaaacgtaaaggtaaacgttaaactttaaacgtaaaaccggtaaaaacccgggttcgggttaatttttaacggtaacgtaaactaaaaacggtccgtaaaacgaccggtaacccggttaaaacggaaaccggtacgacctaaccgaccgtccgttaactacttacgacgtaccagtacgtacgtagagtcacgacgtacggaacggtaagggacgttacttagttcggtttnttaacggtcttaacggtcccgggacgggtaaccagggtaacgttggttacccgg

SEQ ID NO: 113995 - DNA, 775 bp, Homo sapiens
  misc_feature: GYAE6OF01CJBQK.15.86.H09.1.454.CMB.1.raw
  modified_base (714)..(714): a, c, t, g, unknown or other
  misc_feature (714)..(714): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccagtggagttcgggctggagtcgttgggttttcctgctgtctatacgttaaaggtgtcctagtgagaagtgcgagggtggtggagtcggtgggggagtccgttagggtaaacggtccgggtcgggggttacccttagggtcgttccgtccgttggtcggtcggtccttcgtggtactttctacgttttacgaagttaacgtggtatagggtagttaggtacgggttcggtcccgacgacggtccgtaccgggaaggggtaagggtcgtagggttacggttggggttaacgtaaccggtttaaagtaaaaagttaaagtggtaagttagggtaagtaaagaaaaccgttagtaacgtacggtacgaccgtaacggaagaaacgacgtctacgactatcgaagaagaatactaaacgaaccgtaaggtcgttaatagttagaattaagacggtaacacgtaccaaacggaaacgcgaagacccgtacgtctaacgtaacgtttaccaacggaccctaagtaaggtaccgttaacgtaacgacgttacaaagggttacccgaaaaggttaacgggactcgtttaacgngtttacgtttacgaacgtttacggttccggacgggtaaccaggttaaccgtacgttccggg

SEQ ID NO: 113996 - DNA, 684 bp, Homo sapiens
  misc_feature: GYAE6OF01ESBJ1.15.86.H09.1.454.CMB.1.raw
  modified_base (479)..(479): a, c, t, g, unknown or other
  misc_feature (479)..(479): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggtttttccttgctgctatacttaaaggtgtccagtgtgaagtgcgaggtggtggagtcgtggggagcgttggtaagccgtggggtcccttagagtctcgtgtgtcggcctgtggattcactttcagtaatggtctggatggtagttcggggtccgcgaggccgtaccggaggggagggcgtggaggttgggtggtacgttacgaaaagtaaatgagtggtagaagtaaatagtacgtacggtcgacgaccgtaggaaaggtacgattacaccatctacgaaagagaattaaagtaacgaaaacggtgtagttatttcgaaactaaanacgaacgacgtacgtaacgaaaccgaggacagacgtaccctagttaacgttactaacgtaccctaagtacgttacggtttacggaactcgtaaccgacttaacgggaaacggtaaagggtacgtaccgttagttacgtttctttacggtacgttacggtaccggttaccggggacccgtaagggtaaaccgtaaggttcccgggg

SEQ ID NO: 113997 - DNA, 879 bp, Homo sapiens
  misc_feature: GYAE6OF01DGQ1D.15.86.H09.1.454.CMB.1.raw
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
tcagtctacgtagccacgaccggtgctcgatttagtgctatagacttgggtttggggggagaggagccccagccttgggactccccaagtgttttcattcagtgatcaggactgaacacagagactcaccatggagttcggctgagcttcggtttttccttgctgcttattacgttaaaaggtgtccngtgtgaagtgngaggtggtggngtcgtggggacgtccgttaggtaacgtccggtcgggggttcccttagtacgtctccgtgtgtcgtcctcgtggtacttctactttacgaagttaagtggcgtggtattggtacggtttcggggtacccgccgaaggtccgtaccggagggggaacgggggtccgtaggggttagggttggggtttaggttaaccggttttaaacgtaaaaaaggttaaaacgttggtaagttaggtagaaaaggtaaaacgttaggaaaccgttacgggtacgaacccgtaaacccgggtaaggaaaacgggtaacgtaacgttacccaaccgtacgttaccgtaacgaaaagtaagtaaaacgtttaaacgtttaaaaccggaaaaaaccggttcgggtttaagtttaaacgtttacggaaacgtaaagtaacgaaaccgtacggtaacccgtaaaacggaaaccgggaaacggtaaccaacgtaccggtaccgtttaaccctttacgtttaaacccgttacgtaaaccgtaacgtagttaacggttacgggtaaacgttgaaccgtacgttacccggtaaaagggtaacgggaacggtacttagtttacgttcgttttaacgagttacgttaccgggtacgggtacccggaagggttaaccgtggtttaccccgggg

SEQ ID NO: 113998 - DNA, 1095 bp, Homo sapiens
  misc_feature: GYAE6OF01DAXSQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagtcttgggtttttccttgctgtctatacttaaaaggtgtcctagtgtagaagtgcgagggtaggtggaggtcgtggggggagtccgttaggtaacgtccggttcggggggtacccttaggtacgttcctccgttggttcggtcgggtcccttcgttggtactttcctaccgttttacaaggtttaagtcgggtaccgttaggggtaacgttgggttaacggggtttccgggggttcccggaccccgtaacggggtcccggttacccgggaaggggggggtaaacggggggtccggtttagggggtaacgggggttttaggggtttacggggttaaaccggttttaaaaccggtaaaaaaaaggtttaaaaagttaagggttaagttaagggtaggtaaaaaggtaaaaacggtaagtaaccggtaacggtacggtaccggtaaaccccggttaaaggaaaacgggtaaaggttaacctttaaccgaaccctaacgttaccgttaaacgaaacggtaaacggtaaacttttaaaacgttaaaaccggtaaaaaccgggttaaccgggttttaagttttaaacggttttacgaaaacgttaaaggtaacggtaaaacggaaaccgtaacccggtaaaccgggtaaaaacccggtaaacggaaacccgtaaccgtaaccgggtaaccccgttttactttaaaaccgttttccgtaaaccggttaaacccgtaacggtttaacggtaacggttttaaccggggtaaacgttacggttaaccggtaacggtttaaaacccgggaaacgggggtttaaaacggggacggttaacggttttaaaggtttacggttttaaccgggttttttaacaaggttttaacggttaaccccggggttaccggggggttaacccgaaacgggggtaaccgttaaaggggttttccccgggggg

SEQ ID NO: 113999 - DNA, 755 bp, Homo sapiens
  misc_feature: GYAE6OF01A6AGJ.15.86.H09.1.454.CMB.1.raw
  modified_base (184)..(184): a, c, t, g, unknown or other
  misc_feature (184)..(184): n is a, c, g, or t
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (535)..(535): a, c, t, g, unknown or other
  misc_feature (535)..(535): n is a, c, g, or t
  modified_base (576)..(576): a, c, t, g, unknown or other
  misc_feature (576)..(576): n is a, c, g, or t
  modified_base (596)..(596): a, c, t, g, unknown or other
  misc_feature (596)..(596): n is a, c, g, or t
  modified_base (711)..(711): a, c, t, g, unknown or other
  misc_feature (711)..(711): n is a, c, g, or t
tcagtctacgtagccacgaccggtgctcgatttagtgctatagacttgggtttgggggagaggagccccagccttgggactccccaagtgttttcattcagtgatcgaggactgaacacagaggactcaccatggagttcgggctgacgcgttggttttcctgctgactatacgttaaaaggtntaccagtgtagagtgcgaggtggtggagtcgtggggatcgttaggtaacgcgtggggtccttagngtctctgtgtcgtcctctagtattcgtactttanagtaagtggtcgtggagtggtcggttcgggtacccgccgcggtaccgtccggaagggggacgggcgtaggggtaagggtttggggttaggttaaccgtttaaagaaaaagttaaagtggtaaggttaggagaaagtaaacgtacgtaacgtacggtacgaccgtaaccggtaagaaaggtaactacttaccaacctatactaacgaagtagtaactaacgttaaccgaaaaggttcgttagttaacgtttanaaacgaaagtacaaacccgtgtaaaccgaaggaaacccggngtacccaagccctaccgttntaacgtttcaccgtacccaagttcgtaagtttccggaagttacgcgtaacggttaacgggaaagttaaacggggtctcgtttaattcggtttcctttaagaggttttaccccggngggaacccggggtaacacccgggttaagttacccggttcccggg

SEQ ID NO: 114000 - DNA, 876 bp, Homo sapiens
  misc_feature: GYAE6OF01B0LDA.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcacatggagttcggctgagtcgttgggttttccttgctgctatacttaaaggtcgtccagtgtagaagtgcgagggtggtggaggtcggtgggggagtcccgtttagggtaaacggtccggttcggggggttacccttaggtacgtccttccgtggtcggtcgtccttcgtggtacttctacttttacaagttaagtggtcgtaggattggtagggttacgggcccgacggtacggcccgtacgggaagggggacgggggtcgtaggggtacgggttaggggtttacggtaacgtttaaacgaaaaaggttaaaacgtggtaagtagggtaagaaagtaaaagtacgtaaccgtacggtacgaccgtaaccggtaaggaaacggtaacgttacttaccaactacttacgtaacgtaaaggtaagtaaactttaaacgttaaaaccggtaaaacgggttacggttaagtttaacgtttaacgaaacttaaaaggtaccgtaaaaccgtaacggtaacccgtaaaaccgggaaaacccggacggaaaccacccgttacgttaccttacttaacgtttccctaacggtaccctaacggtaagttacgggttaaaccggagtaccgacgttaaccggaacggttaaaccgggtaaaggtaggttaccgtttagtacggtttacgtttacgtaaggttaccggttccggggtaccgggtaaaccgtcggggttaaacgttcgggttacccggg

SEQ ID NO: 114001 - DNA, 956 bp, Homo sapiens
  misc_feature: GYAE6OF01ERYTK.15.86.H09.1.454.CMB.1.raw
tcagtctacgtagccacgaccggtgctcgatttagtgctatagacttgggtttgggggggagaggagccccagccttgggatccccaagttgttttcattcagtgatcaggactgaacacagaggactcaccatggagttcgggctgagcgttggtttccttgctgctattacgttaaaggtcgtaccagtgtagaagtgacgaggtggtggtagtcgtggggacgtacgttaggtaacgtccggtcgggggttacccttaggtacgttccttccgttggttcgtacggtccgttacgtggttactttaccgtactttacgaagttaacgtggtacgttaggtagttacggttacgggtttccgggtacccgaccgtaacgggtcccgtaaccgggtaaaggggggtaacgggggaccggtttacgggggttaaggggtttacggggtttaaaccgggtttaacggtttaaaaaccgtaaaaaaggttaaaaggttacgtaagttacggtaagtaaaggtaaaaagtacggtaacggtacggtacgaccgtaaccgtaaggaaacgtaacgtacgtaccgaactacgtaactaacggtaaacgtaaagtaacttaaaccgtttaaaggaaaaccgttcggttaattaacgtttaaggaaacttaaacggtacgaaacgtaccgtaaggtaaaccgaaaccgtaggaaccctaggttaacccggttaccacgtttaacgtaccgtagttaaaccccgagttaacggttaacgttaaccggaattaccgggttacaaacccgggttaaacgggttaaaaccgggttacggaaacggttttaaacccgtgttttaaccgggtttacctttaaaggttaccccggtttaaccggacgggggtttaacccccggggaagtaaaaacccgggtttaccggttcgggtttaaaccccccgggg

SEQ ID NO: 114002 - DNA, 879 bp, Homo sapiens
  misc_feature: GYAE6OF01DP8JY.15.86.H09.1.454.CMB.1.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
tcagtctacgtagccacgaccggtgctcgatttagtgctatagacttggggtttgggggggagaggagccccagccttgggatccccaagttgttttcattcagtgatcaggactgaacacagagacctcacatggagtcggctgagtcgttcggttttccttgtctacgtcttaagttaacgttaaaaggtcgtccgtagtgtagagtggcgtagggtggtgtaggtgggtggggactcggttaggtaacggtccggttggggtcctagtacgtctcctggtgtcgtcctgtgnttctacttcgaagttagngtcgtggtagttgggtagttaccgggtccgacggacggtccgtaccggaggggtacgggtcggttggggtaggttggggttacggttaaacgttaacgtaaaaagttaaagngttaaggtaggaagtaaaagaaagtacgtaacgtacggcaaccggtaaccgaaggtaaacggtataacttaccaacctacgtacgaacgtaaggtaaagttaaactaaccggtaaacgtaaaaggttcgggttaagttacgtttaacgaaacttaaccgtaacgtaaagtaaccccggtaaccgtaaaacggaaaacccgttacggaacctacccggtaaaccgtttaccgtttactttaaaccctacggttaaacccggttaaacctacccggttaaaggtaaccggtttagggtaccttaacggggcttaaaacccgggaaaccggttaaacggtaacccgggttacgggtattttaccgggttagtttaaacgttttaacgggcgtttaaacccgggtacgggggtttacccgggaaacccgtttccggggaaatttccgggtttaccggg

SEQ ID NO: 114003 - DNA, 851 bp, Homo sapiens
  misc_feature: GYAE6OF01CRL03.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatacttaaaaggtgtccagtgtgagtgcgaggtggtggaggtcggtggggacgccgttaggtaacgtccggtcgggggtacccttaggacgtcgtccgtgtcgtcggcctcgtggtattcctactttacgaagttaagtcgggtaccgtaggagttaggtacggtttcggggtccccgaccgacggtccgttacccgggaaggggaacgggggtcgtaggggtagggttcggggtttaggtaaccgttttaaacggaaaaaagttaaaaagtagtaacggtaggtagaaaacggtaaaagtaacggtaacgtacggtacgaccgtaacccggtaaggaaaaggaagtaacttaccgaacctagttacctaagaaacgtaagtaaacgttaacgttaaacgaaaaaccgggttacggttaagttaagtttacgaaactaaagtaacggaaacgacgtaccggtaaacgaaaacccggagaaaccacgtaaccgtaccgttaacgtttaactaaccgtaacgtaacccgaacgtactaacgggttacggtaagtccgtaaccgtaacggtaccgtaaaacgggtaaacgggtacgttaacgttagttacgtttccgtttaacggttaacgttaccgttcgggttaacccggggacccgtaaacggggtaaccgttcggttaccgggg

SEQ ID NO: 114004 - DNA, 871 bp, Homo sapiens
  misc_feature: GYAE6OF01CHIVS.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctggttttcctgctgctatacgttaaaggtgtcagtgtgaagtgcgaggtggtggagtcggtggggacgtccgttagggtaaacggtccggttcggggggttacccttaggtacgttcgttccgtgttcggtcggtccttcgtggtacttcctacgtttcgagtaagtggtcgtaggaagttgggtacggttcggggtacccgtccggtaaggtccgtaccgggaagggggtaacgggggtccggtaggggtacgggtttgggggtttacggtaaccggttttaaacgtaaaaaaggttaaaagtggtacggtaggtaaggaaacggtaaaagtacggtaaccgtacggtacgtacccggtaaccgggtaaggaaaacgggtaatacgttaccgaacctaacgttactaacggaaacgtaagtaaattaaaccgtaaacggtaaaaccggttacgggttatttaacgtttacgaaacgtaaagttaaccgaaacggtaccgtaacccggtaaaacggaaaacccgggttaacggaacccgtaacgtaacccggggtaccctttaacgtttaagtttacccggttaaccgtaccccgtaaaggttacgttaacgtaccggtaagttccgaacgtacggtaaacgtaacggtaaaggcggtaccttaggtactttcgttagagttaccgtacggttacgggaccgtaaacggtcgttaggtcccggg

SEQ ID NO: 114005 - DNA, 866 bp, Homo sapiens
  misc_feature: GYAE6OF01BA25H.15.86.H09.1.454.CMB.1.raw
  modified_base (810)..(810): a, c, t, g, unknown or other
  misc_feature (810)..(810): n is a, c, g, or t
tcagtctacgtagccacgaccggtgctcgatttagtgctatagacttggggtttggggggggagaggagcccccagccttggggactccccaagttgttttcattcagtgatcaggactgaacacagaggactcaccatggagttcgggctgagtcttcgggttttccttgctgtctatacgttaaaggtcgtctagtgtagaagtgcgaggtggtggtaggtcggtggggtacgtcgttagggtaaacggtccggttcgggggttaccttaggtacgtccgtccgtggtgtcggtcctcgtaggtactttctacttacgtaagtaagtggtcgtagtagtggtacggtcggtccgtcgacggtcgtaccgggaaggggacgggtcggtgggagggttgggggttaacggttaacgtttaaacgaaaaaggtttaaaacgtggtaacggttaggtaaaggtaaaagtaaaaacgttacggtaaccggtaacggtacgtaacccgtaaaccggtaaagtaaaacgggtaacttaacgttaaccaaccgtaactacgtaaacgtaaacgtaaggtaaacttaaaacgtaaaccgtaaaaacgggttcggtttacgttttaaacgttataaaccggtaaaactaacgggtaaaacctagggtaacccgtaaaacgggaaaccgaacggaaacctaccgtaactaccggttaaacttacgttaccgaaaccgtttaaccaaggtaaccttaacggtacggtaatcggactaacgggtaaccgtaaacgggaacggtagaatttacttacggttntttaccgggaattacggtcccgggtacgggaacccgttaaggattcgggttaccgg

SEQ ID NO: 114006 - DNA, 919 bp, Homo sapiens
  misc_feature: GYAE6OF01CPVPA.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccgatggagttcggctgacgcgttgggttttccttgctgctatacttaaaggtgtccagtgtgaagtgcgagggtggtggaggtcggtgggggacgtccggttaggtaaacggtccggttcggggggttaccccttaggtacggttccgttccgttggttcggtcggtccgttcgtagggtacttcctaccgttttcgaaggtttaagtcggtcgtagggtagttggttacggttcggggtcccgaccgacggtcccggcggaagggggtaacgggcgttagggtgggtgggttacggtaccggttaaagaaaaaggtaaaagtgtaacggtggtaagaaacggaaaagttagacgtaacggagtaccgtacgaaggaaacggagttaactacctaaccgactaccgttaaacgaagtaagtaacgtttaaacgtaaaccgtaaaaacggtcggtttagttaacgttacgaaaccgttaaagttacgggaaaacctccgggttaacccgtaaaaccggtaaaacccggaacgggtaaacccccaaaggtacccgggttaacccgtttaacgttaacgttttaaaccccgaccggtttaaccgaaacccgggttcgggtttaaaaccgttacgggggtaaccgtcgttaaaccccgtacgaaaacccgggggtaaaacgttaacgggggtacgttaacgtttacggtttacgttaaccggtttttagggacctttaacgggtttccggggacggggtaaaccctaaccgggggttaataccccggggttcgg

SEQ ID NO: 114007 - DNA, 744 bp, Homo sapiens
  misc_feature: GYAE6OF01EUNN2.15.86.H09.1.454.CMB.1.raw
  modified_base (133)..(133): a, c, t, g, unknown or other
  misc_feature (133)..(133): n is a, c, g, or t
  modified_base (563)..(563): a, c, t, g, unknown or other
  misc_feature (563)..(563): n is a, c, g, or t
  modified_base (601)..(601): a, c, t, g, unknown or other
  misc_feature (601)..(601): n is a, c, g, or t
tcagtctacgtagccacgaccggtgctcgatttagtgctatagacttgggtttgggggggagaggagccccagccttgggactccccaagtgttttcattcagtgatcaggactgaacacagaggactcaccntggagttcggctgagtcgttgggttttcctgctgtactatacgttaaaggtcgtccagtgtgaagtgcgagggtggtggtagtcggtggggactccgttaggaaggtccgtcgggggtaccttagacgttcgtccgtagtcgtacggccttagtaggtacttaccttacgtttacgtaagtaacgtgggtcctagggacgttaggtaggttccggacccgacgacggtcgtaaccgggtaggggaagggtcgtgggttaacgggtgggttacgttaacgtaaacgaaaaggtaaagttgagtagttaagaaagtaaataggtaccgtaggtaccgacgtaacccgaagtaacggaacgttactaccaacgtatacgtaacgagtaagtaacttaataaaccgaagttacgtagttataccgtaataaagnaacgtaacgacgtaacggaaaaccgtgacacggtaacncccttaagttacgtaactaacgtaccgaagtagttacggaacgtaagttacgaggttaaccaagggtaaaccgaaggtacgtacttaggtcttacggtaagtacttacggtccgaacgggtccaaacggagttacgggtaccg

SEQ ID NO: 114008 - DNA, 1043 bp, Homo sapiens
  misc_feature: GYAE6OF01BCQFR.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccagtggagttcgggctgagtcgtggtttttccttgctgctatacgttaaaaggtgtccgagtgtgaagtgcgaggtggtggtagtccgtggggacgtcgttaggtaacggcggttcggggttcccgttagacgtctcctgttgtcggtcctcgtggtacttcgtactttcgagttaagtcggtacgtaggagttggtacgggtttaccggggtcccgacccggtagggtaccccggttaccggaacggggggtaacggggggtccgttaggggttacggggtttacgggggtttaccgggttaaaacgggttttaaaaccgtaaaaaagggttaaaaagttagggtaagggttaaggggttaaaaggaaaaacgggttaaaaagtttaaccggtaaaccggtttaacccgggtaccccgggaaaccggttaaacccccgggttaacgggaaaaaaagggtacgtaaaccggtttaacccggaaaccccttaacgttacccggtaaacgtaaaaacggtaacggttaaaactttaaaacggtttaaaacccgtaaaaaccggggtttaccgggttttaaggtttaaaccgtttacggtaacccggtaaaagttaacgtaaacgggtaacctaaccccgggtaaaaccggtaaacgggtaaacccgaaccgtaaccgaaccgggtttaaccttaaccgtttaaaccgttaaccgttaaccccggttaaccgtaaacgtaaccgggttaacgttaaccggggtaactacggtaacgtaaccggtaaccgggtaaacggtaaagggtaccgtaaccggttattaaccgggtttatttaaacccgggtatttaccccgggggttacggaaccccggggtaaaccggtaacgggaaaccccgttaaggggttcccccggg

SEQ ID NO: 114009 - DNA, 773 bp, Homo sapiens
  misc_feature: GYAE6OF01AIITS.15.86.H09.1.454.CMB.1.raw
  modified_base (725)..(725): a, c, t, g, unknown or other
  misc_feature (725)..(725): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttttccttgctgctatcttaaaaggtgtccagtgtgaagtgcgaggtggtggagtcgtggggtagtccttaggtaaacggccgtgggggggtcccttaggacgttcctccgtggtggtggccttcgtgggtactttcctacttttcaagtaacgtgggcgttgggatcggtacggtttcgggggtcccgccgagggtccgtaccggaaggggggaacgggggtccggttagggtagggtttcgggggttacggtaacggttttaacgaaaaaaggttaaaaagttggtaagtagggtaagaaagtaaaaagtaggtaacgtaacgggtcgaccgtaacccggtaaggaaaaggtaagtactaccacctactacctagaaagagtaaataacgttaaccggaaaacgtgggtttaataagtttacaactaaaagtcgaaaaccgacggtacccgtaaaggaaaacccgtgaacctaacgtccgtacctttactaactttacgtaccgacctacgtaagtaacgttacggaagtcgaccgaacgttcgggaaacggtaaggacggtctggttnttagtttcaagttcgtacggccgggaacccgagggctttaggtacggg

SEQ ID NO: 114010 - DNA, 883 bp, Homo sapiens
  misc_feature: GYAE6OF01DYNUG.15.86.H09.1.454.CMB.1.raw
  modified_base (198)..(198): a, c, t, g, unknown or other
  misc_feature (198)..(198): n is a, c, g, or t
tcagtctacgtagccacgaccggtgctcgatttagtgctatagacttgggtttggggggagaggagccccagccttgggatccccaagtgttttcattcagtgatcaggactgaacacagagacctcaccatggacgttcgggctgacgtcttggttttcccttgctgctatacgttaaagtctccagtgtagagtgngtaggtggtggagtcggtggggacgtccgttaggtaacgccggttacgggggttacccttaggacgtccttccgttgtgtcgtcccttcgtaggtactttaccctagtttaccgtaagttaacgtcggtacgttagggtattaggttacgggttccggggtacccgaccgtagggtacccctaccggggaacgggggtaacggggtccggtggggtacgggtttcggggttacgggttaaccgtttaaacgaaaaaaggttaactgggtaagttagggtaagtaaaagtaaagtacggtaaccgttacgggtacgacccggtaacccggtaaggtaaaaggtacgtaactacccgtaccctagttaccgtaagaaacggtaagtaaacttaacgttaaacgaaaacggttcgttaagtttaactttacgaaagtaaacgtaacgtaaacgacccgttaacccgtaacggtaaacccggacgaacctaccggtaccgttaccgtttaaccgtaatttacccgtactaacccggtaacgttcgtaacggtttacggaattcgtacgtaaccggaacgtaaaccgggtaagtccgaaacgtttaggtttactttccgggtttaataccggtacgggtttacccgggtaccccgggaacccgtttaacggggactttcgggttacccgg

SEQ ID NO: 114011 - DNA, 727 bp, Homo sapiens
  misc_feature: GYAE6OF01APW6Q.15.86.H09.1.454.CMB.1.raw
  modified_base (177)..(177): a, c, t, g, unknown or other
  misc_feature (177)..(177): n is a, c, g, or t
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (609)..(609): a, c, t, g, unknown or other
  misc_feature (609)..(609): n is a, c, g, or t
  modified_base (633)..(633): a, c, t, g, unknown or other
  misc_feature (633)..(633): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttctgctgctattactaaaggtntaccagttgtanagtcgcgtggtggtggacgtcggtggggngtccgttaggtaaacgtccggtacggggggttccccttaagtacgttccgttccgtaggtggttcgaccgttcgtaggtacttcttaccgttntagtacgtgtcgtggtagtacggtggtggggtccctaacgngtccctcggaacggggagggccgttgggtaggtcggttcggtaacgtttaagaaagtaaacgtgagtaggacgtaagaaacgtagacgtaacgtgaaccgacgtagaaacgtgtaatcaaccgtatacgtacgaagactacgtaaacgtaaccgtaaagcgttaagtaagttagtaacgaaaattccgaacgtacgaaccgtaagaaccaaggtacacggtactaaccgttcgtaacttacgttacgaaacccggtntacggtaacgtaaggtaacccgtntaaccgtagtaaccgtaggaacggttcgaacttcgttaagtttcgtacgtaagttacgttcccggggaacggaccgtaaggtacgttacgcggg

SEQ ID NO: 114012 - DNA, 852 bp, Homo sapiens
  misc_feature: GYAE6OF01BL0PZ.15.86.H09.1.454.CMB.1.raw
  modified_base (378)..(378): a, c, t, g, unknown or other
  misc_feature (378)..(378): n is a, c, g, or t
tcagtctacgtagccacgaccggtgctcgatttagtgctatagacttggtttgggggggagaggagccccagccttgggatccccaagtgttttcattcagtgatcaggactgaacgaccaggaggacctcaccatggagttcggctgagctgggtttcctgctgctatcgttaaaggtcgtaccagtgtgaagtgcgagggtggtggagtcgtggggagccgttaggtaagccgtgggggttcccttagagtctccgtgtgtcggcctctggtattctactttcagtaatggctggatggagttcgggccaccgaggcgtaccgaggggtaagggtcgtgggtaggtgggttggtacgtttacaaaaggttaaaagngtaagtggtagaagtaaaatagaccgtacggtcgaccgtaacccggtaaggaaacggtaacgtacgttaccgacctaagtcctacgaaaggacgttaagttaaacgttaacccgaaaaaacggttccgggttaagtttaacgtttacggaaacgttaaacgtacgaaaccgtaacggtacccggttaaacggtaaaaacccgggacgtaacccggaacgtaaccgggttacccccgtttacgtttaacgttttaacccgtaacgggttaaacccccgtaacggttaacgggttaaaccggttttaacgggaaacgttccggtaaaccggtaacggttaaccccggggtaaaagggtttaaaaccggggaggttaacccgttttagttaacggtttcccgtttttaacgtaagttacgttaccccgggtacgggggtaacccccggtaaaggggtaccgtaaaccgggttcgggg

SEQ ID NO: 114013 - DNA, 885 bp, Homo sapiens
  misc_feature: GYAE6OF01BA7D1.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttggctgagtcgtgggttttccttgctgtctatacgttaaaaggtgtccagtgtgtaagtgacgaggtggtggtaggtccggtgggggacgtccttagggtaacgtccggtacgggggtcccgttaggtacgttccgtccgttggtcggtcggtcctccgttggtacttcctacttacgataagtcggacgttggtagtggttacgggttcggggtcccgaccggtacggtacccgtccgggtaacgggggaagggggtccggtggggttagggttcggggttagggttaaccggttaaacgaaaaaggttaaaacgtaggtagtacggtaggaaacgtaaagtacggaacgtcggtacgaccgacgggtaaggaaaggtaccgtaacgtttaccgaccttacgtacgtaacgtaagtataaccgtaaagttaaaccggtaaaaccggttaccggttaagtttaacggttaactaaaccgtaaacgtaacgtaaaccgtaaccgggtaccgtaaacgggaaacctaccgggacgtaaccgacgttaccctacgtaactttcccgtaactacctacgtaagtaacggttacggtacgtaccgacgttaacggtaacggtaccggtaaaaagggttccggttaaaacgttcggttaacggtttcgtttaacggtttaacgtacccgggtttaccggggaacccgggtaacccggttaaacgggtaaaccggttttccgggtaaccccggg

SEQ ID NO: 114014 - DNA, 825 bp, Homo sapiens
  misc_feature: GYAE6OF01AJ4TQ.15.86.H09.1.454.CMB.1.raw
  modified_base (214)..(214): a, c, t, g, unknown or other
  misc_feature (214)..(214): n is a, c, g, or t
tcagtctacgtagccacgaccggtgctcgatttagtgctatagacttggggtttggggggggaggaggagccccagccttgggatccccaagtgttttcattcagtgatcaggactgaacacagaggacgtcaccatggagtcgggctgagtctgggttttcctgctgctatcttaaacggtgtcctagtgtagagtgcaggtggtggagtcgnggggtagtcgttaggtaaacggccggttggggggtacccttaggacgtcgtacccgtggtcggtcggtcccgttgtagggtactttctaccttttggaagttaaggtggtcgttggaagttgtacggttcgggtccgaccgaggtccgaccccggtaaggggggacgggtcggttacgggtacggttggggttaccggtaacgtttaaccgaaaaaggttaaaatcgtaaggtcggtaagaaaggtaaacgtacgtaacggtaaccggtcggtaactaacccgggtaagaaaaggggtcgtaaacgttacccgaacttaacgtaccctaagtaaaggtaacgtaacttaaaccgtttaagaaaaccgggtagttaccggttaagtgtaaacggtaagtaccgtaaacgaccggtaactaacccggtaacggaacgtaacacgtaacgtcgttaccgtacttaacggtacgtaccgaacgtaacgtactacgggagtaccgtacgtacgaacgggtaacgaacgggtacgtacgttggtttacgtccgttttaaggaccgtttacgtacccggggtacgggtaaccggtacggacgtttaaccggtacgggg

SEQ ID NO: 114015 - DNA, 968 bp, Homo sapiens
  misc_feature: GYAE6OF01BUGE9.15.86.H09.1.454.CMB.1.raw
tcagtctacgtagccacgaccggtgctcgatttagtgctatagacttgggtttgggggggagaggagccccagccttgggatccccaagttgttttcattcagtgatcaggactgaacacagaggacctcaccatggagttcgggctgagtcgttgggtttttccttgctgcttatacgttaaaggtgtcctagtgtagagtgcgtagggtggtggagtcggtggggtacgtccgttagggtaacggtccggttcgggggttacccttaggacgttccttcgtggtggtcggtacctcgtaggtacttctactttcgagtacgtggtctaggagttaggtacggttcggcccgtacgacggtccgtaccggagggggtacgggtcggtgggttacggttcggggttaacggttaacgtttaaacgtaaaaaggttaaaagttcggtaaggtacgggttaaagaaaaggtaaaacgttaaccgggtaacgttaccgggtacgtaaccccggtaacggtaaaggaaacggtaacgtacgttaaccgaccgtaactacgtaacgaaagtaacgttaaattaaacgttaaccggtaaaaaccggttcggtttaagtttaacggttaacgaaagttaaaaccggtacggtaaaaccgtacccgggtaaaccggttaaaacccggtaaaacccggacgggtaaaccctaacccggggttaacgttttacccccgttaaacgttttaaacggtacccgtttaaacccggtaaaccccgtaaagggttaacgttaaccgggtttaaaccccgggaagttaccccgttaaacgtaacgggtaaaccgggtaaacgggtaagggtacgtttaaccggttaggtttaccggtttagttttaacgtacgggtttaaacccggtccccgggggtaaccggggtaaacccgttagggtaaccccggtttgggtttacccggg

SEQ ID NO: 114016 - DNA, 672 bp, Homo sapiens
  misc_feature: GYAE6OF01DAJIU.15.86.H09.1.454.CMB.1.raw
  modified_base (142)..(142): a, c, t, g, unknown or other
  misc_feature (142)..(142): n is a, c, g, or t
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
  modified_base (391)..(391): a, c, t, g, unknown or other
  misc_feature (391)..(391): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttgggggagaggagccccagccttggactccccaagttgttttcattcagtgatcaggactgaacacagagactcacagtggagttcgggntgagtcgttcggtttccgtgcgtgctatacgtaagtcgcgtagtgtgtagtgcgaggtggtggcgtcggtagggacgccggttaggaacggtccggtcggggtacctagtcgtcgtcgtgtgtcgtctcgngtactcttacttatagtagngtcgtagtagtaggtcggttcggccgacgcggcgtacggagggacggttgcgggtggtacggtacgtaacggtaagtaaagtaagtgtaagacggtanaaacgtaagtacgtacggttacgacgtaccgtaaggaagtaacggtaatacacctatacgtacgaagaagtactaaagtaacgtaacgaagttagtactactaagtactaagactaacagtaaccgacgaagacctagaccgtgtacgtattacgttanacgtactagacggttactacgtgagtaccgagtaacggaacgtagtacggctttaagttaccgtgtttaggtacgacgggtacccgtaggaccccgggttaagttcccggtcggtttaccgg

SEQ ID NO: 114017 - DNA, 792 bp, Homo sapiens
  misc_feature: GYAE6OF01BFCXQ.15.86.H09.1.454.CMB.1.raw
  modified_base (659)..(659): a, c, t, g, unknown or other
  misc_feature (659)..(659): n is a, c, g, or t
  modified_base (711)..(711): a, c, t, g, unknown or other
  misc_feature (711)..(711): n is a, c, g, or t
  modified_base (736)..(736): a, c, t, g, unknown or other
  misc_feature (736)..(736): n is a, c, g, or t
tcagtctacgtagccacgaccggtgctcgatttagtgctatagacttgggtttgggggggagaggagccccagccttgggatccccgaagtgttttcattcagtgatcaggactgaacacagaggactcaccatggagttcgggctgagcttgggttttccttgctgctatacgttaaaggtgtccagtgtagaacgtgcgagggtggtggtagtcggtgggggacgtccgttagggtaaacggtccggttcggggggttcccttaggacgttcttccgttggtggtcggtccttcgtggtactttcctacttttcgaaggttaagtcgggtacgttaggtacgttagggttacgggtttccggggtcccgccggtaacgggtcccgtaaccggggaacgggggggtaacgggggtccggttggggtacggggtttgggggtttacgggttaaaccggttttaaaccgaaaaaaggttaaaagttggtaagttacggtaaggaaaagtaaaacgtacggtacgtacggtcgtaaccgaaccggtaaggaaaggtacgtacttaccgaactatacacgaagtataacttaacgtaacgaaaacgggttcttagttaagttacaactaagtacgaaacgcggtaaccaaacggaaaccggngtaaccacggacgttcctaattacgtcgactacagtaggtacgttagactanacgtaacgaggtaaagtaggtcgtntaagttcgtacgtttagacccgttgtccgggaacgggtacaaacggtgttcggtcg

SEQ ID NO: 114018 - DNA, 842 bp, Homo sapiens
  misc_feature: GYAE6OF01BFSH5.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttcctgctgctatacttaaaaggtgtccagtgtgaagtgcaggtggtggagtcgtggggagccgttaggtaaaggccgtgggggtacccttagacgtctccgtgtgtcggtcctcgtggtattctactttcgagtaatggactggatgagttggccgtcaggcgtccgaggggagggcgtggtacggtgggttagggtacgttttacgaaaagttaaaagtgagttggtacgtaaaggtaaaagtaggtaaccgtaacggtcggaccgaaccccggttagggaaaacggtacgtaacgttacccgtaaccgtaagtacctaacgaaacggtaataaacgttaaaccgttaacgaaaaaaccggtccgggtttaacggtacgtttttaccgaaaagttaaaccgtacggtaaacgtacggtaacccgtaaacgggttaaaaacccggaggtaaacccgaaccggtaaccggttaccccggttacttaaaactttcccggtaacggtaaaccccccgagttaaacggtaccccggtttaaagggaaccgttacgtaccgaacgttaaccgggtaaacgggttaaaacgggccggttaagttaccggttagtttaccggtttacgaacgtttaaccggttcggttacccgggggaacccgtaaggggttaacctacgggtttaaccccgggg

SEQ ID NO: 114019 - DNA, 788 bp, Homo sapiens
  misc_feature: GYAE6OF01DUVVV.15.86.H09.1.454.CMB.1.raw
tcagtctacgtagccacgaccggtgctcgatttagtgctatagactttgggtttggggggagaggagccccagccttgggatccccaagtgttttcattcagtgatcaggactgaacacagagacctcaccatcggagttcgggctgagtcgttgggtttttcctgctgtcttagttacttaaaggtcgtccagttgtagaaggtgcgagggtggtggaggtcggtgggggacgtccgttaggaaacggtccgggttcgggggttacccttaggacgttcctcgttggtcgtcggtcctacgttgtacttcgtacgtttacaaggttagtggtcgtaggtagttagtacgggttacgggtcccgacgtacggccgtacgggaggggagggtcgtgggtagggttagggttaggtaaacgttaagaaaaacgttaagtagtagtaggtaagaaataaagtacgaacgtgtacgacgacgtaaggaaacgtaataccgttaccaaccgtagttaccgaacgtaagtaagtaagttaaccgttaaacggtaaacggtcggtttaagtttagttaaccgaataacgtaacggaacacgggtaaccgaaacgggtaaccgaaggtaccaacgtaacgtccttaacgttacttaaccgtaactaaccgtacgtaaccgttaggttaacgaagttcgagtaaaccgtacgggtaaacggtaaggcgttcttaaggttctttacgttaagtacgccgttaccgggacccggtaaggtacggtaagtccggttaacg

SEQ ID NO: 114020 - DNA, 826 bp, Homo sapiens
  misc_feature: GYAE6OF01AQA12.15.86.H09.1.454.CMB.1.raw
tcagtctacgtagccacgaccggtgctcgattttagtgctatagacttgggtttggggggagagggagccccagccttgggatccccaagttgttttcattcagtgatcaggactgaacacagaggactccaccatggagttcgggctggagtcgttgggtttttccttgctcgtactattacgttaaagtgtacctagtgtagagtgcgtagggtggtggagtcggtgggggatccgttaggtaacgtccggtcgggggttaccttaggcttccgtccttggtgtcggtcctcgtggttacttacgttacgtttcgaagttaacgtggtcgttaggagtaggtaggtttccggggcccgtaccggacggtccgtaacccggtaaggggggaaccgggtggtaggggtaagggtttacggggttaggttaaccgtttaaacgaaaaaggttaaaagtggtaacggtagggtaagaaacgttaaaagtacggtaccgttaacggacgtacccgaaacggtaaggaaaacgtagtaacccttacaaccgattaaccgagaaacgtaagtaacgttaaaccttaaacggaaaacgggtttcggtaatttaacgttacgaaactaaacttacgaaaagtccggtaaaccgtaaacgggaaaccctaggaaccctaagcccgttactaacttaactagaaccgttaacgcgtaagttaccggtaaggacgtcgaccaaagggtacggaaacgttaagggcttcggtaagttctttgtaagaccggttacgtacggacccggggacccgttaaggccgttagggttacccgg

SEQ ID NO: 114021 - DNA, 765 bp, Homo sapiens
  misc_feature: GYAE6OF01ARKN2.15.86.H09.1.454.CMB.1.raw
  modified_base (182)..(182): a, c, t, g, unknown or other
  misc_feature (182)..(182): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagcttgggttttccttgctgctatcttaaaaggtntccagtgtgaagtgcaggtggtggagtcgtgggggagccgttggtaaagccggtgggggtacccttaggagtctcctgtggtggcctctggtattcactttcagtaatggctggatggtaggtcggggtcccgccgtaggtcctaccggagggggaacggggcgtagggaggttggggtttacgggtaacggttttaaacgaaaaaaggttaaaaagtggtaagttagggtacgtaaaggaaaagttaggtaaccgtaacggtcgaccgaacccggtaaggaaaagggtaataacttaccaaacctatacctaacgaaaggagtaacgttaaacttaaacggaaaaaccgggttaggttaagttagtttacgaaacgtaaaagtgaaaacctacggaccgtaaaccgaaaacccggagaaacccacgtaacgtcccgtaacttaacgttccgaacgtaccaactagtacgttacggaagtcgataacgtacggaaaaccggtaaaggaccgtcgtaagttcggttatttacggtaatacggttaaccgggcggggaacccgagggtaaccctgggttaccggg

SEQ ID NO: 114022 - DNA, 824 bp, Homo sapiens
  misc_feature: GYAE6OF01B9UZ6.15.86.H09.1.454.CMB.1.raw
  modified_base (372)..(372): a, c, t, g, unknown or other
  misc_feature (372)..(372): n is a, c, g, or t
  modified_base (471)..(471): a, c, t, g, unknown or other
  misc_feature (471)..(471): n is a, c, g, or t
  modified_base (806)..(806): a, c, t, g, unknown or other
  misc_feature (806)..(806): n is a, c, g, or t
tcagtctacgtagccacgaccggtgctcgatttagtgctatagacttgggtttggggggagaggagccccagccttgggatccccaagtgttttcattcagtgatcaggactgaacacagagactcacagtggagttcgggctagagtcgttgggttttcctgtctgtaccttaattaacgtttaaaaggtcgtaccgtaagttggtaggaagttcgaggtagggttggtggtacggttacggtgggggaacgttaccgttaagggtaaacggtcccgggttacgggggttacccttaggacgttctccgtaggtacggacctccgttacgtaggtactttacgttaactttcgaaagttggacgtgtaggngttaggttacggttcggcccgacggacggtaccgtaccggggaaggggacggtggtaagggtggtttcgggtaagtaacgtttaaagaaaaagttaagngtaaggtaggtaagaaagtaaacgtggtaacgtacggtacgaccgtaacggtaaaggaaacgtatacgtaccaacgtactaacgtagaaagtaagtaaacttaacggtaaaaccggtaaaaggtcggtttaattaaacgttacgaaacgtaaacgtaaataccggtaacgtaccggaaaacggaaaacggttacgaaccctaacgtacggttacctaaattaacttcggaccctttaaacgacgttaagtacggtactaggcaaaggtacgtcgaaaagggataccgttaggtatttacgttagttacgagttacccggtcgaaccgggtaaccnggtaacccgttagtcggg

SEQ ID NO: 114023 - DNA, 707 bp, Homo sapiens
  misc_feature: GYAE6OF01CZAWU.15.86.H09.1.454.CMB.1.raw
  modified_base (215)..(215): a, c, t, g, unknown or other
  misc_feature (215)..(215): n is a, c, g, or t
  modified_base (362)..(362): a, c, t, g, unknown or other
  misc_feature (362)..(362): n is a, c, g, or t
  modified_base (589)..(589): a, c, t, g, unknown or other
  misc_feature (589)..(589): n is a, c, g, or t
  modified_base (626)..(626): a, c, t, g, unknown or other
  misc_feature (626)..(626): n is a, c, g, or t
  modified_base (633)..(633): a, c, t, g, unknown or other
  misc_feature (633)..(633): n is a, c, g, or t
tcagtctacgtagccacgaccggtgctcgatttagtgctatagacttgggtttgggggggagaggacgccccagccttgggatccccaagtgttttcattcagtgatcaggactgaacacaagacgactcaccagtggtaggtcgggctgagtcgttcgggttttcctggctgtcttacttaacgttaaaggtgtacctaggtagtagaggtcgngagggtgggtcggtaggtcgggtggggtacgtccggttagggtaacggtccggggtcggggttcccttagtcgtctccgtgtcggtcggtcctgtgtacttctacgttacgaagtacgtggtcgtaggtagtaggtgggtcggcccnggcgggtaccgacggggaggggaccggggtgtacggggtaggttgggtacggttaacgttaaacgaaaagtaaagtagaggtaaggtaagaaagtaactaggtacgacgccgtaacgaacggtaagaaggaatcgtaacacaactacaacgaaagtaagaataaacgtaacggaaagttacgttagtaacttagaactaagacgtaacgacgaacgtaacggaaacngaacacgacgtctaatctaacgactaccgagtaacgngttacgngtacgacacgtaggaaaccgtagtacgtatgtagttcgttcgtagaccggtcggacggagtacggatggttccg

SEQ ID NO: 114024 - DNA, 841 bp, Homo sapiens
  misc_feature: GYAE6OF01BLHXR.15.86.H09.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
  modified_base (321)..(321): a, c, t, g, unknown or other
  misc_feature (321)..(321): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagcgttggttttccttgctgctatacgttaaaggtntccagtgtgagtgngagggtggtggagtcggtggggagtccgttaggtaacggtccggtcgggggttacccttaggacgttccgtcgttgtcggtcggtcctcgtggtacttacctactttcaagttagtggtactaggntggtaggttcggggcccgccgacggtccgtaccgggaggggacggggcgttgggtagggttggggttaggttaaccgtttaaagaaaagttaaaagtggtaagttaggtaaggtaaagtaaaagtacgtacggtacggtacgtacccggtaacccggtaaaggaaacgaagttacttacccgtaacctacttacgtaacgaaaggtaactaaagttaaacgtaaaccggtaaaacgggttacggttagtttaacgtttagaactaaagtacgaaacgtaccgaaccgaaacggtaaaaccggagaacccgtacgtaccggtacccgtttaacttagttaaccgtaaccgttaaccaacggtaggttaaccgttacgggaagtaccgtaacgtaccgtaaagggtaaacggtaacggggttacgttaacgtttaggtttccggtttaacggtttcgttacggttacccgggtttaccggggtacgggaaccccgggtagggtaacccggttagggttccgg

SEQ ID NO: 114025 - DNA, 863 bp, Homo sapiens
  misc_feature: GYAE6OF01D5UJ1.15.86.H09.1.454.CMB.1.raw
tcagtctacgtagccacgaccggtgctcgatttagtgctatagacttgggtttggggggaagaggaagactgacggtccccccaggagttcgggctgagctgggtttccttgctgctatcttaaaaggtgtccagtgtgaagtgcaggtggtggagtcgtgggggagccttaggtaaacgccgtggggggtcccttagagtctcctgtgtcggcctcgtggtattccactttcagttaagtcggctggatggaggttcgggtcccgccgtaggcctaccggaggggaacggggcgtgggaggttggggttggtaacgttttaacgaaaaagttaaaatggtagtaggtagaaagaaaatagactaggtcgccgaaccggtagaaacggagtacttacgactatcgtacgaagtaagtaattaaacttaacgaaaaacggtcggtagttaagtttcgaactaaagttacgaacgtaacggtaccgtaaacgaaaaaccgaggtaccgaaccgtacgtacccgtacttaacgttaacgttcgtaaccgacgtaagtacgttacgggaacgttcgacgtaaacgtaccggtaaacgggtaaaggtacgggtactttagttaccgttagttttaacggaagtttaccggttacggtacccgggggtaacccgtacggggtaaaccgtaggttacccgggtttacgttccgggttaccctttacccggttaccgacccttccccggtaacccgtaacccggtaaccccgggggtacccttccgggttaccccggtttccccccttaccccccggtacggtaaccccccttacccccgttaccctaaacccggtacggtaacccccggg

SEQ ID NO: 114026 - DNA, 746 bp, Homo sapiens
  misc_feature: GYAE6OF01AM97H.15.86.H09.1.454.CMB.1.raw
  modified_base (569)..(569): a, c, t, g, unknown or other
  misc_feature (569)..(569): n is a, c, g, or t
  modified_base (604)..(604): a, c, t, g, unknown or other
  misc_feature (604)..(604): n is a, c, g, or t
  modified_base (609)..(609): a, c, t, g, unknown or other
  misc_feature (609)..(609): n is a, c, g, or t
  modified_base (613)..(613): a, c, t, g, unknown or other
  misc_feature (613)..(613): n is a, c, g, or t
  modified_base (678)..(678): a, c, t, g, unknown or other
  misc_feature (678)..(678): n is a, c, g, or t
  modified_base (708)..(708): a, c, t, g, unknown or other
  misc_feature (708)..(708): n is a, c, g, or t
  modified_base (727)..(727): a, c, t, g, unknown or other
  misc_feature (727)..(727): n is a, c, g, or t
tcagtctacgtagccacgaccggtgctcgatttagtgctatagacttgggtttgggggagctctgggagaggacgccccagccgttgggactccccaagttgtttcattcagtgatcgaggactagaaccacgagaggactccaacaggtgggtacggttcgggctcggaggtcggtttcgggttttcctggcttcggtacttaagttacgttaaaggtcgtactggtagtaggagtggacggtgggtggtaggtggtcgggtacggggtactacggttaagggtaccggtcccggggttcggggggttacctaggtcgttccgttccgttggtcggtaccgtcgttacggtaggtaccttccgttacttagtaacggtaagtcggtaggtcggtaggttaggtcggttccggccgtaccggtcgggccggtaacggggacggggtaggtccggttagggttaggggttcggttaaaggtaaacgttaaagaaaaaggtagtaggaggtaacgtaagaaagtacgtagcgtacggacggaaccgaagtaagaacggtactctacgactnacgtagaataagtaacaagtaagacggtatagtanagaanaganacgaaccagaaccgtaagacgactacgtacgaacttcaacgtcctaacgacgtaagacgtaccgngataccgagtacggaaccgtaaggacgttnacgttgtacgttacgtaancgtcgggagtccggtaacg

SEQ ID NO: 114027 - DNA, 959 bp, Homo sapiens
  misc_feature: GYAE6OF01BD119.15.86.H09.1.454.CMB.1.raw
  modified_base (200)..(200): a, c, t, g, unknown or other
  misc_feature (200)..(200): n is a, c, g, or t
tcagtctacgtagccacgaccggtgctcgatttagtgctatagacttgggtttgggggggagaggagccccagccttgggactccccaagtgttttcattcagtgatcaggactgaacacagaggactcaccatggagttcgggctgagcgttgggttttcctgctgctatacgttaaaggtgtacctagtgtgaagtgngtaggtggtggaggtcgtggggtacgtccgttagggtaacggcccggttcgggggtaccgttaggtacgttcctccgtgtggtcgtccgttcgtggtacttctacgtttacgagttagtggcgttaggtagtggtacggttcgggtacccgtccgacggtccggtaaccgggtaacgggggaacggggtcggtagggtgggttacggggttacggttaacggtttaaaacggtaaaaaaggttaaaagtacggtaaggtagggtaaaggtaaaggtaaaaggtaaccgtaaccggttaaccgggtacggtaacccgtaaacccgggtaaaggttaaaacgggtaaacgttaaccgtaaccgtaaaccgttacgtaaccgttaaacgaaacgtaaacgtaaacgttaaaacgttaaaacccgtaaaacggggttaccgtttaaggtttaacgttaaaccgtaaagtaaaacgttaccggaaaacgtacgggtaaacccgaaaacccggttaaaagggaccgtaacctaaccgttaaccccgtgtttaaactagttaaacccgttacgaaacccgtacggtaaggttaaacccttaaggggtaacgaccttaaacggtaaacgtacccggggttaaaaacggtaagggacccttcgtaacggtttaacccggtttagtttaccggaaccggttttaacgggtcccgggaaaaccccgggggttaaccgtaagggttaaccgtaaaggggttttccccgggg

SEQ ID NO: 114028 - DNA, 879 bp, Homo sapiens
  misc_feature: GYAE6OF01BFM9S.15.86.H09.1.454.CMB.1.raw
  modified_base (775)..(775): a, c, t, g, unknown or other
  misc_feature (775)..(775): n is a, c, g, or t
tcagtctacgtagccacgaccggtgctcgatttagtgctatagacttgggtttgggggggagaggagccccagccttgggatccccaagtgttttcattcagtgatcaggactgaacacgagaggactcaccagtggagttcgggctgagcttggttttcctgctgcttatacttaaaggtcgtccagtgtagaagtgcgaggtggtggagtcggtgggggacgtccgttagggtaaacgtccgggttacgggggttacccttaaggtacggttccgttccgttgggttcggttccgggtccccttggttacggtactttacgttaacgttttaccgtaaggtttaacgtgggtaccgttaggtagttgggttacggttccggggtacccgaccggtacgggtccccgtaaccgggggtaagggggtaacggggtcggttagggggtacgggtttcgggggttaacgggttaaccgttttaaaacggtaaaaaaggttaaaaaggtcggtaagggttacgggtaaggtaaaacggtaaaagtacggtaaccggttaaccggtcgaacccggaaccggttaaggaaaacgggtacgttaaccgtaccaacgtactacccgtaaaggaagtaaacgtaacgttaaacgttaacgaaaacggttcgttagttactagaaactaagagaccgaacggtaactaacggaaaccgacgaacaccgagttacccgattaaccgtacgtacctacccgtagtaagttaccggtagtaaccggntaacgaacgttacgggaaacgtaaaggttgtaccgttagttaccgtttcggttagacgttaccggttcgggaacccgggtagtaaacgtggttaaggtcccggg

SEQ ID NO: 114029 - DNA, 717 bp, Homo sapiens
  misc_feature: GYAE6OF01AQ2AA.15.86.H09.1.454.CMB.1.raw
  modified_base (284)..(284): a, c, t, g, unknown or other
  misc_feature (284)..(284): n is a, c, g, or t
  modified_base (421)..(421): a, c, t, g, unknown or other
  misc_feature (421)..(421): n is a, c, g, or t
  modified_base (460)..(460): a, c, t, g, unknown or other
  misc_feature (460)..(460): n is a, c, g, or t
tcagtctacgtagccacgaccggtgctcgatttagtgctatagacttgggtttgggggggagaggagccccagcccttgggatccccaagtgtttcattcagtgatcaggactgaacacagaggactcaccatggagttcgggctgagcgttggtttccttgcctgctatacttaaaggtctccgagtgtgaagtgacgaggtcggtggagtcggtggggatcgtaggtaacgccggtcggggtcctagacgtctaccgtgtgtcggccgtctggtattccgtntttacagttaagtggacgtggtagtggtaggttccgggtcccgcgtacggtccgtaccggaggggtaacggggtgtgggtaggttgggttacggacgttttaaacgaaaaaggtaaacgtagtagtagacggtaaanaaagtcgtaaccgtacgtcgaacgtacgtaggaaagtanacttcactagtacctaagaatacgtataaacgtaactaaaacgcggttattaagtacggtaacgaaagttagaaacgtaaccgacgtaaacaaacgggtacaacgtacgtccggaacttactaacgttacgtactacggtaactaaggtaacgttaactaacggtaccgaatacccgagggtaacgtaacggaaagtccttaagcgtttactttacggattacgtacggtacgaccggaacgtagtccgggttaacg

SEQ ID NO: 114030 - DNA, 840 bp, Homo sapiens
  misc_feature: GYAE6OF01BCBEE.15.86.H09.1.454.CMB.1.raw
  modified_base (744)..(744): a, c, t, g, unknown or other
  misc_feature (744)..(744): n is a, c, g, or t
tcagtctacgtagccacgaccggtgctcgatttagtgctatagacttgggtttgggggggagaggagccccagccttgggatcccccaagttgttttcattcagtgatcaggactgaacacagaggacctcaccagtggagttcgggctgagcgttggttttccttgctgctatacgttaaaggtcgtcctagtgtagagtgcgaggtggtggtagtcggtggggacgtccgtagggtaaacgtccgggtcggggttaccctaggacgttccgttccgtggttcggtaccggtcccttcgtacggtactttcctaccgttttacgaagttaagtggtacgtaggtagtggttacggttccggcccgtcgacggtccgtaccgggaggggaggggtcgtagggtacggggttgggtttacggtaacggtttaaacgtaaaaaggttaaaataggtaagtagggtaagtaaaacggtaaagtaacggtacggttaacggtacgaacccggaaccggtaaaggaaaacggtaacgtacttacccaactacttacgtaaacgtaagaaacgttaacgttaaacgtaaaaccggtaaacggggttaccttttagggttaactttaaccggtaaataaaaaccggcgtaaaaccggaccgtaaaccaaaccggggtaaaacgaccaaccgtactacggttaccgttactaacgttaccgaacgttacaacgtagttagggtaccgagttnaccgtaacggtaaagggtaaccgtaagggtcctaaagttacgttcgtactttggaaccctagggtcggtccggtaaccggagtacggttaggtccg

SEQ ID NO: 114031 - DNA, 878 bp, Homo sapiens
  misc_feature: GYAE6OF01BIXFL.15.86.H09.1.454.CMB.1.raw
  modified_base (307)..(307): a, c, t, g, unknown or other
  misc_feature (307)..(307): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatacttaaaggtcgtccagtgtgaagtgcaggtggtggagtcggtggggagtccgttaggtaaacgtccggtcgggggttccccttagacgttcctccgtggtggtcggccctgtggtacttcctactttacgagttaagnggtcgtggagttggtaggttcgggtcccgccgacggtccgtaccggaagggggaagggggcgtaggggtacgggttggggtttacggtaacggttttaacgaaaaaaggttaaaaagtagtaagttagggtaagtaaagtaaaagtacgaacgtacggtacggaccctaaacccgggtaagaaaagggtaaacgtaacgttacccgaaacctattacccgtaacaaaggtaaacgtaaactttaaaagttaaaccggaaaaaaccggttacgggtttaagtttaacgttttaagaaacctaaaagtaacggaaaaccgtaccggaacccggtaaaacggaaaacccggaacgggtaaccaaaccgacggttacccgtaatttaaccgttaacgtacccttaaccggaacgtaacgtaaccgttaacggaacggtaccaacgtaacggtaaccgggtaaaaccgggttaagggaacggttacgttaagttagtttcccgttttaagaaccggtttaacgttcgggggtacccgggtaaccggaaacggggtaccgttaaagggttcccgggg

SEQ ID NO: 114032 - DNA, 860 bp, Homo sapiens
  misc_feature: GYAE6OF01C7XDB.15.86.H09.1.454.CMB.1.raw
  modified_base (147)..(147): a, c, t, g, unknown or other
  misc_feature (147)..(147): n is a, c, g, or t
  modified_base (211)..(211): a, c, t, g, unknown or other
  misc_feature (211)..(211): n is a, c, g, or t
tcagtctacgtagccacgaccggtgctcgatttagtgctatagacttggggtttggggtccactgggcagtctcgaatagagctcttggaagtccctccaaccatggcctgggtctccttctacctactcgtcccttcatttttccnccaactaggtccttctgtcgctctcggcctgtcgcgttcgaccttccgacccggtcccccgttnacgtctacttccgttcgtccttcggacgtgggaccgtcctcgtaactacgaacgtcctctaccgtcgaacctaaccggttaaggtagacgaccgactaccgtaccgaacctaccactacgtacgtaactacggtaactacgaacgaacggtaccggaaccggtaccgggtaaccccgttaccctaaagttaacgtaaagttaaacggttaaaggtaaaacggttaaggtacggtaagtacggtacggacgaaccgaaccggaaccgggaaccggggaacggggtaaccgtacccggtaccgtacgttaccggtaccgttaccggtacggttaccggtaccgttacggtccggtttacgggtccggtaccggttaacccggaccctttaccgtacccgtaccctaaccttaacccgtacccctaaccccgtactccggtaacgtaccgtaacggtacggtacgtacgcggttacgtacggtactacgtacgtcggtaaggtacggacggtaaccaacgtacaacgttaagtacgtaacggtcggtacggtacccgggttaaggttccggggttaccggggtacgggaccgggtaacgggaacccgaggtacccgtccggaccgtacggtacgtacccggtcggtaacccg

SEQ ID NO: 114033 - DNA, 755 bp, Homo sapiens
  misc_feature: GYAE6OF01D0WWU.15.86.H09.1.454.CMB.1.raw
  modified_base (177)..(177): a, c, t, g, unknown or other
  misc_feature (177)..(177): n is a, c, g, or t
tcagtctacgtagccacgaccggtgctcgatttagtgctatagacttgggtttgggggagaggagccccagccttgggatccccaagtgttttcattcagtgatcagactgaacacagagactcaccatggagttcgggctgagcgttgggttttcctgctgctatacgttaaaggntacagtgtagagtgcgtaggtggtggagtcggtggggacgtccgttaggaacgtccggtggggtcctagacgtctcgtgtgtcgcctgtgtattctacttgaagtagtgactaggagtaggtcgttcggcccgcgtacgccgtaccggaggggacgggtcgtagggaggttcggggtagtacgttaaacgaaaagtaaagtggagtgggaagaaacgaaagtacgtacgttacggcgtaccgtaaccggtaaaggtaaagtacgttactaaccaccggtaactttcgaaacgaaaggtaaacgtaaagttaaaccgtaaacggtaaaaaccggtggtttaagttaaacttacgggaaattaaacgacgaaacgtaacgtacggtaaaacaaacccggaggtaaaccaccgtaacgttaaccgttcttaagttaacctaaccgtaacccgagttacgtaacgttacggaacgtagaaccggtaagacccgggtaaacggtaaggtaccgtaagtttgttaacgttgttacgatttcggggccggttaacggggacccctaagggtccaagggtttcggg

SEQ ID NO: 114034 - DNA, 868 bp, Homo sapiens
  misc_feature: GYAE6OF01B3VBW.15.86.H09.1.454.CMB.1.raw
tcagtctacgtagccacgaccggtgctcgatttagtgctatagacttgggttgggggggagaggagccccagccttgggatccccgaagtgtttcattcagtgatcaggactgaacacgagaggactcaccagtggagttcgggctgagctggtttcctgctgctatacgtaaaaggtgtccaagtgtgaagtgcgaggtggtggaggtcggtaggggagtccgttaggtaaacgtccggtggggggtacccttaggacgttcgtccgtaggtcgtcggtccgtcgtggtacttccgtaaccgttttacgaagttaaagtcggtcgtaggtaagttacggtacggttcggggtacccgaccgtacgggtcccgttaccggggaagggggaacggggtaccgtagggtaaggttacggggtttacggtaaccgtttttaaacggaaaaaaggttaaaaaacgttaggtaaggtaggggttaagaaaacggtaaaaaagtaccggtaaaccggtaacgggtaccgaaccggtaaaccccggtaagggtaaaaacgggaacgttaacgttaccgaaccgtaagttaccgtaaacaaaggtaagtaaacgtaaacgttaacgaaaacggtacgttaggtaatttacgggaaataaacgtacggaacgtaacgtacggacccgtaaacggaaaaccgtacgaaccgaacgtacgtaccggttactaacgtttaaccacgttacccgaatacggttagttaccggaagtccgaacgtacgacggtaaacggtaaacgggagtactagttcggttaccgtttaggaacccgttacgtacccgggttagggaaccccaaggggtaacttaccgggg

SEQ ID NO: 114035 - DNA, 884 bp, Homo sapiens
  misc_feature: GYAE6OF01D5D3A.15.86.H09.1.454.CMB.1.raw
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagtcttggttttccttgctgctatacttaaaaggtgtaccagtgtagaagtgcaggtggtggagtcgtggggactccgttaggtaacgccggtcgggggtcccttaggctctccgtgtgtcggcctgtgacttctacttnagtaagtggcgtaggatgtaggttcggccncgaggctacggaggggacgggcgtagggtaggttggggttacggtaacgtttaaacgaaaaaaggttaaaacgtggtaagttagggtaaacgtaaaaggtaaaaacgtaacggtaacgtaaccgggttccgaaacccggtaaacccgggttaaaggaaaaaacggtaaacgttaaacgttaccgaaaccctacttaacccgtaaacggaaaaggttaaataaaacgtttaaaacgttaaaacccggtaaaaaaaccgggttgggttttaagttaagttttaacgaaaaacgtaaacgttaacggaaaaccgaacccggtaaacccgtaaaacgggaaaaacccgacggaaacctaaccggaaccgttaacccggtttacttaaaaccgttacgttaacccgtaaacccgtaacgtaaagggttaccgtttaacgggaaagttcggaactaaaccgggtaacggaaaacgggttaagggcttaaccggttagttacggttttaccgtttaagaacgtttacgtacccgggggacccggtaacccggaagggtaaccttacgggttccggg

SEQ ID NO: 114036 - DNA, 735 bp, Homo sapiens
  misc_feature: GYAE6OF01D9CZJ.15.86.H09.1.454.CMB.1.raw
  modified_base (202)..(202): a, c, t, g, unknown or other
  misc_feature (202)..(202): n is a, c, g, or t
  modified_base (383)..(383): a, c, t, g, unknown or other
  misc_feature (383)..(383): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtgggttttcctgctgcttatacgttaaaaggtcgtaccagtgtagaacgtgagngggtggtaggacgtcggtagggggatccgttagggtaaacgccggtcgggggttcccttaaggcgtctcgttgtggtcggtacctcgtggtattactactttcgaaggttaatccggcttaggaacgttggtaaggtttccggtccgcccgtaggcccgttaccggaggggaccgggtcgngggttaacggtgggttaccggtaagtttacaaaaacggtaagtacgtagtagggtataaagggaccctaaagtcgtaccggattacccgtaacgtaaggtaagggtacccaaggtttaacccaagtccgttaaactacgtaagtaagtaacgtaacgtaacgtaacgtacgtacgtacgtacgtacgtacgtacgtacgtacgtacgtacgtaacgtaacgtacgtttacgtacgtacgtaacgtacgtacgtacgtacgtacgtacgtacgtacgtagtacgacgacgtacgacgagtacgtcgtagtacgtacgtacgtacgtcgtacgtacgtagtacgtcgtcgtacg

SEQ ID NO: 114037 - DNA, 883 bp, Homo sapiens
  misc_feature: GYAE6OF01CGO0H.15.86.H09.1.454.CMB.1.raw
tcagtctacgtagccacgaccggtgctcgatttagtgctatagacttgggttgggggggagaggagccccagccttgggatccccaagtgttttcattcagtgatcaggactgaacacagaggactcaccagtggagttcgggctgagtcgttcgggttttcctgctgtctatacgttaaaggtgtccagtgtagacgtgcgaggtggtggtagtcggtggggacgtccgttaggtaacgtccggtcggggtacctagtacgtcttccgtggtgtcggcttcgtgtacttctaccgttagagttaacgtggtacgtaggacgttggtaacgggtttcgggcccgaccggtacggacgttaaccggggaggggtaacgggtcggttgggtaggttcggggttaagtaaccgtttaaacgaaaaagttaaagtaggtaaggtacggtaaaggaaagtaaaacgtgtaacggtaccggtacgtaaccgaaaccgggtaaggaaacggtaataaccttaccgaacctagttaacgaacgtaaagtaaacgtaaacttaaagtaaaacccgaaaagggttcgtttacgttaaagttaaacgaactaaaacggtaccgtaaacgaacgttaacccgggaaacggaaaacccggcgaaacgtaccgtaaaccgggttaccttaaaccggttttaactcgaaacccgtttaacgaaccgtaaaggtttaccggtaaagggtaacggtaccgttaaacgtaaccggtaaacgggtaaaccgggtaaagttacccggaacgtttacgttacggtttaacgtttaacggaattaccgggggttacccgggacccggtaaaggggtaaccttaacggggtaaccgtttcccgggg

SEQ ID NO: 114038 - DNA, 964 bp, Homo sapiens
  misc_feature: GYAE6OF01BWF44.15.86.H09.1.454.CMB.1.raw
tcagtctacgtagccacgaccggtgctcgatttagtgctatagacttggggtttgggggggagaggagccccagccttgggatccccaagtgttttcattcagtgatcaggactgaacacagaggactcaccatggagttcgggctgagcgtgggttttcctgctgctatacgttaaaggtgtccagtgtagaagtgcgtagggtggtaggtaggtcggtgggggacgtccgttagggtaaacggtcccggtggggggttcccttaaggacgtccgttccgttggttcggtcggtcctcgtggtactttctaccttttacgaagttaagtcggtacgtggtagtggtacgggttcgggtcccgccgtaggccgtaccggaggggggtaacggggtcgtaggggtagggttcgggggtttacggtaaccggttttaaacgaaaaaaggtttaaaaacgtggtaacggtttaggggtaaaggtaaaaggtaaaaacgtacggtaaccggtaacgggtacggtaacccgtaaacccgggttaaggaaaacggtaacgtaaccgttacccggaacctaagtaccgttaacgaaaggtaacggttaaactttaaacggttaaacccggaaaaaccggttaggggtttagtttaaacgtttacggaaaacttaaaggtaacccggaaacgtacccggtaacccgtaaaaccggaaaaaccggccggtaaaccaaccggtaacccggtttacccgttaaaccgtttacgttaacccgtaacggttaacccaaacgtttaacgggtaccgtttaacgggtaacgttcgtaaccgtacgggttaaaccgggtaaaacggggtaaacggtaggttacctttagttacgggttaccttttagggtaaaccctttcgggtaaccccgggtaccggggaacccgttaaaggggtaacccgtttaggggttacccggg

SEQ ID NO: 114039 - DNA, 786 bp, Homo sapiens
  misc_feature: GYAE6OF01BLBV2.15.86.H09.1.454.CMB.1.raw
  modified_base (143)..(143): a, c, t, g, unknown or other
  misc_feature (143)..(143): n is a, c, g, or t
  modified_base (189)..(189): a, c, t, g, unknown or other
  misc_feature (189)..(189): n is a, c, g, or t
  modified_base (264)..(264): a, c, t, g, unknown or other
  misc_feature (264)..(264): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcatttttcnccacaggtctctgtgctctcgccttgtgctgactcacgcccccgtntgcatctcgcctttgcgtgggacgcctcgtatcgaagccttaccaccgtgacctaacccgttaagtagtcggacncctacgtaccgaaccctaaccacctaacgtacgtaacgtaggttaactaccgaacgacggaacggaacccggtaacggggaacccctcccccgtaagttaattaacgtaattaacggtaaaaggttaacgaggtaggtacgtcggacgtacgaccgaaccgaaccgggtaacgggggaccggaccgtcccgacgtcgtaccttcggtagtccgggtcctccgttacgggttcggtacggggtaccttaccggtacccgtacccgttaaccctaccgtaaccctactaccccgttacccgtaacccgtcctacggtaccggtacaccggtaggtccggaacgtccgttagtacgttacgtcgacgttggacggaagtaccggactaccgaacgtaacgtagttacgaccggtacgtaccgtaaggggttacgggttcggggttacgggtacggggtacgggtaacccgggaaccggtacgtaccgggttacggtacccggtgttaaccggtccgtaacccggg

SEQ ID NO: 114040 - DNA, 894 bp, Homo sapiens
  misc_feature: GYAE6OF01AR03K.15.86.H09.1.454.CMB.1.raw
tcagtctacgtagccacgaccggtgctcgatttagtgctatagacttgggtttggggggaggaggagccccagccttgggatccccaagtgtttcattcagtgatcaggactgaacacagaggactcaccatggagttcgggctgagcgttgggttttcctgctgctatcgttaaaaggtgtccagtgtagaagtgcgtagggtggtggagtcgtgggggagtccgttaggaacggtccggttcgggggtacctaggtagtcgtccgtggtcggtcggtccgtcgtggtagttctacgtttcagttaagtggtacgtggagttggtaggttccgggtcccgccgtacggtaccgtaccggagggggaacgggggtcggtagggttaggggtcggggtttacgggtaaccggtttaaaggaaaaaaggtaaacgttggaagttagggtagaaagtaaaagtacggtaacgtaacgggtcgaaccgtaacccggaaggtaaaacgggtaacgtaacgttaccaaacccggtaacgttaccgtaaacggtaaagtaaacggttaaccttaaaagggtttaaaacccgaaaaacggggttaaccgttttagggttaacgttttaacggaaaacttaaaaacgggtacgaaaacccgttacggtaaaacccgtaaaccggggaaaacccgaaggtaaaccctcggtaaaccggtttaacccgtaaccgttaaacgtttacccccgtaaggttaccccgaaacgtttggaaaccggttttaaccggagtacctaacggtaacgtaggtaaaaaccgggaaagttacggaccgttttagcggtttaacgttcgaaagttcggttaacgggcccgggtacggagaaccgtttaccgggtcgg

SEQ ID NO: 114041 - DNA, 784 bp, Homo sapiens
  misc_feature: GYAE6OF01DKYVH.15.86.H09.1.454.CMB.1.raw
  modified_base (352)..(352): a, c, t, g, unknown or other
  misc_feature (352)..(352): n is a, c, g, or t
  modified_base (560)..(560): a, c, t, g, unknown or other
  misc_feature (560)..(560): n is a, c, g, or t
  modified_base (685)..(685): a, c, t, g, unknown or other
  misc_feature (685)..(685): n is a, c, g, or t
  modified_base (712)..(712): a, c, t, g, unknown or other
  misc_feature (712)..(712): n is a, c, g, or t
  modified_base (730)..(730): a, c, t, g, unknown or other
  misc_feature (730)..(730): n is a, c, g, or t
  modified_base (774)..(774): a, c, t, g, unknown or other
  misc_feature (774)..(774): n is a, c, g, or t
  modified_base (784)..(784): a, c, t, g, unknown or other
  misc_feature (784)..(784): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccagtggagttcgggctgacgtcgttggtttccttgctgacttaatagttaaaacggtgtacctgtgtagagtcggacgtaggggtggtggtaggtcggtcgggggtataccggttaagggtaaccggtccgggtacgggggtacccgttagtacggttccttccttgggtacgtccggtccctggttacggtactttacctatttacggaattaaggtcggtntaggtacgtcgggttacggttacgggcccgacggacggtaccgtacgggaaccggggtagggccgtaggggtacggttaggggtacggtaaacgtttaaacgaaaaagttaagacgttagtaagtaaggtaaaataaacgtcgttaaacgcggttacacccggtaaggtaaaggaaacggtaacgtacctacactacgtaacagaaanacgtaaataacgtaaacaaacggtgtaagttataagtaacaagtaccgaatacccgtactaacggaaacgcggtaaacctacgcgtacctaagtaactacgaccgtagaaccgtatacgttacgngtactaactaaccgaaggtaaaccggngtaaacgtctaaggtttnttaacgttacgtacgttacggtccgggaacgggtaagtaacggnttaacgggtn

SEQ ID NO: 114042 - DNA, 707 bp, Homo sapiens
  misc_feature: GYAE6OF01ECKZL.15.86.H09.1.454.CMB.1.raw
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
  modified_base (397)..(397): a, c, t, g, unknown or other
  misc_feature (397)..(397): n is a, c, g, or t
  modified_base (694)..(694): a, c, t, g, unknown or other
  misc_feature (694)..(694): n is a, c, g, or t
tcagtctacgtagccacgaccggtgctcgatttagtgctatagacttgggtttgggggggagaggagccccagccttgggatccccaagttgtttcattcagtgatcaggactgaacacagaggactcaccagtggagttcgggctggagtcgttggttttcctgcgtgctagtagttaaaggtgtacgtagtgtagagtgngnggtggtggtagtcggtggggngtcgttaggtacgtcggtcgggtccttagcgtctcgtgtgtcgtctcgtagtattctattcgagttagtcggtctaggagttggtacggttcgggtcccgacgtacgggcctacggggaaggggacgggtcggtgggtaggttcggttaagttaacgttaagaaaagttaanggtaacgtgtaagaaagtaagtacgtagtaccggtcgaaccgtaacggaagaaacgtacgtactaccgaactacgtactaagaaggtaactaacttaaaacggtaacgtaaaacgggttcgttaaagttacttaacgtaaacgtaaacgtacggaacctaaaccggtaccgtaaaccggaaccggataacccgaacgtacgtaccgttacttaacgtcctaagaccgtaagtacgtagtacggatcgatacgtagtagaacgttgtacttatgttactgacgttagtaccggtacgnggtaatcgtgtcg

SEQ ID NO: 114043 - DNA, 760 bp, Homo sapiens
  misc_feature: GYAE6OF01A3LGN.15.86.H09.1.454.CMB.1.raw
  modified_base (215)..(215): a, c, t, g, unknown or other
  misc_feature (215)..(215): n is a, c, g, or t
  modified_base (585)..(585): a, c, t, g, unknown or other
  misc_feature (585)..(585): n is a, c, g, or t
  modified_base (616)..(616): a, c, t, g, unknown or other
  misc_feature (616)..(616): n is a, c, g, or t
tcagtctacgtagccacgaccggtgctcgatttagtgctatagacttgggttggggggagaggagccccagccttgggatccccaagtgttttcattcagtgatcaggactgaacacagagactcaccatggagttcggctgagctggtttccttgctgctatacttaaaacggtgtccgagtgtgaagtgcaggtggtggagtcgtgggggacnccgttaggtaaacggtccggttcggggggttaccccttaggacgttaccgtccgttggtaggtcggtccgttcgtaggtactttacgacgttttacgaaggttaagttcggtccgttaggattggtaaggtttccgggtacccgaccgtacgggtccttacccggaagggggtaacggggtcgttacgggtaggttaggggttacggtacgttttaaacgaaaaaagttaaaaacgtgtaacggtaggtagtaaaacggtaaaagtaacggttaccgtaacgggtcgaccgtaacccggtaagaaaacggagtacttaccgacctatactacgaagacgaattaactacgaaaagtcggtatatcgtaanaaagtacgaacgacctaccgaacgtaaacgngtaactaccgagacccgttactagtacctacgaaccgatagtacgtaacgaggtcgatacgtacgtaaacggtacggacgtacgttatacggttcgttagattaccgtacggttacccggacccggttaggacgtagtaccggg

SEQ ID NO: 114044 - DNA, 790 bp, Homo sapiens
  misc_feature: GYAE6OF01BJAXE.15.86.H09.1.454.CMB.1.raw
  modified_base (189)..(189): a, c, t, g, unknown or other
  misc_feature (189)..(189): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcatttctccacaggtctctgtgctctgtcctgtgctagactcaccgtcccccgtntcgctacttcgtcgtccgttcggcgtacggggaccgtcccgtacgtaacttaccgaaacgtccctacctacccgttcggacccctaaaccccgttaaaggttcgacgacggtactaaccgtaacccgtaaccctaaccaccgtaacgtacgtaagtacgtacaacgaaccgaacggaaccgaaccggaaccggtaaccctacccgtaagtaactaagtaacgtaaggtaaaggtaagtagtagagtcgacgaccgaccgaacggacgggaacgggaccgtaccgaccgtacgtcgtcgtacgtacgtcgtccgtacggtcggttcgggtcggtccgtaccgtacccgtacctacccgtacctacctaccgtaccctacccgtaacccgtaccgtacgtaccgtacggtacgtacggtacggtacgtacgtacgtacgtacgtacgtcgtaggtaacgacggaccgtaccgtaaccaacgtacgtacgtacggtacggtaccggtacgggtacgggttacgggtacgggtacgggtaccggggtacggtaccggtacggtacggtaccggtaccgtaccggtacgtacggtccggtacccgg

SEQ ID NO: 114045 - DNA, 944 bp, Homo sapiens
  misc_feature: GYAE6OF01E5F7X.15.86.H09.1.454.CMB.1.raw
  modified_base (884)..(884): a, c, t, g, unknown or other
  misc_feature (884)..(884): n is a, c, g, or t
tcagtctacgtagccacgaccggtgctcgatttagtgctatagacttgggtttggggggggagaggagccccagccttgggatccccaagtgtttcattcagtgatcaggactgaacacagaggacctcaccatgggagttcgggctaggagtcgttgggttttcccttggctgacttattaacgttaaaaggtcgtaccgagtggtaggtagtgcgagggtggtggtacggtcggtcgggggactccggttaagggtaaacggtccgggtacgggggttaccttaggtacgtctccggttggtcggtacggtcctgtggtacttacctacgtttacgaagtaagtcgtacgtagggtacgtaggtcgggtttccggggcccgtaccggacgggtaccgtacggggtaacggggggtaacggggtcgggtagggtacggggttagggggttaacggttaaccggtttaaaacggtaaaaaaggttaaagttaggtaaggttacgggtaaaggtaaaacgttaaaacggtacggtaaccggtacggtaccggaccgttaaaacccgggaaggtaaaaggtaaccgttaacttaccgaactacctacgtaaaccgaagaacgttaaacttaaacggtaaaccggtaaaacggttggtttaaactacgtttacgaaaagttaaccggtaacccgtacgaaaccggttacccggtaaacgggaaacccgggtacgaaacccgtaccgggtaaccgttaccgttaaccgggttaactacccgggttaaacccgtaactaaccgggtaaggttaaccggttaaggtaaccggtacgtaacgtaacggaacggggttaaaccgaaggtacggtaccttagttaaccgtttnttaacgggttaccgtaccgtagggtacccggtaacggtccggtaagtcgggtttaccggg

SEQ ID NO: 114046 - DNA, 839 bp, Homo sapiens
  misc_feature: GYAE6OF01ANPX5.15.86.H09.1.454.CMB.1.raw
  modified_base (148)..(148): a, c, t, g, unknown or other
  misc_feature (148)..(148): n is a, c, g, or t
  modified_base (780)..(780): a, c, t, g, unknown or other
  misc_feature (780)..(780): n is a, c, g, or t
tcagtctacgtagccacgaccggtgctcgatttagtgctatagacttggggtttgggggggagaggagccccagccttgggatccccaagtgttttcattcagtgatcaggactgaacacagaggactcaccagtgggtagttcgggntggagtcgttggttttccttggtctgacttagtacgttaaaggtgtcctaggtgtaggagtgacgtagggtggtaggtacgtcggtagggggctaccggtttaggtaacggtccgggtacgggggttacccttaggacgttccgtcgttaggtgtcggtcccttgtggtactttcgtaactttacgtaggttaacgtggtaacgttgggtagttacggttacggggttccgggttccgaccggtaccggtaccgtacggggtaacggggtaacgggggtccggtagggtagggtttcggggtttaacgggttaacgtttaaacgtaaaaaaggttacgtaaggtacggttacgggtaagtaaagtaacggtacggtacggtacggtacgaaccggtaacggtaaaggaacggtatacctactaacgtgtaactagaagtaacgtaataacgttaacgaaacggtcgttaagtacttaagtaccgtaaagacgtacgtaacggtaacgtaacgaacggtacgaacgtaaccggcgtaacgtacttaactaccgtaataaccgtacgttagggtaacgttaggtacgtacgttaccgaaggttacggtaacgtaacggtcgtacgttacggttntaacgtttcgaaccggttacgttccggggtactacgggtaccggttaggtcgttccggg

SEQ ID NO: 114047 - DNA, 709 bp, Homo sapiens
  misc_feature: GYAE6OF01ANC9Q.15.86.H09.1.454.CMB.1.raw
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (392)..(392): a, c, t, g, unknown or other
  misc_feature (392)..(392): n is a, c, g, or t
  modified_base (470)..(470): a, c, t, g, unknown or other
  misc_feature (470)..(470): n is a, c, g, or t
  modified_base (482)..(482): a, c, t, g, unknown or other
  misc_feature (482)..(482): n is a, c, g, or t
  modified_base (534)..(534): a, c, t, g, unknown or other
  misc_feature (534)..(534): n is a, c, g, or t
  modified_base (581)..(581): a, c, t, g, unknown or other
  misc_feature (581)..(581): n is a, c, g, or t
  modified_base (660)..(660): a, c, t, g, unknown or other
  misc_feature (660)..(660): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtgggtttttccttgctgctatacttaaaaggtgtccagtgtgaagtgcgtaggtggtggaggtcgtggggagtccgttagggaacgtccggtcgggggtccttaaggngttccgtctggtgtcgggtcctacnggtattcctaactttcgagttaatggacgtggagtgtaggttcggtccggcgtaaggctccggaagggggacgggcgtagggacggtttggggttacggttacgtttaaanaaaaggttaaaaagtgagttgtacggaaagaaaataccgagttacggcacgtacggtaaggaaagtaagtacttaacnccgtaatccganaagaacgaattaaacgtaccaaaaagtcggtatattacactaataaggaacnggtaccaaggaaaccgaggtacaagcgtacgttaactgtacgtaacncccggaaataacgacttacggacgaccttagaacgtacggaaaccggtaaggtacgaacgtttgttactaaggtttttnaaaccgttaggtttcgaacccgggtacgtaacgtaaggtaggtacccgg

SEQ ID NO: 114048 - DNA, 970 bp, Homo sapiens
  misc_feature: GYAE6OF01DHJAE.15.86.H09.1.454.CMB.1.raw
  modified_base (200)..(200): a, c, t, g, unknown or other
  misc_feature (200)..(200): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcgttgggttttccttgctcgctatacgttaaaaggtgtccagtgtgtaagtgngaggtggtggagtcggtgggggagtccgttagggtaaacgtccggtcggggggtacccttaggtacgttcctccgttggtaggtcggtccgtgtggtacttccgtacttcgaaggttaagtcggtcggtaggtagtggttacgggttcgggtaccgccgtacggtccgtaccgggtaagggggaacgggggtcgtaggggtacgggttaggggttacggtaaccggtttaacgtaaaaaggttaaaagtggtaacggttagggaaggtaaagtaaaacgtaggtaaccgttaacggtacggtacccggtaacccgggtaaggaaaacgggtaacgttaaccgttaccctaaacccgttacgttaccgtaacggtaaacggttaaacgtaacgtttaaacgtttaaaaccggaaaaacccgggtttgggtttaacgtttaaaggtttaaccgaaacgttaaacggtaacggtaaacctacgggttaacccaaacgggtaaaacccgaacgggtaaccctaacggtaacccggtaccccggtttaaataaccgtttacccggtttaacgtaaaaccccgtagttaacgggtaacccgtttacggggttaaacgtccgggaacgttaccggtaaaccggggtaaacccgggtaaaaggggtaccggtactttaaaggggtttcgtttaacccgtttaggaccgtttaccggggttacccgggttaccccggggaacccggttaaagggtacccggttaacgggtttcccgggg

SEQ ID NO: 114049 - DNA, 888 bp, Homo sapiens
  misc_feature: GYAE6OF01BM2BF.15.86.H09.1.454.CMB.1.raw
  modified_base (662)..(662): a, c, t, g, unknown or other
  misc_feature (662)..(662): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccagtggagttcgggctgagtcttgggtttttccttgctgtacttattacgttaaaaggtcgtcctaaggtgtagaagtgcgtagggtggttggagttcggtgggggacgtccgtttagggtaaacggccggttggggggttacccttaggacgttcttccgtggttcggtacggtccttcgtacggtctttccgtacgttttacgaaggttaaacgtgggtccgttagggtagttgggtacgggtttcgggtacccggtccggaaggcccgttaccgggacggggggaaggggtcgtgggggtaggtttagggggttacggttaacggtttaaacgaaaaaaggttaaagtacgtaggttagggtaaggaaacgtaaagtagtacgtacggtcgacgtaaccggtaaggaaaggactacgtaccacgtaactcgtaacgaaagataacgttaaacgttaaacgaaaccgggttagttacgtttaattacgaataaagtacggaactaaccggtaacgtaaacggaaaaccggngtaaccgacgtaccgttcgtaaacctttagtcccggttagtaaccgacgtaccgtaggtttaccggaagttccgtaagaacgggttaaccggtaaagggtaaaaccgggtggttaaccttaaatttcccggggttttagtttaaacgggtttattacccgggttacccggggttacgggggtaaaccccgtaaaggggttaacccgtttaacgggggttcccgggg

SEQ ID NO: 114050 - DNA, 864 bp, Homo sapiens
  misc_feature: GYAE6OF01ATCH4.15.86.H09.1.454.CMB.1.raw
tcagtctacgtagccacgaccggtgctcgatttagtgctatagacttgggtttgggggagaggagccccagccttgggatccccaagttgttttcattcagtgatcagactgaacacagaggactcaccagtggtagttcgggctgacgtcgttgggttttccttgcgtgtacttacgttacgttaaaggtcgtacctagtagtagtaagtgacgtaggtggtggacgtcggtggggacgtcgttaggaacgtcggttcggggtccttagacgttcgtccgtgtcggtcgtccgttgttaggtacttccgttaacgtttcgtaaggttaacgttcggtacgttacgggattacgggttacggtttccgggtacccgtaccggtacggttaccggtaaccggggtaagggggtaacgggtacgggtagggtacgggttttacggggttacgggttaaaccgttttaaaacggaaaaacggtttaaaggtggtaacggttaggtaaacggtaaagtaaacggttaacgtaccggttaacggtacgtaaccggtaacgtaaaggtaaacggtacgttaaccgttacaactacgttaacaacggaagttaacgtaacgttaaacgtaaacgttaacggttacgttagttaacgtaagaaccttaacgaaggtaacaccgtaacgtaaccgaaacggtaaccacgttagaaccgttacttaagtaacttccgtaaaccgtcgtaacgttaccggtaacttcgggaactaccgtacgtaaacgtgggtaaaacgtaaggtccgagttaccgttgttaccgtttgaacgttcgtaccgggtaacgaccggtagttccgtaaccggtttcgg

SEQ ID NO: 114051 - DNA, 786 bp, Homo sapiens
  misc_feature: GYAE6OF01EW8CR.15.86.H09.1.454.CMB.1.raw
tcagtctacgtagccacgaccggtgctcgatttagtgctatagacttgggtttgggggggagaggagcccccagcccttgggatccccaagttgttttcattcagtgatcaggactgaacacagagactcaccatggagttcggctgagcgttggttttcctgctgctatacgttaaagtgtcagtgtgaagtgcgaggtggtggtagtcgtggggagtccgttaggtaaacggtccggtgggggtacccttaggtacgttcctccggttgttggtcggtccttagtggtactttccgtacttttacgtaagttaacgtcggtactaggtataggtaggttcggtcccgacgtacggcgtaccggaggggaacgggtcgtagggtacggttggttaggtaaccgtttaaagaaaaagttaaaatggaacgttaggtaagtaaagtaaaagtagtaaccggtacggtacgacccgtaacgtaaggaaaggtagtactaccgaactactacgaacgaaagtaataaacgttaaacgttaaacgtaaaacgggtaccgttaagtttaacttaaggaactaaaacgtagtaaacgaccggtaccgtaaacggaaccgtaagaacccacgtaacgtacccgtattaacacgttacgtaacccaagtacgtacgtacggtaacgacgtaactacggtaacgtaaaccggtaagcgtttaactagtttacggttaacttaggtacgttacggttaccgggacgggtaacccgtaaaggacccgtaaggtccgg

SEQ ID NO: 114052 - DNA, 762 bp, Homo sapiens
  misc_feature: GYAE6OF01EHQTY.15.86.H09.1.454.CMB.1.raw
  modified_base (193)..(193): a, c, t, g, unknown or other
  misc_feature (193)..(193): n is a, c, g, or t
tcagtctacgtagccacgaccggtgctcgatttagtgctatagacttgggtttgggtccactgggcagtctcgaatagagctcttggaagtccctcaaccatggcctgggtctccttctacctactcgtcccttcattttctccacgaggtctctgtcgctctcgcctgtcgctgacctcgaccgtccccgtntcgactacttcgtcgtccttcgacgtcgggtaccgtcctacgaactaccaacgtcctaccgtaccgtcgacctaaccgttaagtgacgacacgtacgtaccgtaacctaccacgtacgtacgtaagtacgtacacgaacgacggaacgtaaccggacggtacccgtacccgtaagtaacttaagttaagtaaggtaaagtacgtaggtacgtacgtacgaacgaacgaccgtaaccggaacggggtaacgggtaccgtaccgtaccgtacgtacgtcgtacgtcggtcgtaccgtacggttacggtcggtcggtcgtaccgacgtacctccgtacctaccgtacctacccgtaccgtaccgtacgtacgtacgacgtagtacggtacgtacgtacgtacgtacgtactacgtacggtacgtaacgtacgacgtaaccgaccgtacgtaacgtagttacgtaacggtacgttaacggtacgggttcgggttacgggtacggttacgggacggtaaccggtaccggtacggtaccgttaccggaccggttaccgtacggaaccggtaccgg

SEQ ID NO: 114053 - DNA, 830 bp, Homo sapiens
  misc_feature: GYAE6OF01BDIJ2.15.86.H09.1.454.CMB.1.raw
  modified_base (750)..(750): a, c, t, g, unknown or other
  misc_feature (750)..(750): n is a, c, g, or t
tcagtctacgtagccacgaccggtgctcgatttagtgctatagacttgggtttgggggggagaggagccccagccttggatcccaagtgttttcattcagtgatcaggactgaacacagaggactcaccatggagttcggctgagctggttttccttgctgctatacgttaaaaggtgtccagttgtagaagtgcgaggtggtggaggtcgtgggggagtccgttagggtaaacgccggtgggggttacccttagagtctccgtgtcggtcgccttcgtggtactttctacgtttcgaagttaagtggcgtagggatggtagtttcggggccgccgaggccgtccggaaggggagggcgtagggtggtttggggttggtaaccgtttaaacgaaaaaggtaaaaagttggacgttagggtaagtaaagaaaaacgtacgtacggttaacggcggtaacccgaacccggttaagggaaaacggtaaggtaacttaaccgtaacgtaacttaccggtaactaaaggaaacgttaattaaaaccgttaaaccgaaaaacgggtacgttttaagttaacgttagtaaacaaagttaacggaactaaccggttaaccgtaaaaccgggaaacggtaaccgaacaaccggtagttccccttaacggtttacttccaaccgttaaccgaagtacggttaaccgtaggtaacgtcgtaacgtaaccggtcgggtaaaaaccggtaagggtaacggttnttaacggtttacgtttctttaaggctttacggtcccgggtacggggtaaccgtaaacggttaccggtacggtttccgggg

SEQ ID NO: 114054 - DNA, 728 bp, Homo sapiens
  misc_feature: GYAE6OF01A40CX.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcgttaaaaggtgtccagtgtgaagtgcaggtggtggagtcgtggggagtccgttaggtaaacgtccgtcgggggtcccttaggacgtctccgtggtggtcggcctcgtggtattcctactttcagttaatggtctggatgaggttcgggccgccgaggcgtaccgaggggaacgggggtcgtaggtaggttgggttaggtacgttttaacgaaaaagtaaaacgtgaagtggtagaagaaaatagacgtacggtagaccgtaacccggtagaaacgggtaagtacttaccaaccgtactcgtaacgaaaggtaagtaacttaaacgttaaccgaaaaacggtacggttagttaatttacggaactaaaagtacgaaaccgtacgaccctaaacgggaaaacccggagaaccgaaccgacgtacccgttagttaacttacgtaccgtaacccatacgtacgttacgaagtcgacacgtaccggtaaacggtaaggcggtacgtagttacggtcttttaggattacgtccggtacgggaccgtaggactaaggttcccggg

SEQ ID NO: 114055 - DNA, 772 bp, Homo sapiens
  misc_feature: GYAE6OF01D1V8W.15.86.H09.1.454.CMB.1.raw
  modified_base (281)..(281): a, c, t, g, unknown or other
  misc_feature (281)..(281): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttggttttccttgctgctatacgttaaaaggtgtccagtgtagaagtgcaggtggtggagtcgtggggagccgttaggtaagccgtgggggtcccttagagtcctctgtgtggcctgtggtattctactttanagttaagtcggcgtggtatggtacggttcggtcccgccgaggcctaccggaggggaacggggtcgtaggggtaggttggggtttacggtaaccgttttaacgaaaaaaggttaaaataggtaagtagggtaagaaagtaaaatacggtaaccgtacggtacgaccgtaaacccggtaaggaaaaggtaacgtacgttaccaacctactactaacgaaagaacgtaaattaactaaacgaaaaacggttcggttaagttacgtttaagaaacgtaaatacgaaacctacggaacccgtaagggaaaaccgaacgacccgaacgaccggtaccgttaacttagttaaccgtacgtaaccctaagtaggttacgttacgggaactacggtactaacgtaacggaaacggtaaagggacggtacttaaggttacgttcttttaagacgttaccggttccggtaccggggaccgaaacgggtacgtaggttccggg

SEQ ID NO: 114056 - DNA, 809 bp, Homo sapiens
  misc_feature: GYAE6OF01E094W.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtccagtgtgaagtgctaggtggtggagtcgtgggggacgccgtttagggtaaacgtccggtggggggttccccttaggagttccgtcccttggtcggtcggcctcgtggtatttccacttttcaagtaagtggcctaggatggtaggttgggtcccgaccgacgggccgtacccggaggggaagggggtcgtgggagggttgggttggtaacggtttaacgaaaaaggttaaaaagtgtaggtagggtagaaacgtaaaaagtacgacgtaacggtacgcgaacccggttaaggaaaacgaaagtactaccgacctaatacctaagaaagaagtaacttaaaacgttaacgaaaaaccggttcggtacgtaatttgaaacgtaaataacgaaagtaaccgtccgtaaacgaaaacccggtaaggtaccaacgtaccggtacccgtatttaacgttaaccgtacaaccgtacgtaacggtcgtttaaacgggaacgtacgtgtaaacggttaccggtaaaaccggggtaaaaggtaccggaaccgtttagtaacgttttgtttacgggaaatttaccggtaaccggggtccggggtaacccgaacggggtaaagtgggtttacccggg

SEQ ID NO: 114057 - DNA, 830 bp, Homo sapiens
  misc_feature: GYAE6OF01CLD23.15.86.H09.1.454.CMB.1.raw
  modified_base (775)..(775): a, c, t, g, unknown or other
  misc_feature (775)..(775): n is a, c, g, or t
tcagtctacgtagccacgaccggtgctcgatttagtgctatagactttgggtttgggggggagaggagccccagccttgggatccccaagtgtttttcattcagtgatcgaggactgaacacagagactcaccatggagttcgggctgagtcttgggttttccttgctgctattacgttaaaaggtgtcagtgtgaagtgcgaggtggtggagtcgtggggagtcgttagggtaacgccggtcgggggttcccttaggtacgtcttccgtggtcgtcggtcctcgtggtacttcctacttttcaacgttaagtggtcgtaggtagttggtaaggttcgggtcccgaccgtacggtccgtaccggagggggtaaggggtcgtagggtagggttcggggttaggtaaaccggttttaaacgaaaaaagttaaaagtggtaagttaggtaagaaaagtaaaacgtacggaacgttacggtacgtacccgaacccgggtaaaggaaacgggtaacgtaacttaccaaccgtactacgtaacgaaagtaacgtaaatttaacgtaaacgaaaaacggttacggttaagtttaagtttacgaaacttaaagaaccgtaaacgaccgtaaccgtaaacggaaacccgggtaagaacccgaacgtaacgtacccgtttaattaaccgtaaccgtacgtaaccctaacgtagttacggtacggacgttcgacgtacggtaacggtaaacggtaaacggtcgtaacttaggttattacgttttanacgtttacgggtacccgggtacggtacccggtaaaggtaccgtaacggtttcggg

SEQ ID NO: 114058 - DNA, 715 bp, Homo sapiens
  misc_feature: GYAE6OF01C376W.15.86.H09.1.454.CMB.1.raw
  modified_base (459)..(459): a, c, t, g, unknown or other
  misc_feature (459)..(459): n is a, c, g, or t
  modified_base (678)..(678): a, c, t, g, unknown or other
  misc_feature (678)..(678): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtagaagtgcgaggtggtggagtcgtgggggagtccttgggtaaagccgtgggggtccttagagtctcctgtgtggcctctggattcgtactttacagtaatggctggatgaggttcggcgcaggtctacggagggaagggctgggtaggtgggttacggtacgtttaacgaaaaaagtaaaagtgtaacgtgggtaagaagtaaaaagtacgacgtaacggtcgaccgtaaccggtaagaaaggaagtactacgacctatctaacgaaganaattaataacaaaaggtcgttaagtattacgaataaagtacgaaacgtaagtactaaacggaaaacccggtagaaccgtaacaccggtaaccgttaaccttacgtttaaccagttaaccccgaaagtacgtaaacggtcgttaaagacgtaacgtaaggtaccgaaaaccgggtaaaggacggttacgttaaggtctacggttttacaacggtttaacnccgggttacgggaaccctaagggacttaaaccggtgg

SEQ ID NO: 114059 - DNA, 721 bp, Homo sapiens
  misc_feature: GYAE6OF01A13RB.15.86.H09.1.454.CMB.1.raw
  modified_base (221)..(221): a, c, t, g, unknown or other
  misc_feature (221)..(221): n is a, c, g, or t
tcagtctacgtagccacgaccggtgctcgatttagtgctatagacttgggtttggggtccactgggcagtctcgaatagagctcttggaagtccctccaaccatggcctgggtctccttctaccctactgcccctttcattttcctccacaggtctcgtgtgctctgcctgtgctagactccacgccccccgtgtgctagtcgtcgccttgccgtgggacncctcgatcaagtcctactacctggacccaacccgtaaggtacgtgacgctacgtaccgaaaccctacacctagtacgtaagttggtacttaccaaagaggacgaaccggacgggtaacccctacccccgtagtaacgtataagtaagtaaagttacgagtgaacgtggacgtacgcccgtaacggaaccgggaacgggggaccggtaccgtcccgtatccgtacgttcgacggttcggaccttcggtaccggtttcgggtcgggtaccgaccggacccgtacgttacccacgtacccgctaccccgtacctacccgtacgtacgtcgacgtacggagttcggacgtcgtagtacgtacctcgtacggttaggacggaggtaccacggacctacgtaactagtcgtaacggggaaccgtagggggtacgggtcgggttacgggacgggtacccgggaaggtaccgacgtaccggtacggtaccgtccgtacggccgaccgg

SEQ ID NO: 114060 - DNA, 724 bp, Homo sapiens
  misc_feature: GYAE6OF01ESXDI.15.86.H09.1.454.CMB.1.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtcgctgactcacgcccccgtntgcatctgccttgcgtgggacncctagactacaagtcctaccaccgtcgaccctaacccgttaaggtagtgacgacctaacgttaccgaaacccttaaccacctacgtaaccgaagtacggtataccaaacgaagaacgaaccgaacgggaaccgtccccctaaggtaactaagtaagtaggtaaaacggtttaagagtagacgtcgacgacgaccgaaccgaaaccgggtaaggggggaaccggtaaccgtaccccggtaagtccgtaccgttcgtacgggtacgggtccgtccgttacggttccggtacggggtcctcggtacccgtccgttaccctaccgtacctactaccctacccgtaaccctaccgtacgtctacgtacggtacttacggacgtcggtaggtaacttacgtcgtacgtggtacgggagacgtaccgacacgtactaagtgacgtacgacgtaacggttcgggttcgggtcggtacgggcggacggacgacgtcgacggaccgttacgtacgcgtaacccgg

SEQ ID NO: 114061 - DNA, 845 bp, Homo sapiens
  misc_feature: GYAE6OF01A8BO2.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagacctcaccatggagttcgggctgagcgttgggtttttccttgctgcttatacttaaaggtcgtccagtgtagagtgcgaggtggtggagtcggtggggacgtccgttaggtaaacggccggttcggggggttacccttaggacgttccgttcccgttaggttcggtcggtcccgttggtcggtaactttcctaacttttcaaggttaagtcggtcgtaggtacgtggtacgggttcggtcccgaccgtacggccgtccggaagggggtaacggggcgttagggtaggttcggggttgggttaaacgttttaacgaaaaaagtaaagttgaagttaggtaacgaaaagtaaagtaacgtacggtacggtacgaccgtaaccggtaaggaaacggtaacgtacttaccaacctacgtacctaagaaacgtaagttaacttaaacttaaacggaaaacgtcggtttaaagttacgttagaaacgtaaagtacggaaacgaccgtaaccgaaacggtaaacccgaaggaaccctaacgaccgttaaccgttaacctttaacgtaccgtttaacctaaacccgaacgttacgttaacgttacgggaagtccgtaaacgtacggtaaacgggtaacggtaaaggtacggtacgttttaagttcggtttatttacggtagttacggttccgggacccgggtaacgtaacgggaacgttaggttcccgggg

SEQ ID NO: 114062 - DNA, 973 bp, Homo sapiens
  misc_feature: GYAE6OF01DAX1R.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagcttgggttttccttgctgctatacttaaaaggtgtccagtgtgaagtgcaggtggtggagtcgtgggggagccttaggaaacgccggtgggggtccttagcgtctcctgtgtcggtcctcgtggtacttctacttacgtaagttaagtcggtcttaggtacgttacggtacgttccggggtacccgtaccgtacgggaccgttaccggaaaggggggtaacgggggtcgttaggggagggtttcgggggtaccggacccgtaaacccgtaaagttaaaacggaaaaaaaaggaggttaaagggtaaaggtaacgaaacccgtaaccgtaaaacccttaaggttacgtaacgttaaaacccgttcgttacggttaacggaacggtccggggtaacgttacccgtttaccgaccccggttacccgtaccgaacgggtaacggaacccggaacccggtaacccgaaaacgtaaacccgttaccgaaacctacctaaacttaccgtaacgtaacgtaaaacgttaaccgtaaaaccgtaaaaccgttagggaaaaccgtaccgggacccgggttaacgggaaacccgttaccgggtaaccggtttagggttaaggttttaaccgtttacggttaaggtttacggggtaaggttaacgggtaacggttaaggtttcggtttaaccggggttaccggggtttaccggggggtttaaccgggggtaacccccggggtaaacccggggtttaaaccccggtacccgggtttaccccggttaaccccggtttccccgtaaccccgttccggttaaccccgttaaacccccccggg

SEQ ID NO: 114063 - DNA, 821 bp, Homo sapiens
  misc_feature: GYAE6OF01CK2N8.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtccttagagtctcctgtgtggcctctggattctactttcagtaatggctggatgtaggttgggtccgcgaggtctccgaggggaaggggcgtagggaggttgggttaggtacgttttacgaaaaaggttaaaaatggagtgggtagaaggtaaaaagtacggaaccgttaacgggtcgtaaccgacccggttaaggaaaaaggtaaacgtaacgtttacaacccgtaaatccgtaacgtaaaggtaacgtaagttaaactttaaacgaaaaaaaccgggttcgggttagtttaaactttaggaacccaaaaagttacggaaaaccaacggtacccctaaaagggaaaaacccggaagggaacctaaccgtaacgggttcccgtaactttaaacgtttaacccgtaacggtaacccctaacgaaggttaaccgttacggggaaaagttcgaaccgtaacgttaccggaaacggttaaaaacgggtgggtaccccttaaggttccggttaactttttcgaaacgttaccggttaccgggtcgggggaaaccccccggtagggtaacccgttaaagggttccccgggg

SEQ ID NO: 114064 - DNA, 704 bp, Homo sapiens
  misc_feature: GYAE6OF01AYBYA.15.86.H09.1.454.CMB.1.raw
  modified_base (264)..(264): a, c, t, g, unknown or other
  misc_feature (264)..(264): n is a, c, g, or t
  modified_base (628)..(628): a, c, t, g, unknown or other
  misc_feature (628)..(628): n is a, c, g, or t
  modified_base (659)..(659): a, c, t, g, unknown or other
  misc_feature (659)..(659): n is a, c, g, or t
tcagtctacgtagccacgaccggtgctcgatttagtgctatagacttgggtttggggggagaggagccccagccttgggatccccaagtgtttcattcagtgatcaggactgaacacagaggactcaccatggagttcggctgagctgggttttcctgctgcttatacgttaaaggtgtccagtgtagaagtgctaggtggtggagtcgtggggacgtcgttggtaacgcgtggggtcccttagagtctctgtgtcgctctggnttctacttcagtaagtgctggatggaggttcggtccgcgaggtctacggaggggacgggtgtagggtagttcggggttagacgttttaaacgaaaaagttaaaactgtactagggaagtaaagtaaaatacggtaactacgggttagacccgtaaccgggtaacggtaaaaggacgttacgtaaccgaaccctaagtacctaacgaaagtaagttaactaaattaaccgaaaaccggtgtttacgttaatttacgaataaaacgtgaaacccgtaggtaaccctaaacgaaaccggaacgaccaacgtacgtcccgtttaataacgttcgaacgtaccaacgttacgtacgttaggagttaccngtacgtacgaaaggttaagcgtacttaggtntaacgtttgaacttcgtcgggacggacctaaggtctaacggttcg

SEQ ID NO: 114065 - DNA, 550 bp, Homo sapiens
  misc_feature: GYAE6OF02JC0EV.15.86.H09.1.454.CMB.1.raw
  modified_base (174)..(174): a, c, t, g, unknown or other
  misc_feature (174)..(174): n is a, c, g, or t
  modified_base (178)..(179): a, c, t, g, unknown or other
  misc_feature (178)..(179): n is a, c, g, or t
  modified_base (183)..(184): a, c, t, g, unknown or other
  misc_feature (183)..(184): n is a, c, g, or t
  modified_base (189)..(189): a, c, t, g, unknown or other
  misc_feature (189)..(189): n is a, c, g, or t
  modified_base (191)..(193): a, c, t, g, unknown or other
  misc_feature (191)..(193): n is a, c, g, or t
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (309)..(309): a, c, t, g, unknown or other
  misc_feature (309)..(309): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcggcgttcgtcgagtcgcatagtaagtncagnngatnnagtgngnnnggganctgaanctggggtcctagngtctctgtgtggctctggattcactttcagtaatggctggatgagttgggtccgcaggctccagggaaggggctggagtgggtggacgtttnaaaagtaaaatgatggtgagaaaatgatacggtgcaccgtgaaaggaagattcacatcanananatatanaaacgacgtagtatnanaatananacgactacgaacgacgacgacacgacgtactactactacgtaccacacgtacgttacgtaagtagacacgtacgtacgtaaggaggtacgtagtagttacgtttagtagttacgtacggtacgggtaccggacggtacgtagtacgg

SEQ ID NO: 114066 - DNA, 556 bp, Homo sapiens
  misc_feature: GYAE6OF02GS0C4.15.86.H09.1.454.CMB.1.raw
  modified_base (483)..(483): a, c, t, g, unknown or other
  misc_feature (483)..(483): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctgggggtcccttagagtctcctgtgtggcctctggattcactttcagtaatggctggatgagttggtccgccaggctccagggaaggggctggagtgggttggacgtttcaaaagtaaaatgatggtgagaaaatagactacggtgcaccgtgaaaggagattcacatctcaagagataattacaaaacgacggtagtatttgacaaatgaacagcctagaaaaccgaggaacacagccgtactattactgtaccanagattacgaagtgcatacgacgtaaggaggtctaatgacttttgattagtcgtgggcccagggaccaagtcgg

SEQ ID NO: 114067 - DNA, 508 bp, Homo sapiens
  misc_feature: GYAE6OF02HM0B3.15.86.H09.1.454.CMB.1.raw
  modified_base (491)..(491): a, c, t, g, unknown or other
  misc_feature (491)..(491): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacggatccccgatcgcttcatgggctccagttctggggctgaccgctacctcaccatctccaacctccagtctgacgatgaggctgagtatcactgtggagagagccacacaattgatggcaagacggttgggtgttcggcggagggaccagcgngaccgtctaggtcacgg

SEQ ID NO: 114068 - DNA, 616 bp, Homo sapiens
  misc_feature: GYAE6OF02F4RSF.15.86.H09.1.454.CMB.1.raw
  modified_base (174)..(174): a, c, t, g, unknown or other
  misc_feature (174)..(174): n is a, c, g, or t
  modified_base (176)..(178): a, c, t, g, unknown or other
  misc_feature (176)..(178): n is a, c, g, or t
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
  modified_base (191)..(192): a, c, t, g, unknown or other
  misc_feature (191)..(192): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (239)..(240): a, c, t, g, unknown or other
  misc_feature (239)..(240): n is a, c, g, or t
  modified_base (242)..(243): a, c, t, g, unknown or other
  misc_feature (242)..(243): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcggcgttcggtcaaggcgcatagtaagncnnngatgnagtgngannggngctgagcgnggtcgtgngtntctgtgngctntgntnctcnangnngnngngtgtcgcgngcncgaggaggngngngtggtggtagtagtaaagtaaagtagtagtagtagaagaaagtaagtacgtacggtacgaccgtaccgtacggaaaggtaacgtaacgtactaactaactactacgaagaagtaagtaagtaacgtaaaacgtaacggtacgttaagttagtaacgtaaacgtaacgtaacgacgtacgtaacgtaaacgaacgaacgacgacgacgtacgtacgttacgtacgtaccgtacgtacgtacgttacgtaacgtacgtacgtacgtacgtacgtaacggtacggtacgtacgtacgtacgtttacgttagtacgtacggtaccggtaccggtacggtacgtagtacgg

SEQ ID NO: 114069 - DNA, 510 bp, Homo sapiens
  misc_feature: GYAE6OF02IUM1N.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacgggatccccgatcgcttcatgggctccagttctggggctgaccgctacctcaccatcctccaacctccagtctgacgatgaggctgagtatcactggtggagagagccacacaatgatggcaaggcggttgggtgttcgggcggagggaccagctgaccgtctaggtcacgg

SEQ ID NO: 114070 - DNA, 778 bp, Homo sapiens
  misc_feature: GYAE6OF02INT6K.15.86.H09.1.454.CMB.1.raw
tcagtctacgtagccacgaccggtgctcgatttagtgctatagacttgggtttggggggagaggagcccagccttgggatcccaagtgttttcattcagtgatcaggactgaacacagaggactcaccatggattcgggctgagctgggtttcctgctgctatcttaaaaggtgtccagtgtgaagtgcaggtggtggagtctgggggagccttggtaaagcctgggggtcccttagagtctcctgtgtggcctctggattcacttcagtaatggctggatgagttcgggtccgccaggctccgaggggtaaggggctgggacgtggggttggacgttttcgaaaaaggttaaaactggaacttgggtacgaaggtaaaaacttacggacgttaaccgggtagaccgtaacccggttggaaaacgggtacgtaactttccgaaccgtaagttccgttacgaaacgtacgtaactaacgtttaccgaaaaaacggtcggttagttaaacgttttacggacgttaaaagtcggtaaacctacggtaccgttaggaaaaacccggtagggtaaccgtaaccgtacgggtacccgtttacgtaacgtttaaccgtacggttacccgaacgttaacgtacgtttaccgggaaacgttcgggaacctaacgttaccggtaacggttaaacgggtacgggtccttaaggttacggtaccttttaggaacgtttacgttccggtacgggggtaccccctaggggttaaccctaaggtttaccgggg

SEQ ID NO: 114071 - DNA, 563 bp, Homo sapiens
  misc_feature: GYAE6OF02I1412.15.86.H09.1.454.CMB.1.raw
  modified_base (490)..(490): a, c, t, g, unknown or other
  misc_feature (490)..(490): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggttttcgtgacgtgctatcttaaaggtgtccagtgtgaagtgcaggtggtggagtctggggagccttggtaaagcctgggggtcccttagagtctcctgtgtggcctctggattcactttcagtaatggctggatgagttgggtccgccaggctccagggaaggggctggagtggggttggacgtttcaaaagtaaaatgatggtgaagaaatagactacggtgcaccgtgaaaggagattcaccatctcaaagagaataattacaaaaacgacggtagtatttgacaaatgaacagcctagaaaccgaggacacacgcctactacttactagtaccanagacttacggaagtgacagtacgacgtaaggaggctagtgtctttagatatcgtagggcccagggacagtcgg

SEQ ID NO: 114072 - DNA, 567 bp, Homo sapiens
  misc_feature: GYAE6OF02GZFU9.15.86.H09.1.454.CMB.1.raw
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (182)..(184): a, c, t, g, unknown or other
  misc_feature (182)..(184): n is a, c, g, or t
  modified_base (189)..(189): a, c, t, g, unknown or other
  misc_feature (189)..(189): n is a, c, g, or t
  modified_base (191)..(193): a, c, t, g, unknown or other
  misc_feature (191)..(193): n is a, c, g, or t
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (448)..(448): a, c, t, g, unknown or other
  misc_feature (448)..(448): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcggtgttcgtgagcgctatagtaagtntcagtngannnagtgngnnngggnctgtaagctgggggtccttagngtctcctgtgtggcctctggattcactttcagtaatggctggatgagttgggtccgccaggctccgagggaaggggctgggagtgggttggacgtttacaaaagtaaaatgatggtagagaaaatagactatggtgcacccgtaggaaaggaagattacaccatctacaagagaattaattacaaaacggtacggtagtatttagacaaatgaacagcctagaaaccgnggacacacgccgtactattactgtaccacagtacttacggaagtcgacagtacgaaccggtaaggaggtactagtggtacttttggattagtccgtgggggaccctaggggactaacgg

SEQ ID NO: 114073 - DNA, 594 bp, Homo sapiens
  misc_feature: GYAE6OF02GOTNK.15.86.H09.1.454.CMB.1.raw
  modified_base (151)..(151): a, c, t, g, unknown or other
  misc_feature (151)..(151): n is a, c, g, or t
  modified_base (540)..(540): a, c, t, g, unknown or other
  misc_feature (540)..(540): n is a, c, g, or t
  modified_base (562)..(562): a, c, t, g, unknown or other
  misc_feature (562)..(562): n is a, c, g, or t
tcagtctacgtagccacgaccggtgctcgatttagtgctatagacttgggtttggggggaggaggagccccagccttgggatccccaagtgttttcattcagtgatcaggactgaacacagaggactcaccatggagttcgggctgagcgnggtttcgtgagtgctatacgtaaagtgtcagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttcaaaaggtaaaatgatggtagagaaaatgactacggtgcaccgtgaaaggagattcaccatctcaagagaattaattacaaaaaacggtcggttagtaagtttgacaaattagaacaggacccttaggaaaacccgaggacaacgagccgtctaattacctgtaaccacgagtatttcgggaatgacagtccgaggtaaaggnggactatgtcgttttagaattntcggttcggggacccaggggtaccaagttcgg

SEQ ID NO: 114074 - DNA, 554 bp, Homo sapiens
  misc_feature: GYAE6OF02GMQUI.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcaccgtgaaaggaagattcaccatctcaagagataattcaaaaacgacggtagtatttgacaaatgaacagcctagaaaaccgaggacacagccgtactattactagtaccacagattcggaagtgacatcgacgtaaggaggctatgcttttgattatcgtgggcccagggacatcggg

SEQ ID NO: 114075 - DNA, 170 bp, Homo sapiens
  misc_feature: GYAE6OF02HYXGC.15.86.H09.1.454.CMB.1.raw
  modified_base (164)..(170): a, c, t, g, unknown or other
  misc_feature (164)..(170): n is a, c, g, or t
tcagtctacgtagccacgaccggtgctcgatttagtgctatagacttgggttgggggagaggagcccagccttgggatccccaagtgtttcattcagtgatcaggactgaacacagaggactcaccatggagttcgggctgagcgggctggcaaggcgcatagnnnnnnn

SEQ ID NO: 114076 - DNA, 597 bp, Homo sapiens
  misc_feature: GYAE6OF02I6WKY.15.86.H09.1.454.CMB.1.raw
  modified_base (318)..(318): a, c, t, g, unknown or other
  misc_feature (318)..(318): n is a, c, g, or t
tcagtctacgtagccacgaccggtgctcgatttagtgctatagacttgggtttgggggaggaggaggccccagccttgggatccccaagtgttttcattcagtgatcaggactgaacacagaggactcaccatggagttcgggctgagcgtggtttcgtgacgtgctatacgttaaagtgtccagtgtgaagtgcaggtggtggagtctgggggagccttggaaagcctgggggtcccttagagtctcctgtgtggcctctggattcatttcagtaatggctggatgagttggcgcaggctccagggaagggcgtggnggtggtggtagtagtaaagtaaagtagtagtgtagagaaagagagtagtagacgacgagaaggaagatacacactactacgaagagaataataacgtaaacgtaacgtagtagttagtagtaagtaagaagacgacgaacgaaacgaacgaacgacgacgacgtactactactacgtacacgacgtacgtacgtagtagacgagtacgacgtaaggtaaggtacgtagtagtacgttacgtagtacgtacgtacggtaccggtacggtacgtagtacgg

SEQ ID NO: 114077 - DNA, 553 bp, Homo sapiens
  misc_feature: GYAE6OF02HMNBK.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcaccgtgaaaggaagattcacatctacaagagataattacaaaaacgtacggtagtatttgacaaatgaacagcctagaaaccgagacacagcctactatactgtaccacagattcgaagtgcatcgacgtaaggaggctatgtcttttgattatcgtgggcccgaggaccaatcggg

SEQ ID NO: 114078 - DNA, 593 bp, Homo sapiens
  misc_feature: GYAE6OF02I1HFE.15.86.H09.1.454.CMB.1.raw
  modified_base (508)..(508): a, c, t, g, unknown or other
  misc_feature (508)..(508): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtccttacgagtctcctgtgtggccgtctggattctacttctagtaatgctggatgagttggtccgccaggcgtccagggaaggggcgtgggtaggtgggttggacggtttacgtaaaagtaaaagtagagtaggtagaagaaaagtagacgtacggtgacacccgtagaaaggaagattacacatactcaagagataatacaaaaacgacggtagtaatttgacaaatagaacagacccgtagaaaaccgaggacacagccgtatattacncgtaccacagagttacgaagtgacagtcgaacgtaaggagtctatgtcttttagattagtccgtggggcccagggtacagtcggg

SEQ ID NO: 114079 - DNA, 542 bp, Homo sapiens
  misc_feature: GYAE6OF02FVGEB.15.86.H09.1.454.CMB.1.raw
  modified_base (507)..(507): a, c, t, g, unknown or other
  misc_feature (507)..(507): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatggtgagaaatagactacggtgcaccgtgaaaggagattcacatctcaagagataattacaaaaacgacggtagtatttgcaaatgaacagcctagaaaccgaggacacagccgtactattactgtaccacagattcgaatgcatcgacgtaaggnggctatgctttgatatctgggccagggacagtcgg

SEQ ID NO: 114080 - DNA, 655 bp, Homo sapiens
  misc_feature: GYAE6OF02HCK5F.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttcgtgacgtgctatcttaaaggtgtccagtgtgaagtgcaggtggtggagtctgggggagccttggtaaagcctggggggtcccttagagtctcctgtgtggcctctggattcactttcagtaatggctggatgagttggtccgccaggctccagggaaggggctggagtgggttggacgtttcgaaaagtaaaatgatggtgagaaaatagactacggtgcaccgtgaaaggaagattcaccatctacaagagataattacaaaacgacggtgtaatttgactaaatgaacagacctagaaaacccgaggaacacgaagccgtactaacgttacagttaacccacgtaagtaactttccgggaaagttcgaccgtaattaccggaaccggttaaaagggacgggtaaccgttaagttagggtaccttttttagggaattttacgttaccggttaccggggggacccccgtaagggggtaaccctaaaggtttcccgggg

SEQ ID NO: 114081 - DNA, 560 bp, Homo sapiens
  misc_feature: GYAE6OF02J3BHZ.15.86.H09.1.454.CMB.1.raw
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
  modified_base (501)..(501): a, c, t, g, unknown or other
  misc_feature (501)..(501): n is a, c, g, or t
  modified_base (525)..(525): a, c, t, g, unknown or other
  misc_feature (525)..(525): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgtgacagaccttgctcggcagcggctttcaccgntttancgttacttangtcagcattcgctacttctgactaccctccagcatgcctcacagcacnccttcacaggctacagaaccncctaccccaccaacaacgcatacgctcgctgcccgcagtccttcggtncgtactcggtttacgccccgtttnacttcctcccgcctatcctgactctacgtagtacg

SEQ ID NO: 114082 - DNA, 547 bp, Homo sapiens
  misc_feature: GYAE6OF02IPE29.15.86.H09.1.454.CMB.1.raw
  modified_base (530)..(530): a, c, t, g, unknown or other
  misc_feature (530)..(530): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggaaggggctggagtgggttggacgtttcaaaagtaaaatgatggtagagaaaatagactacggtgcaccgtgaaaggagattcacatctcaagagataattacaaaaacgacggtagtatttgacaaatgaacagcctagaaaccgaggacacagcctctattactgtaccacagattcggaatgacatcgacgtaaggagctatgctttgatatcgngggccagggacagtcgg

SEQ ID NO: 114083 - DNA, 593 bp, Homo sapiens
  misc_feature: GYAE6OF02ITSD1.15.86.H09.1.454.CMB.1.raw
  modified_base (476)..(476): a, c, t, g, unknown or other
  misc_feature (476)..(476): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaacgcctgggggtcccttagagtctcctgtgtggcctctggattcactttcagtaatggctggatgagttgggtccgcaggctccagggaggggctggagtgggtggacgtttcaaagtaaaatgatggtgagaaatagactaggtgcacccggtgaaaggagattcaaccatctcaagagaataattcaaaaaaccgacggttagtaattttaggactaaaatggaaacagacccttagtaaaaacccgnggaaccacaacgcccgtataattacctagttacccactagattcggaaagtgacagtacgacgtaaaggaggctaagtgtcttttagattatcgtggggacccagggtacattcggg

SEQ ID NO: 114084 - DNA, 552 bp, Homo sapiens
  misc_feature: GYAE6OF02IZZ4I.15.86.H09.1.454.CMB.1.raw
  modified_base (437)..(437): a, c, t, g, unknown or other
  misc_feature (437)..(437): n is a, c, g, or t
  modified_base (472)..(472): a, c, t, g, unknown or other
  misc_feature (472)..(472): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaaagtaaaatgatggtgagaaatagactacggtgcacccgtgaaagggagattcacatctcaagagataattacaaaaacgacggtagtatttagnaaatgaacagacctagaaaacgagacacagccgtntattactgtaccacagattacggaagtgcatcgacgtaaggaggctatgctttgatatcgtgggcccagggactagtcgg

SEQ ID NO: 114085 - DNA, 577 bp, Homo sapiens
  misc_feature: GYAE6OF02HTF6M.15.86.H09.1.454.CMB.1.raw
  modified_base (473)..(473): a, c, t, g, unknown or other
  misc_feature (473)..(473): n is a, c, g, or t
  modified_base (500)..(500): a, c, t, g, unknown or other
  misc_feature (500)..(500): n is a, c, g, or t
tcagtctacgtagccacgaccggtgctcgatttagtgctatagacttgggtttgggggggaggaggagccccagccttgggatccccaagtgttttccattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctgggagtggggttggacgtttcaaaagtaaaatgaatggtgaagaaaatagactacggtgcaccgtgaaaggaagattcaccatactcaaagaagataattacaaaaacgtacggtagtatttgactaaatgaacagctagaaaaccgnggacacagccgtatattactgtaccanagattacgaatgacatcgacgtaaaggcgtactatgtcttttagatagtcgtgggtaccccagggtacaagttcggg

SEQ ID NO: 114086 - DNA, 691 bp, Homo sapiens
  misc_feature: GYAE6OF02GPDUP.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacaggacacgaaggtacccaccctagtataatagaaggtaaagtaagagtagtagtgacgacgaccaacgaaccggggaagggggaccgtacccgtacccgtagtccgttactacgtaggtcggtcctacgtacgttcgggtcgggtctaccggacccgtacctacctaccgacctacgtccctaaccctaccctccgtacgtcgtacggacgtacgtaggacggtacgtaggtaacgtctaccgtacggttgggacgggtaagacggaccgacccgaactaacgttaagtacgaggtaccggacgtaacggggttacggggtttggggttaccggggttcggggaacgggggtaaccgggaaccgaacggtaccggttaacccgggtaccccgttacgggttaccggaccgtaaccccggg

SEQ ID NO: 114087 - DNA, 599 bp, Homo sapiens
  misc_feature: GYAE6OF02IRJHC.15.86.H09.1.454.CMB.1.raw
  modified_base (183)..(183): a, c, t, g, unknown or other
  misc_feature (183)..(183): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
tcagtctacgtagccacgaccggtgctcgatttagtgctatagacttgggtttgggggagaggagccccagccgttgggatccccaagtgttttcattcagtgatcaggactgaacacagaggactcaccatggagttcgggctgagcggtcggttcgtgagtcgctatagtaagtgcagtgngagtgcaggtgtggatctggggagtccttaggtaaagccgtgggggtccttagagtctcctgtgcgcctgtggaattgctttcaggtaatggcctggaatgattcggccgcagncaggagggngngngtgtgtagtagtaagtaaagtagtagagtagagaagtagagtacgtgacgacgtagaaggaagagtacgactactactacgacgagtataataacgtaaacgtaacgtagtagttacgtagtaatacgacgacgtacgaacgaaacgaacgaacgacgacgtacgtacgtactacgtacgtacgacgacgtacgtacgtacgtacgacgtacgtacgtacgtaacggtaacggtacgtacgtacgtacgttagtagtacgtacggtcggtacggacggtacgtagtacg

SEQ ID NO: 114088 - DNA, 585 bp, Homo sapiens
  misc_feature: GYAE6OF02HQP4Z.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgtgacgtgctatctaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtgggttggacgtttacaaaaaggtaaaatgaatggtgaagaaaatgactacggtgacacccgtgaaaaggagatcaccatctacaagagataattacaaaaacgcggtgttatttgacaaatgaacagacctagaaaacgaggaacacacgccgtctattactgtaacctacagtattacggaagtgacatacggacgtaaaggacggctagttgtacttttagattagtcgtcggggaccccagggtacgagttcggg

SEQ ID NO: 114089 - DNA, 562 bp, Homo sapiens
  misc_feature: GYAE6OF02GW3CB.15.86.H09.1.454.CMB.1.raw
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttagggtcgactcaccctgccccgattaacgttggacaggaacccttggtcttccggcgagcgggcttttcacccgctttatcgttacttatgtcagcattcgcacttctgactacctccagcatcgcctcacagcacacctcacagctacagaacgctcccctaccaacaacgcataagcgtcgctgccgcacgcttcggncattggttacgccccgtttnacttccttcccgacactctgacgtctacgatacg

SEQ ID NO: 114090 - DNA, 587 bp, Homo sapiens
  misc_feature: GYAE6OF02IXWWT.15.86.H09.1.454.CMB.1.raw
  modified_base (453)..(453): a, c, t, g, unknown or other
  misc_feature (453)..(453): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcacttcagtaatggctggatgagttgggtccgccaggctccagggaaggggctggagtgggttggacgtttacgaaaagtaaaatgatggtgagaaaatagactacggtgacacccgtgaaaggaagattcacatctacaaagagaataattacaaaaacgacggtagtatttagactaaatgaanacgcctaagaaaaccgaggacacagccgtactattactgtaccacaagtattacggaaagtgacataccgagttaaaggagggactaatggtcttttagattagtcgtaggggacccaagggaccaagttcggg

SEQ ID NO: 114091 - DNA, 561 bp, Homo sapiens
  misc_feature: GYAE6OF02ILZX0.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcgaaaagtaaaatgatggtgagaaatagactacggtgcaccgtgaaaggagattcacatctacaagagataattacaaaaacgacggtagtatttagactaaatgaaacagacctagaaaaccgaggacacagccgtctattactagtaccacagattacggaagtgacatacgacgtaaggaggctatgtctttagatatcgtgggcccagggtacagtcgg

SEQ ID NO: 114092 - DNA, 578 bp, Homo sapiens
  misc_feature: GYAE6OF02GSZ3K.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgtgacgtgctatacttaaaggtgtccagtgtgaagtgcaggtggtggagtctgggggagccttggtaaagcctgggggtcccttagagtctcctgtgtggcctctggattcactttcagtaatggctggatgagttgggtccgccgaggctccagggaaggggcgtggagtgggtggacgtttacaaaagtaaaatgatggtagagaaaatagactacggtgcaccgtagaaaggaagattcacatctcaagagataattacgaaaaacgacggtagtatttgacaaatgaacagctagaaacgagacacagccgtatattactagtaccacagagttacggaagtgacagtccgagtaaaggaggtactatggtactttttagattagttcggtaggggaccctagggtaccaaggttcgg

SEQ ID NO: 114093 - DNA, 561 bp, Homo sapiens
  misc_feature: GYAE6OF02H5DX9.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcacttttcagtaatggctggatgagttgggtccgccaggctccagggaaggggctggagtgggttggacgtttcaaagtaaaatgatggtgagaaaatagactacggtgcaccgtagaaaggaagattcacatctcaagagataatacaaaaacgacggtagtatttgacaaatgaacagacctagaaaaccgaggacacagccgtctattactgtaccacagattcggaagtgacatcgacgtaaaggaggctatgtacttttgattatcgtggggcccagggtacaagtcggg

SEQ ID NO: 114094 - DNA, 666 bp, Homo sapiens
  misc_feature: GYAE6OF02HI12V.15.86.H09.1.454.CMB.1.raw
tcagtctacgtagccacgaccggtgctcgatttagtgctatagacttgggtttgggggggaggaggagccccgagccttgggatccccaagtgttttcattcagtgatcacggactgaacacagaggactccaccatggagttcgggctgagctgggttttccttgctgctatcttaaaaggtgtccagtgtgaagtgcaggtggtggagtcgtgggggagccttggtaaagccgtgggggtcccttaggagtctcctgtgtggcctctggattcactttcagtaatggctggatgaggttgggtccgccgaggctccgagggaaggggctgggaggtgggttggacgtttacaaaagtaaaatgatggtagaagtaaaatagactacggtgacaccggtagaaaggaagacttacgaaccatacctacaaagagtaataaacttaacaaaaacgtacggtagttaagtttagactaaatagaaactagaccttaagaaaaccggtaggaacaacgacgtacccgtactaattacctagtaccctacgtaagtacttacgggaaggtcacgtacgtaccggtaacggtaaacgggaggtacttagttacgtacgttttagtaattacgttcggtaggggtaccccaaggggtacctaagttcgggg

SEQ ID NO: 114095 - DNA, 552 bp, Homo sapiens
  misc_feature: GYAE6OF02JSXVV.15.86.H09.1.454.CMB.1.raw
  modified_base (478)..(478): a, c, t, g, unknown or other
  misc_feature (478)..(478): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggtttccttgctgctatcttaaaaggtgtccagtgtaaagtgcaggtggtggagtctgggggagccttggtaaagcctgggggtcccttagagtctcctgtgtggcctctggattcactttcagtaatggctggatgagttggtccgccaggctccgagggaagggctggagtgggtgacgtttcaaaagtaaatgatggtgagaaatgactacggtgcaccgtgaaaggaagattcacatctcaagagataatacaaaacgacgtagtatttagcaaaatgaaacagcctagaaaaccgaggacacaagccgtatatactagtaccanagattcggaaagtgacatacgaacgttaagaggctaatgctttagattatcgtgggcccagggtacagtggtcg

SEQ ID NO: 114096 - DNA, 561 bp, Homo sapiens
  misc_feature: GYAE6OF02IX16X.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccagggaaggggctggagtgggttggacgtttcaaagtaaaatgatggtgagaaaatagactacggtgcacccgtgaaaggaagattcaccatctcaagagataattacaaaaacgacggtgtaatttgactaaatgaacagcctagaaaaccgaggacacagcctctatactagtaccacagattcggaagtgacagtcgacggtaaaggaggactatgtcttttgattatcgtggggcccaggggacagtcgg

SEQ ID NO: 114097 - DNA, 561 bp, Homo sapiens
  misc_feature: GYAE6OF02GRPKI.15.86.H09.1.454.CMB.1.raw
  modified_base (486)..(486): a, c, t, g, unknown or other
  misc_feature (486)..(486): n is a, c, g, or t
  modified_base (520)..(520): a, c, t, g, unknown or other
  misc_feature (520)..(520): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccgtgacgtgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggcgtggagtgggttggacgtttcaaaagtaaaatgatggtgagaaaatagactaggtgcaccgtgaaaggaagattacaccatctcaagagataatacaaaaacgacggtgtaatttgactaaatgaaacagctagaaaaccgaggacacagccgtctattacngtaccacagattcggaatgacagtcgagtaaggnggctatgcttttagattatcgtgggcccagggacagtcggg

SEQ ID NO: 114098 - DNA, 535 bp, Homo sapiens
  misc_feature: GYAE6OF02GDIIX.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagcacaccaaggggacggatcccgatcgcttcatgggctccagttctggggctgaccgctacctcaccatcctccaaccctccagtctgacgatgaggctgagtatcactggtggagagacgccacaacaagttgatggaccaaggacgggttggggtcggttcggggcgggacgggaccgaaggccgtacggaccgtccgtaggtcaacccgg

SEQ ID NO: 114099 - DNA, 583 bp, Homo sapiens
  misc_feature: GYAE6OF02FNBKP.15.86.H09.1.454.CMB.1.raw
  modified_base (496)..(496): a, c, t, g, unknown or other
  misc_feature (496)..(496): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccaggggaaggggctggagtgggttggacgtttacaaaagtaaaatgatggtagaagaaaatagactacggtgcaccgtagaaaggaagattcacatctacaagagataattacaaaaacgacggtagtaatttgacaaatgaacagacctagaaaaccgagaacacagccgtctattactagtaccanagattacggaagtgcatacgacgtaaaggaggactagtagtctttttaggaattacgtcgtacggggcccaggggtaccaagtcggg

SEQ ID NO: 114100 - DNA, 563 bp, Homo sapiens
  misc_feature: GYAE6OF02HQ4NR.15.86.H09.1.454.CMB.1.raw
  modified_base (489)..(489): a, c, t, g, unknown or other
  misc_feature (489)..(489): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtccttagagtctcctgtgtggcctctggattcactttcagtaatggctggatgagttggtccgcaggctccgagggaaggggctgggagtgggttggacgtttcaaaagtaaaatgatggtgagaaaatagactacggtgacaccgtgaaaggaagattcaccatctacaagagaataattacaaaaacgacggtagtatttagacaaatgaacagcctagaaaaccgagaacacagccgtatatactgtaccanagattacggaagtgacatacgacgtaaggacgctatgacttttagatagtcgtggggcccagggtacagtcggg

SEQ ID NO: 114101 - DNA, 555 bp, Homo sapiens
  misc_feature: GYAE6OF02HNN6Q.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaggggctggagtgggttggacgtttcaaagtaaaatgatggtgagaaaatagactacggtgcaccgtgaaaggaagattcaccatctcaagagataattacaaaaacgacggtagtaatttgactaaatgaacagacctagaaaaccgagaacacagccgtctatactgtaccacagattcggaagtgcatcgacgtaaggagctatgcttttgattatcgtagggcccagggacaagtcggg

SEQ ID NO: 114102 - DNA, 572 bp, Homo sapiens
  misc_feature: GYAE6OF02G9XE6.15.86.H09.1.454.CMB.1.raw
  modified_base (389)..(389): a, c, t, g, unknown or other
  misc_feature (389)..(389): n is a, c, g, or t
  modified_base (421)..(421): a, c, t, g, unknown or other
  misc_feature (421)..(421): n is a, c, g, or t
  modified_base (459)..(459): a, c, t, g, unknown or other
  misc_feature (459)..(459): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcaccgtgaaagganattcacatctacaagagataattacaaaacgnggtagtaatttgacaaatgaacagacctagaaaaccgngaacacagccgtactattactgtaccacagattcggaagtcgacagtaccgacgtaaaggacggctatgtcttttagattactcggtaggggcccaaggggtacaagttcggg

SEQ ID NO: 114103 - DNA, 570 bp, Homo sapiens
  misc_feature: GYAE6OF02H2MPW.15.86.H09.1.454.CMB.1.raw
  modified_base (494)..(494): a, c, t, g, unknown or other
  misc_feature (494)..(494): n is a, c, g, or t
  modified_base (524)..(524): a, c, t, g, unknown or other
  misc_feature (524)..(524): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctgggagtgggttggacgtttcaaaagtaaaatgatggtagaagaaaatagactacggtgcaccgtagaaaggaagattcaccatctacaagagataattacaaaacgacgtagtatttgactaaatgaacagactagaaaaccgagacacagccgtctattacctagtaccanagattacggaagtgacatacgacgtaaggngctatgtcttttagattactcgtcgggacccagggtacaagtcggg

SEQ ID NO: 114104 - DNA, 556 bp, Homo sapiens
  misc_feature: GYAE6OF02FHOEP.15.86.H09.1.454.CMB.1.raw
  modified_base (470)..(470): a, c, t, g, unknown or other
  misc_feature (470)..(470): n is a, c, g, or t
  modified_base (510)..(510): a, c, t, g, unknown or other
  misc_feature (510)..(510): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcacttttcagtaatggctggatgagttgggtccgccaggctccaggggaaggggctggagtgggttggacgtttcaaaagtaaaatgatggtgagaaatagactacggtgcaccgtgaaaggagattcacatctacaagagataattacaaaacgacggtagtatttgacaaatgaacagctagaaaccgaggacacagccgtntattactgtaccacagattacggaatgcatcgagtaaggnggctagtgtcttttagattacgtcgtaggggcccagggacagtcgg

SEQ ID NO: 114105 - DNA, 579 bp, Homo sapiens
  misc_feature: GYAE6OF02GXPGZ.15.86.H09.1.454.CMB.1.raw
  modified_base (373)..(373): a, c, t, g, unknown or other
  misc_feature (373)..(373): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtcgccaggctccgagggaaggggctggagtgggttggacgtttacaaaagtaaaatgatggtgagaaaatagactaggngcaccgtgaaaggagattcacatctacaagagataattacaaaaacgacggtagttaatttgacaaatgaaacagacctagaaaaccgaggacaacacgaccgtactattactagtaccactaagattacggaagtgacatacgacgtaaagggaggactagtgtcttttagattagtcgtaggggcccaagggtacaagttcggg

SEQ ID NO: 114106 - DNA, 560 bp, Homo sapiens
  misc_feature: GYAE6OF02G5TB9.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatgactacggtgcaccgtgaaaggagattcacatctcaagagataattacaaaaacgtacggtagtaatttgactaaatgaacagacctagaaaaccgaggaacacgagccgtctaattactagtaccacagattcggaagtgcatcgacgtaaggaggctatgtcttttgattatcgtgggcccagggacaagtcgg

SEQ ID NO: 114107 - DNA, 586 bp, Homo sapiens
  misc_feature: GYAE6OF02I92HK.15.86.H09.1.454.CMB.1.raw
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttacaaaagtaaaatgatggtagagaaatagactacggtgacaccgtgaaaggaanattcacatctanaagagataatacaaaacgnggtagtattgacaaatgaacagcctaggaaaaccgaggacacgacgaccgtactattactgtaacctacaagtagttacgaagtgacataccggacgtaaagggngtactaatgtacttttagaattagtcgtacggggtacccaagggtactaagtcggg

SEQ ID NO: 114108 - DNA, 624 bp, Homo sapiens
  misc_feature: GYAE6OF02I7EXZ.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtcccgccaggctccgaggggaggggctggaggtgggttggacgtttacgaaaagtaaaatgatggtagagaaatagactacggtgcaccgtagaaaggaagattcaccatctacaagagataattacaaaacgtacggtagtatttgactaaatagaaacagacctaggaaaaccgaggaaccacgacgcccgttactaacttactacgttaacccaacgtaagtactttacgggaaagttcgaacgataccggaacggtaaagggaggtcttaagtgtctttttagattacgtcggtacggggacccaggggacctaaggtcggg

SEQ ID NO: 114109 - DNA, 663 bp, Homo sapiens
  misc_feature: GYAE6OF02JU1RJ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagcctgggggtcccttagagtctcctgtgtggcctctggattcactttcagtaatggctggatgagttggtccgcaggctccgagggaagggctggaggtgggttggacggtttacaaaagtaaaatgatgggtagagaaaatagacgtacggtgaccaccggtagaaaggaagattacaaccatactacaagagaataatacgaaaaacgtcggtagttaatttgaactaaaagtgaaacacgtaccgtaaggaaaaacccgagggaaccaaccgaacggaccccgttattaaacttaccgttacgtaaacccacgtaaggtaacgtttaccgggaaagttcgactaagtaccggaacgtaaagggcggtaacttaagtcgttacttttaggaattcgttacggtcggggacccaggggaacttaacggttcgggg

SEQ ID NO: 114110 - DNA, 591 bp, Homo sapiens
  misc_feature: GYAE6OF02GWUIR.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaaggggctgggagtgggttggacgtttacaaaagtaaaatgaatggtagaagaaaatagactacggtgcaccgtgaaaggaagattacaccatctacaagagaataattacaaaaacgtacggtataatttgacaaatgaacagacctagaaaccgagaacacagccgtatattactagtaccacagacttacggaagtcgacagtacgacgtaaagggacggtacttaagtcgtctttttagattagtcgtacggggcccaagggacagttcggg

SEQ ID NO: 114111 - DNA, 565 bp, Homo sapiens
  misc_feature: GYAE6OF02I1PK2.15.86.H09.1.454.CMB.1.raw
  modified_base (493)..(493): a, c, t, g, unknown or other
  misc_feature (493)..(493): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggaagggctggagtgggttggacgtttacaaaagtaaaatgatggtagaagaaatagactacggtgcacccgtagaaaggagattcaccatctacaagagaataattacaaaaacgacggtagttatttgacaaatgaacagacctagaaaaccgaggacacagccgtatattactgtaccanagattcggaagtgacatacgacgtaaggagctatgtcttttgattagtcgtcgggacccagggacaagtcgg

SEQ ID NO: 114112 - DNA, 580 bp, Homo sapiens
  misc_feature: GYAE6OF02JHNWW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctgggaggtgggttggacgtttacaaaagtaaaatgatggtgagaaatagactacggtgcaccgtgaaagagattcacatctacaagagataatacaaaacgtacggtagtatttgacaaatagaacacgactaagaaacgaggaacacagccgtactattactagtaccagagtagttacgaagtcgacatacgacgtaaggaggtactagttcgtacttttgattacgtacggtacgggacccgagggtactagtcgg

SEQ ID NO: 114113 - DNA, 573 bp, Homo sapiens
  misc_feature: GYAE6OF02GWD6C.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctgggagtgggttggacgtttacgaaaagtaaaatgaatggtagaagaaaatagactaggtgcaccgtgaaagaagatcacatctacaagagataatacaaaaacgcggtagtatttagacaaatgaacagcctagaaacgaggacacagcctactattactagtaccacagattacggaagtgacatacgacgtaaaggacggtactagtgtacttttagattagtcggtgggaccccgagggaccagtcggg

SEQ ID NO: 114114 - DNA, 557 bp, Homo sapiens
  misc_feature: GYAE6OF02I9UN3.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcgaaaagtaaaatgaaatggtgagaaatagactacggtgcaccgtgaaaggagattcacatctcaagagataattacaaaaacgacggtagtaatttgacaaatagaacagctagaaaacgagacacagccgtctattactgtaccacagattacgaagtgacatacgacgtaaggaggctatgtcttttgattagtcgtcgggcccgaggacagtcgg

SEQ ID NO: 114115 - DNA, 560 bp, Homo sapiens
  misc_feature: GYAE6OF02F45NR.15.86.H09.1.454.CMB.1.raw
  modified_base (463)..(463): a, c, t, g, unknown or other
  misc_feature (463)..(463): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggttttccgttgacgtgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcaccgtgaaaggaagattcacatctacaagagataattcaaaaacgacggtagtaatttgacaaaatgaacagacctgaaaaccgnggacacagccgtctattactgtaccacagattcggaatgcatcgacgtaaaggaggctaatgcttttgattatcgtggggacccagggacaagtcgg

SEQ ID NO: 114116 - DNA, 585 bp, Homo sapiens
  misc_feature: GYAE6OF02IKII4.15.86.H09.1.454.CMB.1.raw
  modified_base (408)..(408): a, c, t, g, unknown or other
  misc_feature (408)..(408): n is a, c, g, or t
  modified_base (437)..(437): a, c, t, g, unknown or other
  misc_feature (437)..(437): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggttggacgtttacaaaagtaaaaatgatggtagaagaaaatagactacggtgcaccgtgaaaaggaagatcacatcanaagagataatacaaaacgagtatattganaaatgaaacagcctaagaaaaccgaggacacgagccgtactaattactagtaaccaagaagaattacgggaaagtcgacaatacgaacgtaaaggaggactaagtgtacttttagattactcgtcgggacccgaagggacaagtcggg

SEQ ID NO: 114117 - DNA, 552 bp, Homo sapiens
  misc_feature: GYAE6OF02IO2E8.15.86.H09.1.454.CMB.1.raw
  modified_base (489)..(489): a, c, t, g, unknown or other
  misc_feature (489)..(489): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttcaaaagtaaaatgatggtgagaaaatagactacggtgacaccgtgaaaggagattcacatctcaagagataattacaaaaacgtacggtagtatttgacaaatgaacagcctagaaaaccgaggacacagcctctattactagtaccanagattcggaatgcatcgagtaaggagctatgtctttgattatcgtgggaccagggacagtcgg

SEQ ID NO: 114118 - DNA, 643 bp, Homo sapiens
  misc_feature: GYAE6OF02ITWXF.15.86.H09.1.454.CMB.1.raw
  modified_base (488)..(488): a, c, t, g, unknown or other
  misc_feature (488)..(488): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctccgaggggaaggggctggaggtgggttggacgtttacaaaagtaaaatgatggtagaagaaaatagactaggtgacaccgtagaaaaggaagattacaccatctacaaaggagaataaattacaaaaacgtacggtagttaatttagactaaaatacgaaacagacctaaggaaaaccgnggaacacgagtccgtactaattactagtaaccacagtacgttacggaatgactaagtaccggaacggtaaagggacggtacttaagtcggttaactttttagaagtttacgttccggttacggggaccccggtaaggggtaaccctaagttcggg

SEQ ID NO: 114119 - DNA, 596 bp, Homo sapiens
  misc_feature: GYAE6OF02F84Q0.15.86.H09.1.454.CMB.1.raw
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttacaaaagtaaaatgatggtgaagaaaatagactacggtgcaccgtgaaaggagattcacatctcaagagataattacaaaaacgacggtagtatttgacaaatgaaacagacctagaaaaccgagacacagccgtactaattaccngtacccaanagtattcgggaaatgacagtacgacgttaaaggacggtacttatggttctttttagaattagtcggtacggggccccaagggggtacctaagttccggg

SEQ ID NO: 114120 - DNA, 560 bp, Homo sapiens
  misc_feature: GYAE6OF02GGIGB.15.86.H09.1.454.CMB.1.raw
  modified_base (482)..(482): a, c, t, g, unknown or other
  misc_feature (482)..(482): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcaccgtgaaaggagattcacatctcaagagataattacaaaaacgacggtagtaatttgacaaaatgaacagacctagaaaaccgaggacacagccgtactattacngtaccacagattacggaatgcatcgacgtaaaggaggctagtgacttttgattatcgtggggcccagggacaagtcgg

SEQ ID NO: 114121 - DNA, 601 bp, Homo sapiens
  misc_feature: GYAE6OF02I3CZZ.15.86.H09.1.454.CMB.1.raw
  modified_base (381)..(381): a, c, t, g, unknown or other
  misc_feature (381)..(381): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgtgagtcgctatctaaaggtgtccagtgtgaagtgcaggtggtggagtctgggggagccttggtaaagcctgggggtcccttagagtctcctgtgtggcctctggattcactttcagtaatggctggatgagttgggtccgcaggctcagggaaggggctggagtgggttggacgtttacgaaaagtaaaatgatggtagagaaaatagactacggtgacaccgngaaaggagattcacatctacaagagaatatacaaaacgtacggtagtaatttgactaaatgaacagacctagaaaacgcggaacacagccgtactagttacacgttaccaaccgtagtacgttagggaaacgttgaccgagtaccggaacgttaaagggacggtactacgttagttctttacgagttacgtcgttcgggacccaggggtactaggtcggg

SEQ ID NO: 114122 - DNA, 563 bp, Homo sapiens
  misc_feature: GYAE6OF02FWA3F.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaatagactacggtgcaccgtgaaaggagattcaccatctcaagagataatcaaaaacgcggtagtatttgcaaatgaacagcctagaaaaccgaggacacagccgtctattactgtaccacagacttcggaagtgacatcgacgtaaaggacggcttaagtgtcttttagattatcgttcggggcccaggggacaagttcggg

SEQ ID NO: 114123 - DNA, 554 bp, Homo sapiens
  misc_feature: GYAE6OF02I1CO5.15.86.H09.1.454.CMB.1.raw
  modified_base (374)..(374): a, c, t, g, unknown or other
  misc_feature (374)..(374): n is a, c, g, or t
  modified_base (487)..(487): a, c, t, g, unknown or other
  misc_feature (487)..(487): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaatagactacggngcaccgtgaaaggagattcaccatctacaagagaataattcaaaaacgcggtagtatttgacaaatgaaacagcctagaaaaccgaggacacagccgtctattactgtaccanagattcggaatgcatcgagtaaaggaggctagtgtattttgatatcgtcgggccagggtacagtcgg

SEQ ID NO: 114124 - DNA, 616 bp, Homo sapiens
  misc_feature: GYAE6OF02F1LX2.15.86.H09.1.454.CMB.1.raw
tcagtctacgtagccacgaccggtgctcgatttagtgctatagacttgggtttgggggagaggagtcccagccttgggatccccaagtgttttcattcagtgatcaggactgaacacagaggactcaccatggagttcgggctgagcggtcggtttcgtcgacgtcggctatacgttaaagtgtcagtgtgaagtgcaggtggtggagtctggggagccttggtaaagcctgggggtcccttagagtctcctgtgtggcctctggattcactttcagtaatggctggatgagttgggtccgccaggctccagggaaggggctgggagtgggttggacgtttcgaaaagtaaaatgatggtagagaaaatagactacggtgcaccgtagaaaggaagattcaccatactcaagagataattacgaaaaacgcggtagtatttgacaaatgaaacagaccgtagaaaaccgaggacaacacgaccgtactattactgtaccacgagtactttacggaagttcgactagtaccggtaagtaaagggaggtaaccttaagttcgtccgtttttagaacgttacgtcggtacggggtccccgaaggggtacctagttcggg

SEQ ID NO: 114125 - DNA, 574 bp, Homo sapiens
  misc_feature: GYAE6OF02HUS8X.15.86.H09.1.454.CMB.1.raw
  modified_base (260)..(260): a, c, t, g, unknown or other
  misc_feature (260)..(260): n is a, c, g, or t
  modified_base (339)..(339): a, c, t, g, unknown or other
  misc_feature (339)..(339): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttcgtgacgtgctatacgtaaagtgtccagtgtgaagtgcaggtggtggagtctggggagccttggtaaagccgtgggggtcccttagagtctcctgtgtggcctntggattcactttcagtaatggctggatgagttgggtcgccgaggctccgagggaggggctgggagtgggtggacgtttnaaaagtaaaatgatggtgaagaaatagatacggtgacaccgtagaaaggagaatcaccatactacagagataattanaaaacgngtagtattgacaaatgaacagtctagaaaccgagacacagcgtacattacagtaccacagattacgaagtgacatcgaacgttaagggaggtactagttcgtcgttttagattaacgtcggttaggggaccccaagggtaccaagttcggg

SEQ ID NO: 114126 - DNA, 558 bp, Homo sapiens
  misc_feature: GYAE6OF02HSF0X.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgccaggctccagggaggggctggagtgggttggacgtttcaaagtaaaatgatggtgagaaatagactacggtgcacccgtgaaggaagattcacatctcaagagataattcaaaaacgacggtgtatttgacaaatgaacagcctagaaaaccgaggacacagccgtactattactgtaccacagattcggaagtgcatcgacgtaaaggaggtctatgacttttagattatcgtggggacccagggacaagttcggg

SEQ ID NO: 114127 - DNA, 590 bp, Homo sapiens
  misc_feature: GYAE6OF02FPDDV.15.86.H09.1.454.CMB.1.raw
  modified_base (479)..(479): a, c, t, g, unknown or other
  misc_feature (479)..(479): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggtggacgttcaaaagtaaaatgatggtgagaaaatgactacggtgcaccgtgaaaggagattcacctatctcaagagaataatacaaaaacgtacggtagtaatttgactaaatgaacagacctagaaaaccgaggaacacgagccgtntaacttactacgtaccacaagtattaccggaaagtcgactagtacggacggtaaaggaggtcttaagtggtacttttgattagtcgtacggggcccaggggaccagtcggg

SEQ ID NO: 114128 - DNA, 607 bp, Homo sapiens
  misc_feature: GYAE6OF02F5Y21.15.86.H09.1.454.CMB.1.raw
  modified_base (469)..(469): a, c, t, g, unknown or other
  misc_feature (469)..(469): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaaggggctggagtgggttggacgtttcaaaagtaaaatgatggtgagaaatagactacggtgacaccgtgaaaggagattcacatctacaagagataatacaaaaacgtacggtagtatttagataaatgaaacagacctagaaaaccgaggacanacgccgtactattacagtaccacgtacgaattaccgggaagttcgacagtacgacgtaaacgggaggtactaagttggtaccgtttttagaattacgttcggttacgggggacccctaagggggtaccaagttcgggg

SEQ ID NO: 114129 - DNA, 588 bp, Homo sapiens
  misc_feature: GYAE6OF02IWZ90.15.86.H09.1.454.CMB.1.raw
  modified_base (525)..(525): a, c, t, g, unknown or other
  misc_feature (525)..(525): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttacaaaagtaaaatgatggtagagaaaatagactacggtgcacccgtgaaaggagattcaccatctcaagagataattacaaaaacgacggtagtatttgacaaatgaacagcctagaaaaccgaggacacagccgtctattactgtaccacagattcggaaagtgacagtaccgacgtaaagggngtactagtgttacgttttagattacgttcggtaccggggacccgaagggtacctaggttcggg

SEQ ID NO: 114130 - DNA, 589 bp, Homo sapiens
  misc_feature: GYAE6OF02GFATM.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccttggtaagccgtgggggtcccttagagtctcctgtgtggcctctggattcactttcagtaatggctggatgagttgggtccgccaggctccgaggggaggggctgggagtgggttggacgtttacaaaagtaaaatgatggtagaagaaaatagactaggtgcaccgtgaaaggagattcacatctacaagagaataatacaaaaacgacggtagtatttgacaaatgaaacagcctagaaaaccgaggacacgagcccgtactattactcgtaccacgagacttacgggaatgactagtcggaacgtaaaggaggtactaagttgtcttttagattacgtcggtcggggaccccaggggtacctaggtcggg

SEQ ID NO: 114131 - DNA, 581 bp, Homo sapiens
  misc_feature: GYAE6OF02IX5YP.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgccaggctcagggaaggggctggagtgggttggacgtttcaaaagtaaaatgaatggtgagaaaatagactacggtgcacccgtgaaaggaagattcaccatctcaaagagataattacaaaaacgacggtagtaatttgacaaatgaaacagacctagaaaaccgaggacaacagaccgtctattactgtaccacagacttacggaagtgacagtacgacgtaaaggaggactaatgtctttttagattagtcttagggggccccaaggggtacaagttcggg

SEQ ID NO: 114132 - DNA, 560 bp, Homo sapiens
  misc_feature: GYAE6OF02FNPFJ.15.86.H09.1.454.CMB.1.raw
  modified_base (516)..(516): a, c, t, g, unknown or other
  misc_feature (516)..(516): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagcctgggggtcccttagagtctcctgtgtggcctctggattcactttcagtaatggctggatgagttgggtccgccaggctccgagggaaggggctggagtgggttggacgtttcaaagtaaaatgatggtgagaaatagactacggtgcaccgtgaaaggagattcacatctcaagagataattacaaaacgacggtagtatttagacaaatgaacagctagaaaaccgaggacacgagccgtactattactagtaccacagattacggaagtgacatcgacgtaaaggnggtctagtgtcttttagattactcgtgggcccagggacagtcgg

SEQ ID NO: 114133 - DNA, 558 bp, Homo sapiens
  misc_feature: GYAE6OF02HF01I.15.86.H09.1.454.CMB.1.raw
  modified_base (399)..(399): a, c, t, g, unknown or other
  misc_feature (399)..(399): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccaggggaggggctggagtgggttggacgtttcaaaagtaaaatgatggtgaagaaatagactaggtgcaccgtgaaaggagattcacatctnaagagataatacaaaaacgacggtagtatttgacaaatgaacagcctagaaaaccgaggaacacagccgacttattactagtaccacagtattacggaagtgcaagtccgagtaaggagctaatgtcttttgattatcgtgggcccagggacagtcggg

SEQ ID NO: 114134 - DNA, 728 bp, Homo sapiens
  misc_feature: GYAE6OF02H7GEB.15.86.H09.1.454.CMB.1.raw
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (185)..(186): a, c, t, g, unknown or other
  misc_feature (185)..(186): n is a, c, g, or t
  modified_base (188)..(188): a, c, t, g, unknown or other
  misc_feature (188)..(188): n is a, c, g, or t
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcggcgttcggtcaaggtcgctatagtaagncatgnangnngngtgngtgtggngcgtgagcgtggtcgtagagtctctgtgtcgctcgtgtatctacttactagtagtgtcgtagtagtagtaggtcggtccgccgtacggtcgtaccggagggacgggacggtaggtaggttagggtaggtacggttaacgtaaaagtaaaagtagtagtaggtagtaagtaaagtaagtaacggtacggtacggtaccgtaaccggtaacggtaaacggtaaacgtaacgtaccgtaccgtaacgtaaccgtaacgtaacgtaagtaaacgttaaacgttaaaccgtaaaacggtaaacggttaacgtttaacgtttaacgtaacgtaaagtaacgtaacgtaacgtaaccgtaacgaaaccgtaacgaacgacgtacgtaccgtacgtacgttaacgtacgtacgtacgtacgtacgttacgtaacgtacgtacgtacgtacgtaacgtaacggtaacggtacgtacgttacgttacgtttacgtacgtacgttaccggtaccggtaccggtacggtacggtacgtcgg

SEQ ID NO: 114135 - DNA, 557 bp, Homo sapiens
  misc_feature: GYAE6OF02G9KNL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttcaaagtaaaatgatggtgagaaatagactacggtgcaccgtgaaaggaagattcacatctacaagagataattacaaaaacgacggtagtatttgacaaatgaacagcctagaaaaccgaggaacacagccgtactattactgtaccacagattcgaagtgacatcgacgtaaggagctatgtcttttagatatcgtaggggcccagggacagtcgg

SEQ ID NO: 114136 - DNA, 570 bp, Homo sapiens
  misc_feature: GYAE6OF02GZ3KL.15.86.H09.1.454.CMB.1.raw
  modified_base (487)..(487): a, c, t, g, unknown or other
  misc_feature (487)..(487): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggttggacgtttcaaagtaaaatgatggtgagaaatagactacggtgcaccgtgaaaggagatcacatctacaagagataattacaaaacgcggtagtatttgacaaatgaacagacctagaaaaccgagaacacagccgtactattactgtaccanagattcggaagtgacatacgacgtaaagggacggtctagtgtcttttagattagttcgacggggtcccagggtacagttcggg

SEQ ID NO: 114137 - DNA, 743 bp, Homo sapiens
  misc_feature: GYAE6OF02HZU50.15.86.H09.1.454.CMB.1.raw
  modified_base (454)..(454): a, c, t, g, unknown or other
  misc_feature (454)..(454): n is a, c, g, or t
  modified_base (599)..(599): a, c, t, g, unknown or other
  misc_feature (599)..(599): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttccgttgacgtgctatacttaaaggtgtccagtgtgaagtgcaggtggtggagtcgtgggggagcttggtaaagccgtgggggtccttagagtctcctgtgtggcctctggattcactttcagtaatggctggatgagttggtccgcgaggctccgaagggaagggtctggtaggtgggttcggtacgtttaacaaaaggttaaaaatgaatggtagaagaaaagtagacgttaacggtcgacctaacccggtaggaaacgggtaaagtacgttaccacctaatacctaccaaaggtaanaactttaaagtaaccgtaaaaaaacggtacgggttagttaaattttacgggaaccttaaaagtacggaaactacggtaacccgttaaacggaaaacccggagggaaccaacgtacgaccgtacttattaaccgtagtacccgaanaacgtagtttaaccgggaagtacgtaccgtaagtaccggtaacggtaagggacggtacgtttaagtaccggtttcttttaaggactttaccgggtacgtacccgggggtaaccccgtaaggggttaacccgtaggttaccgggg

SEQ ID NO: 114138 - DNA, 545 bp, Homo sapiens
  misc_feature: GYAE6OF02IH68X.15.86.H09.1.454.CMB.1.raw
  modified_base (153)..(153): a, c, t, g, unknown or other
  misc_feature (153)..(153): n is a, c, g, or t
  modified_base (161)..(161): a, c, t, g, unknown or other
  misc_feature (161)..(161): n is a, c, g, or t
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (415)..(415): a, c, t, g, unknown or other
  misc_feature (415)..(415): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagcggngtttcgtnagtgcatntaagntcangtnagtgcagtgtgatctggganccttgaaagcctgggggtcccttagagtctcctgtgtggcctctggattnactttcagtaatggctggatgagtgggtcnccaggctccagggagggngtggagtggttggacggttcaaagtaaaatagaangtgagaaatagatacgtgnaccgagaagaagatacaccaanctanagagaataataacaaaacgtaacgtagtagttatanaatagaacacgacacgaaacgagacacacgcgtactactactacgtacacagagtacgtagtacgacatacgacgtaaggaggacgtatagtacttagtatacgtacgtacggaccggacggacgagtcg

SEQ ID NO: 114139 - DNA, 598 bp, Homo sapiens
  misc_feature: GYAE6OF02H3K4V.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttgggtaaagccgtggggggtcccttagagtctcctgtgtggcctctggattcactttcagtaatggctggatgagttgggtccgccaggctccgagggagggctggagtgggtgtacgtttacaaaagtaaaatgagtggtagaagaaatagactacggtgacaccgtagaaaggaagatacaccatctacaagagataattacaaaacgtacggtagttaattgactaaatgaaacagacctaagaaaccgagaacacgagccgtactattacagtaccacagtagttacggaagtgacagtaccgacgtaaaggacggtctaagtgtacgtttttagattacgtacggtacggggacccaagggacctaagtcggg

SEQ ID NO: 114140 - DNA, 622 bp, Homo sapiens
  misc_feature: GYAE6OF02IT91J.15.86.H09.1.454.CMB.1.raw
  modified_base (405)..(405): a, c, t, g, unknown or other
  misc_feature (405)..(405): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttacaaaagtaaaatgatggtgaagaaatagactaggtgcacccgtgaaaggagattcaccatcncaagagataatacaaaacgtacggtagttattgacaaatgaaacagacctagaaaaccgaggaacacgaagcccgtactaattacgtacgtaccactagaacgttacggaagtcgactagtacgtaacggtaaaggacgggtactagttggtacctttttaggaattaacgttccggttacgggggaccccgtaagggggtacctaaggttacgggg

SEQ ID NO: 114141 - DNA, 600 bp, Homo sapiens
  misc_feature: GYAE6OF02HACGJ.15.86.H09.1.454.CMB.1.raw
  modified_base (514)..(514): a, c, t, g, unknown or other
  misc_feature (514)..(514): n is a, c, g, or t
  modified_base (544)..(544): a, c, t, g, unknown or other
  misc_feature (544)..(544): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggttggacgtttacaaaagtaaaatgatggtagaagaaaatagactaggtgacaccgtagaaaggaagattcaaccatactacaagagaataaattacgaaaaacgtacggtagttaatttagacaaaagtgaaacaagaccccgaaaacgaggaaccaacagccgtactaattactagtaaccanagattcggaatcgacatacgaacgtaaggnggactaagtgtcttttagattagtcgtacggggacccagggaacagttggtaccgg

SEQ ID NO: 114142 - DNA, 591 bp, Homo sapiens
  misc_feature: GYAE6OF02JODH4.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctgggggtcccttagagtctcctgtgtggcctctggattcactttcagtaatggctggatgagttgggtccgccaggctccgagggaaggggctggagtgggtggacgtttcaaaagtaaaatgatggtagagaaatagactacggtgcaccgtgaaaggaagattcacatctcaagagataattacaaaacgacggtgtaatttgacaaatgaacagactagaaaaccgaggacacgaagccgtactattacagtaccacgagtacgttacggaagtgacaattccgagtaaaggagggtacctaagtcggtacgttttagaagttagttacgtacggggacccgtaagggtacaagttacggg

SEQ ID NO: 114143 - DNA, 602 bp, Homo sapiens
  misc_feature: GYAE6OF02I6QF9.15.86.H09.1.454.CMB.1.raw
  modified_base (368)..(368): a, c, t, g, unknown or other
  misc_feature (368)..(368): n is a, c, g, or t
  modified_base (547)..(547): a, c, t, g, unknown or other
  misc_feature (547)..(547): n is a, c, g, or t
tcagtctacgtagccacgaccggtgctcgatttagtgctatagacttgggtttgggggggagaggagccccagccttgggatccccaagtgttttcattcagtgagtccaggactgaacacaggaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctgatgagttggtccgcaggctccgagggagggctggagtgggttggacgtttacgaaaagtaaaatgatggtagagaaaangactaggtgacaccgtagaaaggaagattacgactatacacgaagagaataattacaaaaacgagtagttaattagacgtaaatgaacagtacctagaaacgagaacaagaagaccgtacttaagttactacgtaaccacgtacgaacttacggaagtgacgtaatcggagttaaaggnggtctatcggtactttagattacgtcggttcgggaccgacggtacgagttacggg

SEQ ID NO: 114144 - DNA, 589 bp, Homo sapiens
  misc_feature: GYAE6OF02I3RY7.15.86.H09.1.454.CMB.1.raw
  modified_base (491)..(491): a, c, t, g, unknown or other
  misc_feature (491)..(491): n is a, c, g, or t
  modified_base (538)..(538): a, c, t, g, unknown or other
  misc_feature (538)..(538): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggttcccttagagtctcctgtgtggcctctggattcactttcagtaatggctggatgagttgggtccgccaggctccgagggaaggggctggaggtgggttggacgtttacgaaaagtaaaatgatggtagaagaaatagactacggtgcaccgtgaaaggagtattacaccatctacaaagagaataattacaaaaacggacggttagtagtttagactaaatagaacagaccctagaaaaccgagacacagaccgtnttatactagtaccagaagtagtacgagtgacgattcgagttaaaggnggtactatcgtcttttagattagtccggtcggacccgagggactaagtcgg

SEQ ID NO: 114145 - DNA, 608 bp, Homo sapiens
  misc_feature: GYAE6OF02JZVZQ.15.86.H09.1.454.CMB.1.raw
  modified_base (497)..(497): a, c, t, g, unknown or other
  misc_feature (497)..(497): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtatggctggatgagttgggtccgccaggctccgagggaaggggctggagtgggttggacgtttacgaaaagtaaaatgatggtagaagaaatagactacggtgacaccgtagaaaggaagattacaccatctacaagagataatacaaaacgcggtagttattgacaaatagaacagacctagaaaccgagaacacgagaccgtactattactagtaccanagacttacggaagtgactagtacggaacgtaaaggacggtcgtaattcggtacgtttttagaacgttacgttaccggtacggggacccctaaggggtacctaaggttcggg

SEQ ID NO: 114146 - DNA, 560 bp, Homo sapiens
  misc_feature: GYAE6OF02H4YGU.15.86.H09.1.454.CMB.1.raw
  modified_base (366)..(366): a, c, t, g, unknown or other
  misc_feature (366)..(366): n is a, c, g, or t
  modified_base (467)..(467): a, c, t, g, unknown or other
  misc_feature (467)..(467): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtcgcaggctccaggaggggctggagtgggtggagtttcaaaagtaaaatgatggtgagaaatagactacggngcaccgtgaaaggaagattcaccatctcaagagataattacaaaaacgacggtagtaatttgacaaatgaacagacctagaaaaccgagaacacgagcctntattactagtaccactagattacgggaatagcagtcgacgtaaaggaggctaatggtacttttgatatcgtcggggcccagggaccagtcggg

SEQ ID NO: 114147 - DNA, 517 bp, Homo sapiens
  misc_feature: GYAE6OF02JAFXF.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccaaggaagtccccccagtatataatgaaagttaagagtgatggcagccacaccgaaggggacgggatccccgatcgcttcatgggctcagttctgggctgaccgctacctcaccatctccaactccagtctgacgatgaggctgagtatcactgtagagagagccacacaatgatgcaagtacgggttgggtacgttcgggacggagggaccgaaggctacgaccgtcgtaggtcgacgg

SEQ ID NO: 114148 - DNA, 617 bp, Homo sapiens
  misc_feature: GYAE6OF02JEAF4.15.86.H09.1.454.CMB.1.raw
  modified_base (409)..(409): a, c, t, g, unknown or other
  misc_feature (409)..(409): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaaggggctgggagtgggttggacgtttacgaaaagtaaaagtgatggtagaagaaatagactacggtgacaccgtgaaaggagattcacatacncaagagaataatacaaaaacgcggtataatttagactaaatgaacagtacctaaggaaaaccgagaacaacagaccgtctaattacgtgtaacccacaaggtattacgggaagttgacctagtacgaacggttaaagggacggtacttaatcggtacttttagaattacgttcgtacgggggacccctaagggacctaagttccgggg

SEQ ID NO: 114149 - DNA, 626 bp, Homo sapiens
  misc_feature: GYAE6OF02GZP6P.15.86.H09.1.454.CMB.1.raw
  modified_base (378)..(378): a, c, t, g, unknown or other
  misc_feature (378)..(378): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaggggctggagtgggttggacgtttacaaaagtaaaatgatggtagagaaaatagactacggtncgaccgtagaaaggagattcacatcacaagagataatacaaaacgtacggtatatttgactaaagtgaacagcctaaggaaaacccgaggaaccaacgacgccgtacttaattacctagtaacccactagattaccggaagtgactagttaccggaagttaaaggggacgtacgttaagttggttaccgtttttaggaattacgttacggttcgggggacccccgtaaggggtaccaagtttccgggg

SEQ ID NO: 114150 - DNA, 569 bp, Homo sapiens
  misc_feature: GYAE6OF02IKPFE.15.86.H09.1.454.CMB.1.raw
  modified_base (524)..(524): a, c, t, g, unknown or other
  misc_feature (524)..(524): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtccttagagtctcctgtgtggcctctggattcactttcagtaatggctggatgagttgggtccgccaggctccgagggaggggctggagtgggttggacgtttacaaaagtaaaatgatggtagaagaaaatagatacggtgacaccgtagaaaggaagacttacacatctacaagagataatacaaaaacgtacgtagtattagacaaatgaaacagcctagaaaaccgagacacagcctataattactataccacagtattacggaagtgacatacgacgtaaaggnggctagtgtactttagatatcgtgggacccaagggaccaagtcgg

SEQ ID NO: 114151 - DNA, 609 bp, Homo sapiens
  misc_feature: GYAE6OF02IBJFV.15.86.H09.1.454.CMB.1.raw
  modified_base (398)..(398): a, c, t, g, unknown or other
  misc_feature (398)..(398): n is a, c, g, or t
  modified_base (503)..(503): a, c, t, g, unknown or other
  misc_feature (503)..(503): n is a, c, g, or t
tcagtctacgtagccacgaccggtgctcgatttagtgctatagacttgggtttgggggggagaggagcccccagcccttgggatccccaagtgttttcattcagtgatcaggactgaacacagaggactcaccatggagttcgggctgagctgggtttttccttgctgctatcttaaaaggtgtccagtgtgaagtgcagggtggtggagtcgtgggggagccttggtaaagccgtgggggtcccttagagtctcctgtgtggcctctggattcactttcagtaatggctggatgagttgggtccgccaggctcgagggaggggctggaggtgggtggacgtttacgaaaagtaaaatgagtggtagaagaaatagactagtgcaccgtagaaagganatcacatctacaagagaataattaacaaaaacgtacggtagtaatttagactaaagtgaacagtacctagaaaaccgagaacacagcctatattactagtaccanagtattacggaagtcgacagtacggaacggtaaaggaggtactacgttgtaccgtttttagaatttacgtccggttacggggaccccgaggggtacctaggtcggg

SEQ ID NO: 114152 - DNA, 811 bp, Homo sapiens
  misc_feature: GYAE6OF02IJWVI.15.86.H09.1.454.CMB.1.raw
  modified_base (301)..(301): a, c, t, g, unknown or other
  misc_feature (301)..(301): n is a, c, g, or t
  modified_base (739)..(739): a, c, t, g, unknown or other
  misc_feature (739)..(739): n is a, c, g, or t
tcagtctacgtagccacgaccggtgctcgatttagtgctatagacttggtttggggggaggaggaggccccgagccttgggagtccccaacgtgttttctatttcagtgatcaggactgaacacagaggactcaccatggagttcgggctgagcgttggttttccttgctgctatacttaaaggtgtcagtgtgaagtgcaggtggtggagtcgtgggggagccgttagggtaaagccgttcgggggtcccttagacggttcttccgtgtggtacggccttcgtggtattccgtacctttnagttaatggcgtggatgtaggttcgggtccgccgaggcctccgagggggaacgggcgtcggaggttggggttaggtacgtttacgaaaaaggtaaaaagtgagttagggtgaaacggtaaagtaagtacgtaacggtgaaccacccggtaggaaaaggtaagtaagttaccgacctaagtactacgtaaagaagtaagtaaattaacgtaaaaaacgaacgggtttgttaaagtttaccgagtaaaaattacgaaaacggagtaccccgtaaaagaaaaccgggtaaacgaccgtaaacacggaccgttaccgttaattaaccgtagttaaccccgacgttaaacgatttaaccgggtaagtacgacccttaagtcccgggaaaacggtttaaacgggggacttaacgttaacggtacggtttacccggttttttaanaaaggttttaccgttacccggggttacggggggacccccctaaaagggggttacccaaaggtttttccgggg

SEQ ID NO: 114153 - DNA, 568 bp, Homo sapiens
  misc_feature: GYAE6OF02JDDOQ.15.86.H09.1.454.CMB.1.raw
  modified_base (359)..(359): a, c, t, g, unknown or other
  misc_feature (359)..(359): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttacaaaagtaaaatgatggtnagaaatagactacggtgcaccgtgaaaggagattacacatctacaagagaataattacaaaacgcggtgttaatttgacaaatgaacagacctagaaaaccgaggaacacgagcccgtactaattaccgtacgtaaccacagattcggaagtgacatacgacgtaaaggngactatgtctttagattatcgtgggccagggacagtcgg

SEQ ID NO: 114154 - DNA, 680 bp, Homo sapiens
  misc_feature: GYAE6OF02FFHMT.15.86.H09.1.454.CMB.1.raw
  modified_base (157)..(157): a, c, t, g, unknown or other
  misc_feature (157)..(157): n is a, c, g, or t
  modified_base (176)..(176): a, c, t, g, unknown or other
  misc_feature (176)..(176): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (353)..(353): a, c, t, g, unknown or other
  misc_feature (353)..(353): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccagtggagttcggctgagcgtgtttcgngagtcgactatacgtaagntcagtgagagtgagnggtgnggtgtcggaggcgtcgttaggacgcggtcggtcctgctctcgtgtcgcgtcctagtgtacttntaccttggaattgccggntggngtggttcggccgccgaggcgtcggaggagggtgtgttaggaggttaggtaactacgtaaaagttaagtaagngtaagtaagaaccgtaagtacgtacgtacgtacgacgaacggtaagaacgtaactactaacacataacgtaacgaataacgtaaactaacgtaacgaacgttgtaagtaccaaacgtaacgaagaccgaaccgttaacgaaccgaacggaaccgtttagacctaccgtacttacgttaactaccgtacgtaacgaaccggtaagttacgtaacggtacgtaacgacttaacggaacgttaaccgtaaggttactacgtttacgacttacggtacgttaacggcgtaggtcccgtaacggtacggtactaccggtttcggacccttag

SEQ ID NO: 114155 - DNA, 582 bp, Homo sapiens
  misc_feature: GYAE6OF02IVBYW.15.86.H09.1.454.CMB.1.raw
  modified_base (527)..(527): a, c, t, g, unknown or other
  misc_feature (527)..(527): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttgggtaaagccgtggggggtcccttagagtctcctgtgtggcctctggattcactttcagtaatggctggatgagttgggtccgccaggctccagggaaggggctggagtgggttggacgtttcaaaagtaaaatgatggtgagaaatagactaggtgcacccgtagaaaggaagattcacatctacaagagataattacaaaaacaacggtagtaatttagacaaatgaacagacctagaaaaccgagacacagccgtctattactgtaccacaagattacgggaagtgactatcggacgtaaaggnggacttaatgtacttttgaattattcggtcggggaccctagggacctagtacggg

SEQ ID NO: 114156 - DNA, 602 bp, Homo sapiens
  misc_feature: GYAE6OF02HQW0U.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccttagagtctcctgtgtggcctctggattcactttcagtaatggctggatgagttgggtccgccaggctccgaggggagggcgtggaggtgggttggacgtttacgaaaagtaaaatgagtggtagaagaaaatagactacggtgacaccgtagaaaggaagattacacatctacaagagaataatacaaaaacggtacggtagttattagacaaatgaacagacctaagaaaaccgaggaccacacgccgtactattactgtaccacagattacgaagtgacagtaccgagtaaaggacggacttaagtggtactttttagatttacgtcgtacgggggaccccaaggggtacctaagttcggg

SEQ ID NO: 114157 - DNA, 555 bp, Homo sapiens
  misc_feature: GYAE6OF02F9W70.15.86.H09.1.454.CMB.1.raw
  modified_base (472)..(472): a, c, t, g, unknown or other
  misc_feature (472)..(472): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcacccgtgaaaggaagattcaccatctacaagagataattacaaaaacgacggtagtatttgacaaatgaacagcctagaaaccgagacacagcctntattactgtaccacagattcggaatgcatcgacgtaaggaggctatgtacttttgattatcgtggggcccagggacaagtcgg

SEQ ID NO: 114158 - DNA, 608 bp, Homo sapiens
  misc_feature: GYAE6OF02ILO02.15.86.H09.1.454.CMB.1.raw
  modified_base (513)..(513): a, c, t, g, unknown or other
  misc_feature (513)..(513): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggcctccgagggaagggggctgggaggtgggtggacgtttacaaaagtaaaatgatggtagaagaaatagactacggtgcaccgtgaaaggaagatacaccatctacaagagaataattacgaaaacgtacggtagttaatttgataaatgaaacagacctagaaaaccgaggaacacagtaccgtacttattacctagtaaccaanagtattacgggaagtnactatacgaggtaaggaggacttagtcgtacttttagaattacgtcggttacggggacccgtagggacctagttccggg

SEQ ID NO: 114159 - DNA, 563 bp, Homo sapiens
  misc_feature: GYAE6OF02HNTNW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcacttttcagtaatggctggatgagttgggtccgccaggctccgaggggaaggggcgtggaggtggggttggacgtttacaaaagtaaaatgatggtagaagaaatagactacggtgcaccgtgaaaggaagattcacatctacaagagataattacaaaacgcggtagtatttgacaaatgaacagacctagaaaaccgaggacacagccgtactattactgtaccacagattcggaagtgcatcgacgtaaggaggctatgtctttgatagtcgtgggacccagggacagtcgg

SEQ ID NO: 114160 - DNA, 626 bp, Homo sapiens
  misc_feature: GYAE6OF02IHTEP.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaggggcgtggaggtgggttggacgtttacaaaagtaaaatgaatggtagaagaaatagactacggtgacacccgtagaaaggaagacttacaccatctacaagagataattacaaaacgtacggtagtatttagacaaagtagaacagactaagaaaaccgaggaacacgagcgtactattactagtaccacgagacttacggaagtacgcgtagtacgaacgttaaagggacggtacttagttggttacgttttagaacgtttacgttacggttacggggaccccgtaagggtaccgtaaggttacggg

SEQ ID NO: 114161 - DNA, 561 bp, Homo sapiens
  misc_feature: GYAE6OF02GUUBV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaatgatggtgagaaaatagactacggtgcaccgtgaaaggaagattcacatctacaagagataattacaaaaacgacggtagtatttgacaaatgaacagacctagaaaccgaggaacacagaccgtactattactcgtaccacagattcggaagtgacatacgacgtaaggaggctatgtcgtttgattatcgtgggacccagggacagtcgg

SEQ ID NO: 114162 - DNA, 561 bp, Homo sapiens
  misc_feature: GYAE6OF02JA9LS.15.86.H09.1.454.CMB.1.raw
  modified_base (397)..(397): a, c, t, g, unknown or other
  misc_feature (397)..(397): n is a, c, g, or t
  modified_base (503)..(503): a, c, t, g, unknown or other
  misc_feature (503)..(503): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaaagtaaaatgatggtgagaaatagactacggtgcaccgtgaaagagatcacatctnaagagataattacaaaaacgcggtagtaatttgacaaatgaacagaccctaggaaaaccgaggaacacagcctactattactgtaccacagattacggaagtcganatcgacgtaaaggaggctaatgtcttttgattatcgtcgggcccagggacaagtcggg

SEQ ID NO: 114163 - DNA, 558 bp, Homo sapiens
  misc_feature: GYAE6OF02JSUVB.15.86.H09.1.454.CMB.1.raw
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
  modified_base (536)..(536): a, c, t, g, unknown or other
  misc_feature (536)..(536): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccagggaaggggctggagtgggttggacgtttcaaagtaaaatgatggtgagaaatagactacggtgcaccgtgaaaggagattcacatcacaagagataatcaaaaagtcggtagtatttgactaaatgaacagacctagaaaaccgnggacacagccgtactatacngtaaccacgagattacggaagtgacatacgacgtaaggaggctatgtactttgaatcttcgngggacccaggtacgagttcggg

SEQ ID NO: 114164 - DNA, 570 bp, Homo sapiens
  misc_feature: GYAE6OF02HJMHK.15.86.H09.1.454.CMB.1.raw
  modified_base (471)..(471): a, c, t, g, unknown or other
  misc_feature (471)..(471): n is a, c, g, or t
  modified_base (518)..(518): a, c, t, g, unknown or other
  misc_feature (518)..(518): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgccaggctccgagggaaggggctggagtgggttggacgtttacaaaagtaaaaatgatggtagaagaaaatagactacggtgacaccgtagaaaggagattcacatcacaagagataatacaaaaacgcggtatattgacaaatgaacagctagaaaacgagacacagccgtntaattctagtaccagagtattcggaagtgacagtacgacgtaaaggnggactagtgttactttagattacgtcgtggggacccaggggactaagtcggg

SEQ ID NO: 114165 - DNA, 569 bp, Homo sapiens
  misc_feature: GYAE6OF02GFBKN.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctgggagtgggttggacgtttacaaaagtaaaatgatggtgaagaaaatagactacggtgcaccgtgaaaggagattcacatctacaagagataattacaaaacgcgtagtatttagactaaatgaaacagacctagaaaaccgaggacacgagccgtactattactgtaaccagagtagttacggaagtgacatcgacgtaaggaggactatggtcttttgattagtcgtgggcccagggactagtcgg

SEQ ID NO: 114166 - DNA, 616 bp, Homo sapiens
  misc_feature: GYAE6OF02H3VOL.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttggccgccaggctccgagggaggggctggaggtgggttggacgtttacaaaagtaaaatgaatggtagaagaaaagtagaacgtacggtgacgaccggtagaaaggaagattaccaactatctacaaagataattaaacttaacgaaaaacggtacggtagttaatttgaactaaatgaaacagacctaaggaaaaccgaggaacacgacgtaccgtacttaacttactacgtaaccactaagtacgttacggaagtgactagtacgacggtaaggcgactagtgtacttttgattagtcgtcgggaccaggactagtcgg

SEQ ID NO: 114167 - DNA, 544 bp, Homo sapiens
  misc_feature: GYAE6OF02IB81Q.15.86.H09.1.454.CMB.1.raw
  modified_base (185)..(185): a, c, t, g, unknown or other
  misc_feature (185)..(185): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctcgatcaagctcacctgcaccctaagtagtgagcatacgaacctacaccatcgaatggtatcaacagagaccagggaagtccccccagtatataatgaaagttaagagtgatggcagccacaccgaaggggacggatccccgatcgcttcatgggctccagttctggggctgaccgctacctcaccatcctcccaacctccagtctgacgatggaggctgagtatacagtgtaggagagagccgacaacaattgagtacgcgaaggcgggtttgggtacggttcggggcggagggaacccgaagtccgtaggtacccggtccgtaggtacaacccgg

SEQ ID NO: 114168 - DNA, 615 bp, Homo sapiens
  misc_feature: GYAE6OF02H14R7.15.86.H09.1.454.CMB.1.raw
  modified_base (564)..(564): a, c, t, g, unknown or other
  misc_feature (564)..(564): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccttagagtctcctgtgtggcctctggattcactttcagtaatggctggatgagttgggtccgccaggctccgaggggaaggggctgggaggtggggttggtacgttttacgaaaaaggttaaaaataggtaagtggtagaagaaaatagacgtacggtgcaacccgtagaaaaggaagattacaccatctacaagagaattaattacgaaaaacgtcggtagttaatttgaataaatacgaacacgacctaacggaaaaccgaggaacacgagaccgtacttattactacgtaccacagtattacggaatgacagtcgagtaaaggnggacttagttgtcttttagattagtcgtgggacccgaagggactaagtcgg

SEQ ID NO: 114169 - DNA, 571 bp, Homo sapiens
  misc_feature: GYAE6OF02G2XRD.15.86.H09.1.454.CMB.1.raw
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccagggaaggggctggagtgggttggacgtttacaaaagtaaaatgatggtgagaaaatagactacggtgcaccgtgaaaggaagattcacatctacaagagataatacaaaaacgcgtagtaatttgacaaatgaacagcctagaaaaccgagacacagccgtntattactagtaccanaagattcggaagtgcagtcgaggtaaaggaggtctagttgtcttttagattagttccgtggggcccaagggtactaagttcggg

SEQ ID NO: 114170 - DNA, 559 bp, Homo sapiens
  misc_feature: GYAE6OF02HRIGN.15.86.H09.1.454.CMB.1.raw
  modified_base (458)..(458): a, c, t, g, unknown or other
  misc_feature (458)..(458): n is a, c, g, or t
  modified_base (487)..(487): a, c, t, g, unknown or other
  misc_feature (487)..(487): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccagggaaggggctggagtgggtggacgtttcgaaaagtaaaatgatggtgagaaaatagactacggtgcaccgtgaaaggagatcacatctcaagagataatacaaaaacgtacggtagtattgactaaatgaacagctagaaaaccgnggacacgagccgtactattactgtaccanagattcggaagtgcatcgacgtaaaggaggctatgtcttttgattatcgtggggcccagggacaagttcggg

SEQ ID NO: 114171 - DNA, 855 bp, Homo sapiens
  misc_feature: GYAE6OF02H37OA.15.86.H09.1.454.CMB.1.raw
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
tcagtctacgtagccacgaccggtgctcgatttagtgctatagacttgggtttgggggagaggagccccggagccttggggatccccaagtgttttcattcagtgatcaggactgaacgacgagaggactagaccatgagttcggcctgagctgggttttccgttgctggctagtcttaaaaggtgtccagtgtgaagtgcaggtggtggngtcgtggggngccttggaaagcgtgggggtccttagacgtctcctgtgtcggcctcgtcggattccacttttcgagttaagtggacttagggattaggtaggtttcggggtacccgtccgaacgggtaccgtacccggaaggggaacgggggtaccgtacgggtaaccggttaggggtttaacgtaacggttttaacgtaaaaaaggttttaaaaaagtggtaagttagggtacgtaaacggtaaaagttaaggtaaccgttaacgggtacgtaccgtaaccccggttaggtaaaacgggtaaagtacgttaaccgtaaccgtaacgtccttaaacgaacggtaacgtaaacctttaaacgttaaccgtaaaaaaccggtccgggttttaagttacgtttacggaaactaaaacgttaggtaaaaccacgggtaccgttaaacggaaaacccgggacgggtaaataaccgtaacgtacccgtttacttaacgttaacctagttaaccctaacgaacggtaacgttaccggtaagttcgtaccgtaagtaccggtaacgtaaacgggtcgtaacgttagtacgttaccgttttagacgtttagtccggttaccgggacccccgtagggtaccctaagttcccggg

SEQ ID NO: 114172 - DNA, 589 bp, Homo sapiens
  misc_feature: GYAE6OF02HIC1D.15.86.H09.1.454.CMB.1.raw
  modified_base (301)..(301): a, c, t, g, unknown or other
  misc_feature (301)..(301): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
  modified_base (491)..(491): a, c, t, g, unknown or other
  misc_feature (491)..(491): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccnccaggctcgaggggagggctggagtgggttggacgtttacaaaagtaaaatgatggtagaagaaaatagactacggtgacacccgtagaaaggagattacacatctanaaganataatacaaaacgtcggtagtattganaaatgaacagcctagaaaaccgaggaacacagcctatattactataccanagatttcggaagtgctaagtccgaacggtaaaggacgggtctaattcggtacttttaggatttaagtcggtacggggacccgaagggtacagttcggg

SEQ ID NO: 114173 - DNA, 603 bp, Homo sapiens
  misc_feature: GYAE6OF02IG666.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccttagagtctcctgtgtggcctctggattcactttcagtaatggctggatgagttgggtccgccaggctccgagggaaggggctgggaggtgggttggacgtttacaaaagtaaaaatgaatggtagaagaaaatagactacggtgcaacccgtagaaaggaagattacaccatctacaagagataattacgaaaaacgacggtagttaattgactaaatgaaacagacccgaaaaccgagaacacacgccgtatacttactcgtaaccacgagtagttacggaagtcgactagtaccgaacgtaaggaggctaatcgtattttagatagtcgtacggggcccaagggacctagtggttaccgg

SEQ ID NO: 114174 - DNA, 571 bp, Homo sapiens
  misc_feature: GYAE6OF02F5R7C.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggctgggagtgggttggacgtttcaaaagtaaaatgatggtgagaaatagactacggtgcaccgtgaaaggagattcaccatctacaagagaataattacaaaacgcggtatatttgacaaatgaacagacctagaaaccgaggaacacagcctctattactagaccacagacttcggaatgacatacggacgtaaagggaggtctagtgtcttttagattacgtcgtggggacccaggggacaagttcggg

SEQ ID NO: 114175 - DNA, 609 bp, Homo sapiens
  misc_feature: GYAE6OF02HVU8C.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagttaatggctggatgagttcgggtccgccaggctccgaggggaaggggcgtgggaggtgggttggacgtttacaaaagtaaaatgatggtagaagaaaatagactacggtgaccaccggtagaaaggaagacttcaaccatactacaagagaattaattaacaaaaacggtacggtagttaatttagactaaatgaaacagacctaaggaaaaccgagacacacgccgtactacttactactaccacagtattacggaagtgacagacgaacggtaaggacggtctagtgtacttttgattacgtcgtaggggcccagggactaaggtcgg

SEQ ID NO: 114176 - DNA, 583 bp, Homo sapiens
  misc_feature: GYAE6OF02HYI1G.15.86.H09.1.454.CMB.1.raw
  modified_base (508)..(508): a, c, t, g, unknown or other
  misc_feature (508)..(508): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctgggagtgggttggacgttttacgaaaagtaaaaatgaatgggtagaagaaaatagactacggtgcaccgtgaaaggaagattacacatctacaagagaataacttacaaaaacgtacggtagttaatttgactaaaatgaacagacctagaaaaccgaggacacagccgtactattactgtaccanagattacggaagtcgacatacgacgtaaaggaggacttagtgtctttagatatcgtgggcccagggacagtcggg

SEQ ID NO: 114177 - DNA, 563 bp, Homo sapiens
  misc_feature: GYAE6OF02G9BLV.15.86.H09.1.454.CMB.1.raw
  modified_base (475)..(475): a, c, t, g, unknown or other
  misc_feature (475)..(475): n is a, c, g, or t
  modified_base (531)..(531): a, c, t, g, unknown or other
  misc_feature (531)..(531): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtggggttggacgtttacaaaagtaaaatgatggtagaagaaatagactacggtgcaccgtagaaggagattcacatctacaagagataattacaaaacgcggtagtatttagactaaatgaacagcctagaaaccgaggacacagccgtntaatactagtaccacagtacttacggaagtgacagtcgacgtaaggagtctatgtntttagatacgtcgtggacccgaggacagtcgg

SEQ ID NO: 114178 - DNA, 506 bp, Homo sapiens
  misc_feature: GYAE6OF02GL9Q2.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaatgatgcaagcggttgggtgttcggcggtaggaccagctgaccgtctaggtcacgg

SEQ ID NO: 114179 - DNA, 600 bp, Homo sapiens
  misc_feature: GYAE6OF02I1HTC.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcacttttcagtaatggctgggatgagttgggtccgccaggctcgagggaaggggctggagtgggttggacgtttcaaaagtaaaatgatggtagagaaaatagactaggtgacaccgtagaaaggaagattacacatctacaagagataataccaaaaacgacggtagtattgacaaatgaacagacctagaaaacgaggacacgacgccgtactaagttactgtaccacagtacttacggaagtgctaagtccgaacggtaaaggacggtacttaactggtctttttagatttagtaccggttggggaccccgtaagggaccgaaggttcggg

SEQ ID NO: 114180 - DNA, 557 bp, Homo sapiens
  misc_feature: GYAE6OF02GYAOC.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactaggtgacaccgtgaaaggagattcacatctacaagagataatacaaaacgacggtagtatttgacaaatgaacagcctagaaaaccgagaacacagcctctattactgtaccacagattacggaagtgctatcgacgtaaggaggtctatcgtcttttagatatcgtgggcccagggacagtcgg

SEQ ID NO: 114181 - DNA, 751 bp, Homo sapiens
  misc_feature: GYAE6OF02IJCUG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggccgccaggctccgagggaggggctgggaggtgggttggacgtttacaaaagtaaaatgagtggtagaagaaagtagacgtacggtagaccaaccggtagaaaaggaagtacttaccaacctaattccaacgaaaggaagtaattaaacttaacgaaaaaaccgggtaacggttagttaatttggaactaaaagtcgaaaactacgtaaccccgtaaaggaaaacccggacggaaaccacaaccgggtacccttacgtttaaacttaaccgttacggttaaccccaagtaacgggttaacgtttaaccggggaaagttcgaaaccgttaagttaacccgggaaacgggttaaaacggggaggtaaccttaaggttcgttaccgttttttaagaactttacggttacccgggtccggggtaacccccggaaggggtaacccgtaaggttccgggg

SEQ ID NO: 114182 - DNA, 673 bp, Homo sapiens
  misc_feature: GYAE6OF02I804Y.15.86.H09.1.454.CMB.1.raw
  modified_base (306)..(306): a, c, t, g, unknown or other
  misc_feature (306)..(306): n is a, c, g, or t
  modified_base (357)..(357): a, c, t, g, unknown or other
  misc_feature (357)..(357): n is a, c, g, or t
  modified_base (384)..(384): a, c, t, g, unknown or other
  misc_feature (384)..(384): n is a, c, g, or t
  modified_base (498)..(498): a, c, t, g, unknown or other
  misc_feature (498)..(498): n is a, c, g, or t
tcagtctacgtagccacgaccggtgctcgatttagtgctatagacttgggtttgggggggtaggaggagccccagccttgggactccccaagtgttttcattcagtgatcaggactggaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccncaggctcgagggaaggggctggagtgggttggacgtttcaaaaagtaaaangatggtagaagaaaatagatacggtancaaccggtagaaaaggaagacttcgaacctatctacaaagagaattaattaacaaaaaacggcggttagttaatttgaactaaaagtgaaacacgtacctaaggaaaaaaccgnggaaccaacgaacgtcccgtacttaacgttaactacgttaacccaacgtagaacgtttgggaaaagtgacctaagttaccgaaacggttaaaaggacgggtaacttaattcggtactttttaggaacttaagttcgtaccgggggacccctaagggggtaaccaaggttccgggg

SEQ ID NO: 114183 - DNA, 564 bp, Homo sapiens
  misc_feature: GYAE6OF02HGIHJ.15.86.H09.1.454.CMB.1.raw
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcacttttcagtaatggctggatgagttgggtccgccaggctccgagggaaggggctggagtgggtggacgtttacaaagtaaaatgatggtgagaaatagactacggtgcaccgtgaaaggagattcacatctacaagagataattacaaaaacggtacggtagtatttagactaaatgaacagacctagaaaaccgagacanagcctctattactagtaccanagattacggaagtgcatcgagtaaggcggatatgtctttagattacgtcgtcggggacccagggacaagtcggg

SEQ ID NO: 114184 - DNA, 561 bp, Homo sapiens
  misc_feature: GYAE6OF02IPV1R.15.86.H09.1.454.CMB.1.raw
  modified_base (519)..(519): a, c, t, g, unknown or other
  misc_feature (519)..(519): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgccaggctccagggagggctggagtgggttggacgtttcgaaaagtaaaatgatggtagaagaaaatagactaacggtgacacccgtagaaaggaagattcaccatctacaagaagataatacaaaaacgcggtagtaatttgacaaatgaacagactagaaaccgaggacacagccgtctattactgtaccacagattacgaagtgcatcgacgtaaggnggctatgtactttgatatcgtcgggcccgagggacagtcggg

SEQ ID NO: 114185 - DNA, 660 bp, Homo sapiens
  misc_feature: GYAE6OF02I8CYZ.15.86.H09.1.454.CMB.1.raw
  modified_base (363)..(363): a, c, t, g, unknown or other
  misc_feature (363)..(363): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttggtccgccaggctccagggaaggggctgggagtgggttggacgtttacaaaagtaaaatgatggtanagaaatagactacggtgcaccgtagaaaggaagattacgacatctacgaagagaataattacaaaaacgtacggtagtatttagacaaatagaacagacctagaaaaccgaggaacacgagccgtacttattactacgtaccaacgaggtaacttccgggaaagttcgacgtaacgttaccggaacggttaaacggggaaggtaccgtttaagtcggttaccgttttttaaggaacttttacggttaccggttcggggggaacccccctaaggggggtaaccctaaggttaccgggg

SEQ ID NO: 114186 - DNA, 578 bp, Homo sapiens
  misc_feature: GYAE6OF02G05G2.15.86.H09.1.454.CMB.1.raw
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
  modified_base (525)..(525): a, c, t, g, unknown or other
  misc_feature (525)..(525): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaaggggctggaggtgggttggacgtttcaaaagtaaaatgatggtagagaaaatagactacggngacaccgtagaaacggagatcacatctacaaganataatacaaaaacgtcggtagtaattgacaaatgaacacgacccgaaaacgaggaacacgagccgtatattactgtaccacagattacggaagtgacaatcgaacgtaaggngactagtgttactttgattagtcgtcggggaccctagggactagtggttaccg

SEQ ID NO: 114187 - DNA, 763 bp, Homo sapiens
  misc_feature: GYAE6OF02J3UI6.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaggtgtccagtgtgaagtgcgaggtggtggagtcgtggggagtccgttaggtaaacgccgtcgggggttcccttagcgtctccgtggtgtcggccttcgtggtacttctactttcgaacgttaagtggcgtggtagtggtacggttcgggtcccgccgacggccgtaccggaggggaaggggtcgtagggtaggtgggttaggtaacgtttaacgaaaaagttaaaagtgaagtaggtagaaagaaaagtacggtaacgtacggtacgaccgtaaccggtaaggaaaacggaacgtacttacaacctaactacgtaacgaagtaagtaacttaaacgtaaacgaaaaacggtggttagttaattagaactaaagtacgaaaccaacgtacctaaaggaaaacccggagtaaccaacgtaacgtacccgttaacttaaacgttacgtacgtaaccctaagaacggttacgttaaccggaaattcggaaactacggtaaccggtaacggtaagggtacgtacttagtacggtttacgtttaggaacttacgggtccggaccggggtaccgaacgggttactacgggttccggg

SEQ ID NO: 114188 - DNA, 641 bp, Homo sapiens
  misc_feature: GYAE6OF02G0ASM.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaagccgtgggggtcccttagagtctctgtgtggcctctggattcactttcagtaatggctggataaggttgggtccgccgaggctccgaggggaaggggcgtgggaggtggggttggaacggttttacgaaaaagtaaaatggagtggtagaagaaaatagacgtacggtgccaccgtagaaaggaagattacacatctacaagagataattacaaaacgacggtagtatttgactaaatgaaacagacctaagaaaccgaggaacacgacgccgtactattactacgtaacccacgaagtagttacggaagttcgacaacgtacggaaggtaagggcggtacgtagttacgttacttttagacgtttaagtccggtacggggaccccgtaaggggaactacggttggttacccgg

SEQ ID NO: 114189 - DNA, 669 bp, Homo sapiens
  misc_feature: GYAE6OF02IPS4R.15.86.H09.1.454.CMB.1.raw
  modified_base (466)..(466): a, c, t, g, unknown or other
  misc_feature (466)..(466): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctgggggtcccttagagtctcctgtgtggcctctggattcactttcagtaatggctggatgagttgggtccgccaggctccgagggaaggggctgggagtgggttggacgtttacaaaagtaaaatgatggtagagaaatagactacggtgacaccgtagaaaggagattacaccatctacaagagataatacaaaacgacgtgtaattgacaaatgaaacagaccctaggaaaacccgnggaaccaacgacgaccgtacttaattaccgtacgtacccaacgagtaacgtttaccgggaagtacgtaccgtaacttaccgggaacggttaaaaagggcggtaaccgttaagttaccgggtttaccttttttaaggaacgtttacgtttccgggttaccggggggaacccccgtaagggggtaacctaaacggtttccggggg

SEQ ID NO: 114190 - DNA, 602 bp, Homo sapiens
  misc_feature: GYAE6OF02GSHJL.15.86.H09.1.454.CMB.1.raw
  modified_base (406)..(406): a, c, t, g, unknown or other
  misc_feature (406)..(406): n is a, c, g, or t
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgtgacgtgctatacttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccagggaaggggctggagtgggttggacgtttacaaaagtaaaatgatggtgaagaaatagactacggtgacaccgtgaaaggaagattcaacatctnaagagaataattacaaaacgaggttataagtttgacaaatacgaaacagacctaagaaaaccgaggaacacagcccgtntacttactgtaccanagtattacggaatcgacacgtcgaacggtaaaggacggtactagttcgttacttttaggaactagttcggtacggggaccctaaggggactaaggttccggg

SEQ ID NO: 114191 - DNA, 671 bp, Homo sapiens
  misc_feature: GYAE6OF02FR2OE.15.86.H09.1.454.CMB.1.raw
  modified_base (363)..(363): a, c, t, g, unknown or other
  misc_feature (363)..(363): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgtaggttcgggtccgccaggctccgaggggaaggggctggaggttgggttggaacgtttaacaaaagttaaaangagtaggtagaagtaaaatagaacgtacggtcgaccgaaccgtaggaaaaggaagattaccaactatactacgaaagataataaattaaccgaaaaacggtcggttattaatttacgaactaaagtacgaaaccacgaaccgtaaaggaaaccgaggaacacacgtcctataacttacacgtaccataagtacgttacgggaattacgactaacggtacgaacggtaaggtcgttaactaggttacgttagtttagaaccgttacggtccgggtaaccggggaccgtaacgggtactacgggttccgg

SEQ ID NO: 114192 - DNA, 667 bp, Homo sapiens
  misc_feature: GYAE6OF02IP6BW.15.86.H09.1.454.CMB.1.raw
  modified_base (483)..(483): a, c, t, g, unknown or other
  misc_feature (483)..(483): n is a, c, g, or t
tcagtctacgtagccacgaccggtgctcgatttagtgctatagacttgggtttgggggggggagaggagccccagcctttggggatccccgaagtgttttccattcagtgatcaggactgaacacagaggactcaccataggagttcgggctgagctgggttttcccttgctgctatcttaaaaggtgtccagtgtgaagtgcaggtggtggagtctgggggagccgttgggtaaaagccgtgggggtcccttaggagtctcctgtgtggcctctggattcactttcagtaatggtctggatgagttgggtccgccaggctccgagggagggctgggagtgggtgtacgtttacgaaaagtaaaagtgagtggtagaagtaaaatacgatacggtgacaaccggtaggaaaggagtattacaactatcctacaagagtataaagtacaaaaacgtagtcgttaattgaactaaagtacgaaanagaacctaacggaaaacccgaggaacctaacgacgacccgtactaacttaccgtacgtaacccaacaacgtaacgttccgggaaagtcgaccgtatacggtaaccggtaaaggaggtaccttaatcggttacttttaggaattacgtacggtcggggacccctaaggggtactaaggttccggg

SEQ ID NO: 114193 - DNA, 563 bp, Homo sapiens
  misc_feature: GYAE6OF02JCEDC.15.86.H09.1.454.CMB.1.raw
  modified_base (496)..(496): a, c, t, g, unknown or other
  misc_feature (496)..(496): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaaggggctggaggtgggttggacgtttcaaaagtaaaatgatggtgagaaaatagactacggtgcaccgtagaaaggagattcacatctacaagagataatacaaaaacgcggtagtatttgactaaatgaaacagacctaggaaaaccgaggaacaacgagcccgtatattactgtaccanagattcggaagtgacatacgacgtaaaggnggctatgtctttgatatcgtgggccagggacagtcgg

SEQ ID NO: 114194 - DNA, 899 bp, Homo sapiens
  misc_feature: GYAE6OF02I1OBG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgctaggtggtggaggtcgtgggggagccgttaggtaaacgccgtgggggtcccttagagtctcctgtgtcggcctctggattctactttcagttaatggctggatgtaggttacgggtccgcgaggcctaccgaggggaacggggccgtgggtacggttggggttacgggtaacgtttacgaaaaaggtaaaagtggaagtggtagaagaaaataggaacgttacggtagaccgtaacccggtaggaaaagggaaacgtacgttaccgaaacctagtaccgtaacaaacggaagtaaattaaactttaaaccgaaaaaacggtacgggttaagttaagtttagaaactaaaacgtacgaaacgtaacgtacccgtaaaggtaaaaaacccggagggtaaacccaaaccgtaacggtaccccggtttaacttaaacgttttaacccgttaaccggtaaaccccgtaaagttaacgggttaacgtttaacccggggttaaacggttacggtaaccgtaacgggtttaacccgggtaaaccggggtttaaaaacgggggaaccggggttaacccgtttaaaggtttaaccggttaacccggtttttttaaagggtaaaccgttttacggttacccgggggtttaacccggggggttaacccccggaaacggggggtttaaacccgtaaccgggtttttacccgggggg

SEQ ID NO: 114195 - DNA, 588 bp, Homo sapiens
  misc_feature: GYAE6OF02HMG0I.15.86.H09.1.454.CMB.1.raw
  modified_base (415)..(415): a, c, t, g, unknown or other
  misc_feature (415)..(415): n is a, c, g, or t
  modified_base (509)..(509): a, c, t, g, unknown or other
  misc_feature (509)..(509): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaagggggctgggaggtgggttggacgtttacaaaagtaaaatgaatggtagaagaaaatagactacggtgcacccgtaggaaaggaagattcacatcanaagagataaattacaaaaagacggtagttaattgactaaatgaaacagcctaagaaaaccgaggaacaacacgccgtactattactagtaccanagacttcgaagtancaatcgaagtaaggaggtactatagtcttttagattatcggtcgggacccgagggacagttcggg

SEQ ID NO: 114196 - DNA, 560 bp, Homo sapiens
  misc_feature: GYAE6OF02IO3VD.15.86.H09.1.454.CMB.1.raw
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (512)..(512): a, c, t, g, unknown or other
  misc_feature (512)..(512): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctccgagggaggggctgggagtggggttggacgtttacaaaaggtaaaatgagtggtagaagaaaatagactacggtgaccaccgtagaaaggagattcaccatcacaagagataatacaaaacgtcggtatattagataaatgaacagacctagaaaaccgngacangaccntatatagacangatacgatgcatcgacgtaagnggctatgtacttttagattagtcgtcggggaccaagggtacaagtcgg

SEQ ID NO: 114197 - DNA, 570 bp, Homo sapiens
  misc_feature: GYAE6OF02HIUB1.15.86.H09.1.454.CMB.1.raw
  modified_base (546)..(546): a, c, t, g, unknown or other
  misc_feature (546)..(546): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttacgaaaagtaaaatgagtggtagaagaaaatagactaggtgcaccgtagaaaggagattcacatctacaagagataatacaaaacgcggtagtaatttgacaaatgaacagacctagaaaacccgaggaacacacgccgtactattactgtaaccacagtattaccgaagtgacgatacgacgtaaggcggactatgtcttttgaattntcgtgggacccagggtacagtcgg

SEQ ID NO: 114198 - DNA, 614 bp, Homo sapiens
  misc_feature: GYAE6OF02HYTVC.15.86.H09.1.454.CMB.1.raw
  modified_base (305)..(305): a, c, t, g, unknown or other
  misc_feature (305)..(305): n is a, c, g, or t
  modified_base (454)..(454): a, c, t, g, unknown or other
  misc_feature (454)..(454): n is a, c, g, or t
  modified_base (532)..(532): a, c, t, g, unknown or other
  misc_feature (532)..(532): n is a, c, g, or t
tcagtctacgtagccacgaccggtgctcgatttagtgctatagacttgggtttgggggggaggagggaggccccagccttgggatcccaagtgttttcattcagtgatcaggactgaacacagaggactcaccatggagttcgggctgagctgggtttccttgctgctatcttaaaaggtgtccagtgtgaagtgcaggtggtggagtctgggggagccttgggtaaagcctgggggtccttagaggtctctgtgtggcctctggattcactttcagtaatggctggatgagtgggtcgccaggntccagggaggggctggagtgggtggacgttttcaaaagtaaaaatgaatggtagagaaaatagactaacggtgacacccggtgaaaggaaagattacaccaatctacaaagtaagataaattacaaaaacgacggtaagtatttcgganaaaatgaaaacagacctagaaaacccggagaacaacagccgtacatttaactagtaccaactagattacgggaaagtnacaatcgaacggttaaaggacgggactaagtgctttttagacttagttactggggggaccccaggggtaccaagttacgggg

SEQ ID NO: 114199 - DNA, 625 bp, Homo sapiens
  misc_feature: GYAE6OF02FLLTS.15.86.H09.1.454.CMB.1.raw
  modified_base (401)..(401): a, c, t, g, unknown or other
  misc_feature (401)..(401): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaaggggctggaggtggggttggacgtttacgaaaagtaaaatgatggtagaagaaaatagactacggtgcaccggtagaaaggaanattcacatcacaagagaataattacaaaaacggacggtagtatttagactaaatgaacagacctaagaaaaccgaggaacacgacgacccgtacttaacttactacgtacccacaagtactttacggaagtcgacagtaccggaacgtaaagggaggtactagttcggtactttttaggatttacgtcggtacgggggacccctaaggggtacctaagttcggg

SEQ ID NO: 114200 - DNA, 540 bp, Homo sapiens
  misc_feature: GYAE6OF02FGYDG.15.86.H09.1.454.CMB.1.raw
  modified_base (343)..(343): a, c, t, g, unknown or other
  misc_feature (343)..(343): n is a, c, g, or t
  modified_base (460)..(460): a, c, t, g, unknown or other
  misc_feature (460)..(460): n is a, c, g, or t
tcagtctacgtagccacgaccggtgctcgatttagtgctatagacttgggtttgggggagaggagccccagccttgggatccccaagtgttttcattcagtgatcagcactgagcacagaggactcaccatggaattggggctgagctgggttttccttgttgctattttagaaggtgtccagtgtgaggtgcaactggtggagtctgggggagcctcgtccagccgggggggtccctgagactctcctgtgaagcctctggattcaccttgagcacttatggatgacttgggtccgccaggctccagggaagggctggagtgggtgccaccatacaaaaagntggaagtgaacacaacctatgtgaactctgtgatgggccattcaccgtctccagagacgacgccaagaacctcactacatctgacaaatgaaacaacctgagagccgaggacacggntgtgtattactgtgtgagagatgttctggtcggtttggggaccgacgggtaccctgggtaccacccggttctccctaccg

SEQ ID NO: 114201 - DNA, 593 bp, Homo sapiens
  misc_feature: GYAE6OF02IPJR7.15.86.H09.1.454.CMB.1.raw
  modified_base (517)..(517): a, c, t, g, unknown or other
  misc_feature (517)..(517): n is a, c, g, or t
  modified_base (547)..(547): a, c, t, g, unknown or other
  misc_feature (547)..(547): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaggggctgggagtggggttggacgtttacaaaagtaaaatgaatggtagaagaaaatagactacggtgcaccgtagaaaggaagattacacatctacaagagaataattacaaaaacgacggtagtaatttgactaaagtagaaacagtacctaaggaaaaccgaggaaccaacgagaccgtactattacctagtaacccanagattcggaagtgacatacgacgtaaaggnggactatgtcttttagattctcggtcgggacccagggacagtcggg

SEQ ID NO: 114202 - DNA, 621 bp, Homo sapiens
  misc_feature: GYAE6OF02HIWZI.15.86.H09.1.454.CMB.1.raw
  modified_base (383)..(383): a, c, t, g, unknown or other
  misc_feature (383)..(383): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttcgtgacgtgctatcgtaaaggtgtcagtgtgaagtgcaggtggtggagtctgggggagccttggtaaagccgtgggggtcccttagagtctcctgtgtggcctctggattcactttcagtaatggctggatgagttggtccgccaggctccgagggaggggctgggagttgggtggtacgtttacgaaaaagtaaaatgatggtagtaagaaaactagacttacggngacgaccgtagaaaggaagtagttacaccatctacaagagtaataaatacgaaaaacgtacggtagttaatttcgaactaaagtacgaacagaccgtaagaaaaccggagaacacagaccgtactagttactacgtaccacagtattacggaatcgcaatcgaacgtaagggacgtcgtaattcgtacttttaggattacgtcggtcggggaaccccgaagggtacctaagggttcgg

SEQ ID NO: 114203 - DNA, 568 bp, Homo sapiens
  misc_feature: GYAE6OF02HGDUO.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatggtgagaaatagactacggtgcaccgtgaaaggagatcacatctcagagataattacaaaacgacggtagtatttagacaaatgaacagacctagaaaaccgaggacacacgccgtctattactcgtaccacagtattacgggaagtcgactatacgacgtaagggaggctagtgtacttttgattatcgtgggaccctagggaccaagttcggg

SEQ ID NO: 114204 - DNA, 561 bp, Homo sapiens
  misc_feature: GYAE6OF02HIV0K.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggttggacgtttacaaaagtaaaatgatggtgaagaaatagactacggtgcaccgtgaaaggagatcacatctacaagagataatacaaaacgcggtagtatttgacaaatgaacagacctagaaaaccgaggaccacacgccgtatattactgtaccacagtattacggaagtgacagtacgacgtaaggagctatgtctttagattagtcgtcgggccagggacagtcgg

SEQ ID NO: 114205 - DNA, 676 bp, Homo sapiens
  misc_feature: GYAE6OF02I268L.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtggtttcgtgacgtcgctatacgtaaagtgtccagtgtgaagtgcaggtggtggagtcgtggggagccgttggtaaagccgtgggggtccttagagtctcctgtgtggcctctggattcactttcagtaatggctggatgagttcgggtcccgccaggctccgagggaacggggctggagtgggttggtacgtttacaaaaggttaaaatgagtggtagaagtaaatagacgtacggtgccaccgtagaaaggagtacttacaacctagtactacgaaggtaataataaacgtttacgaaaaacggtcggttagtacgtttagactaaagtagaactacgaccgtaacgaaacgacgaacgtacacgtccgtactagttacgtacgtaccacgtatacgttacggaagttcgactagtacggtaacggtaaagggtacggtctttaaagcggtttaccgttttaggaacgtttacgttaccgggtacggggtaccccgtaagggtaaccgtaggtttacccgggg

SEQ ID NO: 114206 - DNA, 637 bp, Homo sapiens
  misc_feature: GYAE6OF02GVVFD.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagcctgggggtcccttagagtctcctgtgtggcctctggattcactttcagtaatggctggatgagttgggtccgcaggctccgagggaggggctggagtgggttggacgtttacaaaagtaaaatgatggtagaagaaaatagactacggtgcgaccgtagaaagagatcacatcacaagagataattacaaaacgtacggtagttatttgacaaatagaacagctaagaaaccgaggaccacgacgaccgtactagttacctagttaccaacgtagtacgttaccgggaaaggtcgacgacgtacgggtaacggttaaaagggccgggtaacttaaggttaggttcctttttaggacgttacgtttccgggttaccggggaccccgtaagggggtactaacggttcgggg

SEQ ID NO: 114207 - DNA, 621 bp, Homo sapiens
  misc_feature: GYAE6OF02HMHJ5.15.86.H09.1.454.CMB.1.raw
  modified_base (416)..(416): a, c, t, g, unknown or other
  misc_feature (416)..(416): n is a, c, g, or t
  modified_base (539)..(539): a, c, t, g, unknown or other
  misc_feature (539)..(539): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgcaggctccgaggggaggggcgtggaggtgggttggtacgtttacaaaagtaaaatgagtggtagaagaaaatagactacggtgacaccgtagaaaggaagattacacatcanaagagataataacaaaacgtcgtagttatttgacaaatagaaacacgaccgtaaggaaaacccggaggaccacgacgtaccgtactaacttacgtacgtaccacgtagtacgttacggaagtnaacgtatacgacggtaaaggacggtactagtcgttactttaggattacgttcggacggggacccgtagggaccagttccggg

SEQ ID NO: 114208 - DNA, 570 bp, Homo sapiens
  misc_feature: GYAE6OF02HN3HD.15.86.H09.1.454.CMB.1.raw
  modified_base (443)..(443): a, c, t, g, unknown or other
  misc_feature (443)..(443): n is a, c, g, or t
  modified_base (471)..(471): a, c, t, g, unknown or other
  misc_feature (471)..(471): n is a, c, g, or t
  modified_base (516)..(516): a, c, t, g, unknown or other
  misc_feature (516)..(516): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccaggggaaggggctgggagtgggttggacgtttcaaaagtaaaaatgatggtgagaaaatagactacggtgcacccgtgaaaggaagattcaccatctcaagagataattcaaaaaacgcggtgtatttgcaaatgaaacagcctagaaaaccgaggacacagccgtctattactgtacccanagattcggaagtgcatcgacgtaaaggngctatgcttttgatatcgtggggcccagggacagtggtcgtcgtntcttcagcctccgaccaggcccatccggtcctcccctggccaccctctccagcg

SEQ ID NO: 114209 - DNA, 560 bp, Homo sapiens
  misc_feature: GYAE6OF02IDUJS.15.86.H09.1.454.CMB.1.raw
  modified_base (383)..(383): a, c, t, g, unknown or other
  misc_feature (383)..(383): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
  modified_base (516)..(516): a, c, t, g, unknown or other
  misc_feature (516)..(516): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagtggtcgccaggctccagggagggctggagtgggtgacgttcaaagtaaaatgatggtgagaaaatgactacggtgacaccgtgaaacggaanagttcaccgatctacaagagataattacaaaacgacggtgtaattgacaaatgaacagacctagaaaaccgagaacaacgagccgtactatacgtagtaccanacgattcgaagtnacatacgacgtaaaggngctatgtctttagatagtcgtcgggaccaaggacctaagtcggg

SEQ ID NO: 114210 - DNA, 656 bp, Homo sapiens
  misc_feature: GYAE6OF02GZQWI.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgttgacgtgctatacttaaaggtgtccagtgtgaagtgcaggtggtggagtcgtgggggagccgttggtaaagccgtgggggtcccttagagtctcctgtgtggcctctggattcactttcagtaatggctggatgagttgggtccgccaggctccgagggaggggcgtggaggtgggttggacgtttacaaaagtaaaatgagtaggtagaagaaaagtagaacgtacggtgaccgaccgtaggaaaggaagtacgttcaactatactacaaagagaattaacgttaacgaaaaacgtacggttaagttagtttagaactaaataggaaacacgtaccctaaggaaaaccgaggaaccaacgaacgtcccgtacttacttaaccgtacgtaccaacgaagttaaccgttaggaaagtcgtaacacgtacggaacggtaacggaggtactagtgttactttgattacgtcggtacgggacccgtagggtactaggtcggg

SEQ ID NO: 114211 - DNA, 628 bp, Homo sapiens
  misc_feature: GYAE6OF02IZ0ZU.15.86.H09.1.454.CMB.1.raw
tcagtctacgtagccacgaccggtgctcgatttagtgctatagacttgggtttggggggagaggagccccagccttgggatccccaattgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaaggggctggaggtggggttggacgtttacgaaaagtaaaatgatggtagagaaaatagactaggtgcaccgtagaaaggagattcaaccatctacaaagagaactaattaacaaaaacgtacggtagtatttagactaaatagaaacagacctaagaaaaccgaggaaccacgacgtaccgtctaattacctagtaacccacaagtacgttacggaaagtcgacagtacggtaacgttaaagggacggtacttagtaggtacttttaggtaattacgttcggttacggggacccgtaggggaacctagttcggg

SEQ ID NO: 114212 - DNA, 643 bp, Homo sapiens
  misc_feature: GYAE6OF02JCWSL.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaaagtaaaatgatggtgagaaatagactacggtgcaccgtgaaaggagattcacatctacaagagataattacaaaaacgacggtagttaatttgactaaatgaaacagaccctagaaaaccgaggacaacgagtcccgtataacttacgtacgtacccaacaaggtactttacgggaaagttcggactaagttaccggaacggttaaaagggacggtaccttaagttcggttacctttttaggaagtttacgttaccggtacggggggtacccccaagggggtaccctaaggtttcccgggg

SEQ ID NO: 114213 - DNA, 598 bp, Homo sapiens
  misc_feature: GYAE6OF02GRE22.15.86.H09.1.454.CMB.1.raw
  modified_base (508)..(508): a, c, t, g, unknown or other
  misc_feature (508)..(508): n is a, c, g, or t
  modified_base (526)..(526): a, c, t, g, unknown or other
  misc_feature (526)..(526): n is a, c, g, or t
  modified_base (543)..(543): a, c, t, g, unknown or other
  misc_feature (543)..(543): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggttggacgtttacaaaagtaaaatgatggtagaagaaaatagactacggtgacaccgtagaaaggaagattcacatctacaagagaataattacgaaaaacgtcggtagtatttagactaaatcgaaacagcctaagaaaaccgaggaacacacgccgtactattactcgtaaccanagtacttcggaagtcganagtacgaaggtaaaggnggaccttatgtacttttagattagttcggtcggggaccctaggggacagttcggg

SEQ ID NO: 114214 - DNA, 594 bp, Homo sapiens
  misc_feature: GYAE6OF02HV3G7.15.86.H09.1.454.CMB.1.raw
  modified_base (518)..(518): a, c, t, g, unknown or other
  misc_feature (518)..(518): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggtagttcgggctgagctgggttttccttgctgctatcttaaaaggtgtccagtgtgaagtgcaggtggtggagtcgtgggggagccttggtaaagccgtgggggtccttagagtctctgtgtggcctctggattcactttcagtaatggctggatgagttgggtccgccaggctccgaggggaaggggctagggagtgggttggacgtttacaaaagtaaaaatgatagggtagaagaaaatagacgtacggtgcaaccgtagaaaggaagacttacacatctacaaagagaataatacaaaaacgcggttagtaattgaactaaatagaacagacctaagaaaaccgagaacaacacgccgtacttaattactagtaaccanagattacggaagtnacancgaagtaaggagactatgtattttagattagtcggtacgggacccagggtacagtcgg

SEQ ID NO: 114215 - DNA, 577 bp, Homo sapiens
  misc_feature: GYAE6OF02GUYC8.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttgggtaaagcctggggggtcccttagagtctcctgtgtggcctctggattcactttcagtaatggctggatgagttgggtccgccaggctccgaggggaaggggctgggagtgggttggacgtttacgaaaagtaaaatgatggtgaagaaaatagactaggtgcaccgtgaaaggagatacacatctcaagagaataatacaaaacgaggtagtatttagcaaatgaacagcctagaaaccgaggacacgagccgtctattactgtaccacagtattacggaagtcgacatacgacgtaaaggaggtactatggtcttttagattacgttcgtcggggccctagggaccgaagttcggg

SEQ ID NO: 114216 - DNA, 619 bp, Homo sapiens
  misc_feature: GYAE6OF02IL93B.15.86.H09.1.454.CMB.1.raw
  modified_base (331)..(331): a, c, t, g, unknown or other
  misc_feature (331)..(331): n is a, c, g, or t
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (503)..(503): a, c, t, g, unknown or other
  misc_feature (503)..(503): n is a, c, g, or t
tcagtctacgtagccacgaccggtgctcgatttagtgctatagacttgggtttgggggggaggagggagccccagccttgggatccccaagtgttttcattcagtgatcaggactgaacacagaggactcaccatggagttcgggctgagctgggtttccttgctgctatcttaaaaggtgtccagtgtgaagtgcaggtggtggaggtcgtggggggagccttgggtaaagccgtggggggtcccttagagtctcctgtggtggcctctgggattcactttcagtaatggctggatgagttggtccgcaggctccgagggagggcgtggnggtgggtgacgtttacgaaaagtaaaatgagtgtagaagaaatagaacgtaggtgacaccgtagaaaggaagagtcacatcgtacaaganataataacaaaacgtacgtntaagtttnactaatagaanacactagaaacgagacacgagtccgtactatactagtaccaanaacgtacttagggaactggactaagtacgaacggtaaacggcggtaactaagtcgttaacgtttagaatttacgttacggtaccggggacccggaaggtacccgtaaggttccggg

SEQ ID NO: 114217 - DNA, 563 bp, Homo sapiens
  misc_feature: GYAE6OF02G0UBT.15.86.H09.1.454.CMB.1.raw
  modified_base (530)..(530): a, c, t, g, unknown or other
  misc_feature (530)..(530): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatgggtgagaaaatagactacggtgcacccgtgaaaggagattcaccatctcaagagataattacaaaacgacggtagtatttgactaaatagaacagcctagaaaaccgagaacacagccgtactacttactgtaccacagattacggaagtgactatacgagtaaggaggactatgnttttgatagtcgtggggacccagggacagtcgg

SEQ ID NO: 114218 - DNA, 577 bp, Homo sapiens
  misc_feature: GYAE6OF02IM9RR.15.86.H09.1.454.CMB.1.raw
  modified_base (502)..(502): a, c, t, g, unknown or other
  misc_feature (502)..(502): n is a, c, g, or t
  modified_base (532)..(532): a, c, t, g, unknown or other
  misc_feature (532)..(532): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgaggggaggggctgggaggtggggttggacgtttacaaaagtaaaatgaatggtagaagaaaatagactacggtgacaccgtagaaaggaagattacaccatctacaagagataattacaaaaacgtacggtgtaatttgacaaatgaacagacctagaaaccgagacacgagccgtactattactgaccanagtagttcgaagtgacatacggagtaaggnggctagtgtactttagattgtcgtcgggacccagggtacagtcgg

SEQ ID NO: 114219 - DNA, 863 bp, Homo sapiens
  misc_feature: GYAE6OF02I9GL5.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacgccggtcgggggtcccgttaggagtccgtcctggtggtcggcctcgtggtattctactttcgaagttaagtggtcgtggagtggtaggttcgggtcccgaccgtacggccgtacccggtaagggggaacgggggtcgtaggggtagggttggggttagggtaaccggtttaacgtaaaaaaggttaaaaagttggaagttagggtaaggtaaaggtaaaaagtaacggtaaccggttaacggttacggacccgtaacccggtaaggtaaaaaggggtaaacgtaacgtttaccgaaccgtacttaccgtacgaaaacggtaaggtaaacttaaaacgttaaaccgaaaaaacggtacggtttaacgtttaacgtttaaggaaacctaaaagtacgaaaacgtaaccggtaaccgtaaacggaaaaacccggacgggtaaacaacccgaacggtacccgttacttaaacgtttaaccgtacgtaaacccaacgtaacgtaacggtttacggaaacgttgaaaccgagttaaccggtaaacgggtaaagggacgttacgtaagttcggttaactttttaggaagtttacgtacccgggttagggacccggttaacgggaacttaaggttccggg

SEQ ID NO: 114220 - DNA, 560 bp, Homo sapiens
  misc_feature: GYAE6OF02GV5QL.15.86.H09.1.454.CMB.1.raw
  modified_base (510)..(510): a, c, t, g, unknown or other
  misc_feature (510)..(510): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaaggggctgggagtgggttggacgtttacaaaagtaaaatgatggtgaagaaatagactaggtgcaccgtgaaaggagattcacatctacaagagataattacaaaacgacggtagtatttagacaaatgaacagcctagaaaaccgaggaacacgagccgtactattactagtaccacaagattacggaagtgnatcgacgtaaggaggctangtctttgatatcgtgggccagggacagtcgg

SEQ ID NO: 114221 - DNA, 572 bp, Homo sapiens
  misc_feature: GYAE6OF02H0KPS.15.86.H09.1.454.CMB.1.raw
  modified_base (303)..(303): a, c, t, g, unknown or other
  misc_feature (303)..(303): n is a, c, g, or t
  modified_base (409)..(409): a, c, t, g, unknown or other
  misc_feature (409)..(409): n is a, c, g, or t
  modified_base (465)..(465): a, c, t, g, unknown or other
  misc_feature (465)..(465): n is a, c, g, or t
  modified_base (509)..(509): a, c, t, g, unknown or other
  misc_feature (509)..(509): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtctgggggagccttggtaagccgtgggggtcccttagagtctctgtgtggcctctggattcactttcagtaatggctggatgagttgggtccgcnggctccgagggagggctggagtgggtggacgtttacaaaagtaaaatgatggtagaagaaatagactacggtgcaccgtagaaaggaagatacacatctacaaganataatacaaaacggtcgttagtatttagacaaatgaaacagacctaggaaaaccgngaacacagccgtactattactacgaccacgagtattacggagtnaccatcgacgtaaggagtctatgtcttttagagttcgtcgtgggccctaagggacaagttcgg

SEQ ID NO: 114222 - DNA, 622 bp, Homo sapiens
  misc_feature: GYAE6OF02I42W8.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcggggctgagcgtgggttttccgtgcgtgctatcttaaaaggtgtccagtgtgaagtgcaggtggtggagtctgggggagccttgggtaaagccgtggggggtcccttagagtctcctgtgtggcctctggattcactttcagtaatggctggatgagttgggtccgccaggctccagggaaggggctggagtgggttggacgtttcaaagtaaaatgatggtagagaaatagactaggtgcaccgtgaaaggagattcacatctacaagagaataattacaaaaacgcggttagtatttagactaaagtacgtaacacgcccttaaggaaaacccggaggaaccaacacgaccgttctaattaccacggtaccacgagtacgttacgggaacgtgacagtaccggtacgtaaagggacggtcttagtcgtactttttgacgttacgtcggtacgggaccccgtagggacctaagttcgggg

SEQ ID NO: 114223 - DNA, 583 bp, Homo sapiens
  misc_feature: GYAE6OF02G7E67.15.86.H09.1.454.CMB.1.raw
  modified_base (516)..(516): a, c, t, g, unknown or other
  misc_feature (516)..(516): n is a, c, g, or t
tcagtctacgtagccacgaccggtgctcgatttagtgctatagacttgggtttgggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttgcagtaacaccaagtacaggaatattaacctgtttcccatcgactacgcctttcggcctcgccttaggggtcgactcaccctgccccgattaacgttggacaggaacccttggcttccggcgagcgggcttttcgacccgtctttatcgttacttatgtcagcattcgcacttctgactacctcagcatcgcctcacacgcacaccttcacaggcttacagtaacgcctacccaccaacaacgcaactaagcgtacgctgccgcacgcttcggncgtattcggtttacgccccgtttcacgttccttcccgactactcgtcgacgtccttacgtagtaccg

SEQ ID NO: 114224 - DNA, 616 bp, Homo sapiens
  misc_feature: GYAE6OF02GBODH.15.86.H09.1.454.CMB.1.raw
  modified_base (568)..(568): a, c, t, g, unknown or other
  misc_feature (568)..(568): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgagggaaggggcgtgggaggtgggttggacggtttacgaaaagtaaaatgaagtgggtagaagaaaatagaacgtacggtgaccgacccggtagaaaaggaagattacaccatctacaagagaattaataacgaaaaacgtacggtagttaatttagacaaaagtagaaacagacctaagaaaaccgaggaacacgacgccgtactattactacgtaccacagtacttacggaatcgactagtacgacgtaaaggnggtactagtgtacgtttgattagtcggtcgggaccagggactagtcgg

SEQ ID NO: 114225 - DNA, 595 bp, Homo sapiens
  misc_feature: GYAE6OF02JE3WW.15.86.H09.1.454.CMB.1.raw
  modified_base (430)..(430): a, c, t, g, unknown or other
  misc_feature (430)..(430): n is a, c, g, or t
  modified_base (504)..(504): a, c, t, g, unknown or other
  misc_feature (504)..(504): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggaaggggctggagtgggttggacgtttacaaaagtaaaatgatggtagaagaaatagactacggtgcaccgtagaaaggaagattcacatctacaagagataatacaaaacgacggtntatttgactaaatgaacagtacctaaggaaaaaccgaggaaccaacgacgcccgtataattactagtaacccanagtacgttacgaagtgacatacgacggtaaggaggtctagtgtcgtttttagattacgtcggtacgggacccgtagggtaccaagttcggg

SEQ ID NO: 114226 - DNA, 669 bp, Homo sapiens
  misc_feature: GYAE6OF02IM9Q5.15.86.H09.1.454.CMB.1.raw
  modified_base (428)..(428): a, c, t, g, unknown or other
  misc_feature (428)..(428): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccttggtaaagccgtgggggtcccttagagtctcctgtgtggcctctggattcactttcagtaatggctggatgagttgggtccgccaggctccgagggaggggcgtgggaggtggggtggacgtttacaaaaagtaaaatgaagtggtagaagaaaagtagacgtacggtgacaacccggtagaaaggaagattacacatctacaaganaataacttacaaaaacggtacggtagttaatttagaactaaaatagaaacagacctaaggaaaaccgtaggaaccacgaacgtacctacttaagttaactacgtaacccaactaaggtacttacggaaagttcgactaacgtaccggaacggtaaagggtacggacttacgttagttacgtttttagactttacggtaccgggttacggggaaccccggtaaggggtacctaaggttcggg

SEQ ID NO: 114227 - DNA, 750 bp, Homo sapiens
  misc_feature: GYAE6OF02IZ1W2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaagccgtgggggtcccttagagtctcctgtgtggcctctggattcacttcagtaatggctggatcgagttgggtccgccaggctccgagggaagggctggaggtgggttgggtacgtttacgaaaagtaaaagtgaagtggtagaagaaaataggactacggtgacaccgtagaaagagatacacatctacaagacgaataataacgaaaaacggtacgttagttaatttacggtaacaaagttacgaaactaacgtacccgttaacggaaaaaccggaacggaaccgaaacctacgggtacccgttaaccgttaaacgtttaaaccgtaccggttaaaccccaacgtaaacggttaaccgtttaaccgggttaaacggtacgtaaccgtaagttaacccgggtaaaccggttaaaagggacggggtaacccttaaaggttcgttaaccgtttttacggtaagtaccggtttaccgggttaccgggggaaaccccgttaacggggtaaccgtaaggtttccgggg

SEQ ID NO: 114228 - DNA, 603 bp, Homo sapiens
  misc_feature: GYAE6OF02FVEPO.15.86.H09.1.454.CMB.1.raw
  modified_base (438)..(438): a, c, t, g, unknown or other
  misc_feature (438)..(438): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaagggctggagtgggttggacgtttcaaaagtaaaatgatggtgagaaaatagactacggtgcacccgtgaaaggagattcaccatctcaagagataattacaaaaacgaggtagtatttgacaaatgaacagcctagaaaaccgaggacacagccgtctattactgtaccanagattcggaatgacatcgaacgtaaaggaggctatgtcttttgattatcgtacggggcccaggggacaagtgggtcgtacgtctcttcacgcctccgaaccgaacgggtccccaagttcccggtacccttcccccgtggacccaccccgttccctaccaagaccg

SEQ ID NO: 114229 - DNA, 587 bp, Homo sapiens
  misc_feature: GYAE6OF02IZ6VI.15.86.H09.1.454.CMB.1.raw
  modified_base (360)..(360): a, c, t, g, unknown or other
  misc_feature (360)..(360): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggcgggatgagttgggtccgccaggctccgagggaaggggctgggagtgggttggacgttacaaaagtaaaatgatggtanagaaaatagactacggtgacaccgtagaaaggaagattacacatctacaagagataacttacaaaacgacggtagtatttgacaaatgaacagacctagaaaccgagacacagccgtatattactagtaccagagagttacggaagttgactatacgaacgtaaggagtacgtagtagtacgttttagagttagtcgtcggggacccaggggacctagtcggttcgg

SEQ ID NO: 114230 - DNA, 587 bp, Homo sapiens
  misc_feature: GYAE6OF02H4J5M.15.86.H09.1.454.CMB.1.raw
  modified_base (446)..(446): a, c, t, g, unknown or other
  misc_feature (446)..(446): n is a, c, g, or t
  modified_base (497)..(497): a, c, t, g, unknown or other
  misc_feature (497)..(497): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaggggctggagtgggtggacgtttacaaaagtaaaatgatggtagaagaaaatagactacggtgacaccgtagaaaggaagattacaccatctacaagagataatacaaaacgtacggtagttaattganaaatagaacagacctaagaaaccgagacacagcctactattactgtaccanagattacggaagtgacagtacgacgtaaggacggctagttgtactttttagagttacgtcggtacggggtacccgagggaccagttcggg

SEQ ID NO: 114231 - DNA, 565 bp, Homo sapiens
  misc_feature: GYAE6OF02IOBD7.15.86.H09.1.454.CMB.1.raw
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaggggctggagtgggtggacgtttcaaagtaaaatgatggtagagaaatagactacggtgcacccgtgaaaggaagattcaccatctcaagagataattacaaaaacgacggtagtatttgactaaatgaaacagacctagaaaaccgaggacacagaccgtactattactacgtaccacagattacggaagtgcaancgacgtaaaggnggactatgtctttagattatcgttgggacccagggacagtcgg

SEQ ID NO: 114232 - DNA, 684 bp, Homo sapiens
  misc_feature: GYAE6OF02HCUMT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggttggacgtttcgaaaagtaaaatgatggtagagaaagtagagtacgtagtcgaccgtaccggtaaggaaaggaagtacgtaccaactactacaacgaagaagtaacttaacgtaaaaccgaaaacggtacggttagtttagttacgaactaaagtaacaacgacctacgaaaccggaaaccggacgaaccacgaccgtccgttactaacgtttaccgtacgtaaccagtaagttaacgttaggaagtcgactacgtaccggtaaacgggtaagggacgttacttaggtacgttttacgtttagtacgttacggttccggggtacccgggtacggtaagggtaaccttacgggg

SEQ ID NO: 114233 - DNA, 659 bp, Homo sapiens
  misc_feature: GYAE6OF02FFTZX.15.86.H09.1.454.CMB.1.raw
  modified_base (452)..(452): a, c, t, g, unknown or other
  misc_feature (452)..(452): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgtagttgggtccgccaggcctccgaggggaaggggctggaggtgggttgacgtttacaaaaggtaaaatgatggtagaagaaatagactacggtgcaccgtagaaaggagattcacatctacaagagataacttacaaaacgcgtgtatttgacaaatgaacncgacctaaggaaaaccgaggaccacgacgtcccgttacttaatttaccgacgttacccaacgtaaggtaacgttttacgggaaagtttcggaccgtaacgttaccggtaacggtaaaagggacggtaccttaagttacggttaccttttttagaacgtttacgtccggttacgggggacccctaagggggtactaaggtttccgggg

SEQ ID NO: 114234 - DNA, 596 bp, Homo sapiens
  misc_feature: GYAE6OF02G4K4D.15.86.H09.1.454.CMB.1.raw
  modified_base (536)..(536): a, c, t, g, unknown or other
  misc_feature (536)..(536): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggtggacgtttacaaagtaaaatgatggtgagaaatagactacggtgcaccgtagaaaggagattcaccatctcaagagaataatacaaaacgtacggtagtatttgactaaatgaaacagacctagaaaaccgaggaacacacgccgtactattacgtcgtaaccacacgtaattcggaagtcgactagtacgacggttaaaggnggtaacttagtgtcgttttagatagttcgtacggggacccgtaggggacctaaggtcggg

SEQ ID NO: 114235 - DNA, 593 bp, Homo sapiens
  misc_feature: GYAE6OF02FZQGJ.15.86.H09.1.454.CMB.1.raw
  modified_base (420)..(420): a, c, t, g, unknown or other
  misc_feature (420)..(420): n is a, c, g, or t
  modified_base (505)..(505): a, c, t, g, unknown or other
  misc_feature (505)..(505): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccaccaggctccgagggaaggggcgtgggaggtggggttggacgtttacgaaaagtaaaatagatggtagaagaaatagactacggtgcaccgtagaaaggaagattacacatctacaaganaataattacaaaaacgcggtagtatttagactaaatagaacagcctaagaaaccgaggacacagcctactattactacgtaccanagattacggaagtgacagtacgaacgtaaaggacggtctagtcgtacttttagattagttcggtacggggacccagggactagtcggg

SEQ ID NO: 114236 - DNA, 564 bp, Homo sapiens
  misc_feature: GYAE6OF02HBMFH.15.86.H09.1.454.CMB.1.raw
  modified_base (398)..(398): a, c, t, g, unknown or other
  misc_feature (398)..(398): n is a, c, g, or t
  modified_base (541)..(541): a, c, t, g, unknown or other
  misc_feature (541)..(541): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccagggaggggctggagtgggtggacgtttcaaaagtaaaatgatggtgagaaatagactaggtgcaccgtagaaggagattcacatctanaagagataatacaaaaacgacggtagtaatttgactaaatgaaacagcctagaaaaccgaggacacagccgtactacttactcgtaccacagtattacggaagtgacgatacgagtaaggaggatatgtctttagattatcgngggtacccagggtacagttcggg

SEQ ID NO: 114237 - DNA, 588 bp, Homo sapiens
  misc_feature: GYAE6OF02JU47N.15.86.H09.1.454.CMB.1.raw
  modified_base (499)..(499): a, c, t, g, unknown or other
  misc_feature (499)..(499): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtccttagagtctcctgtgtggcctctggattcactttcagtaatggctggatgagttgggtccgccaggctccgagggaggggctggagtgggttggacgtttcaaagtaaaatgatggtgagaaatagactacggtgcgacccgtagaaaggaagagttcaccgatctacaagacgaataatacaaaaacgacggtagtaatttgactaaatgaacagactagaaaaccgaggacaacagaccgtactactactacgtaccaanagtacgttaggacgtagacagtcgacgtaaggacggctaagtacgtcttttagattacgtggttacggggacctagggaccattacggg

SEQ ID NO: 114238 - DNA, 596 bp, Homo sapiens
  misc_feature: GYAE6OF02INB9M.15.86.H09.1.454.CMB.1.raw
  modified_base (245)..(245): a, c, t, g, unknown or other
  misc_feature (245)..(245): n is a, c, g, or t
tcagtctacgtagccacgaccggtgctcgatttagtgctatagacttgggtttgggggggagaggagccccagccttgggatccccaagtgttttcattcagtgatcaggacttaacacagaggactcaccatggagttcgggctgagctgggttttccttgctgctatcttaaaaggtgtccagtgtgaagtgcaggtggtggagtctgggggagccttggtaaagcctggggggtcccttagngtctcctgtgtggcctctggattcactttcagtaatggctggatgagttgggtccgccaggctccaggggaggggctgggagtgggttggacgtttcaaaagtaaaatgatggtgagaaatagactacggtgcacccgtgaaaggagattcaccatctacaagagaataattacaaaacgacggttagtaatttgacaaattagaactaagacctagaaaaccgaggaaccacacgaccgtactaacttactgtaacccacagtagttacgaagttcgcaatacgaacgtaaggaggtcgtaagtcgtactttgaacttagccgttggggccccaggggactagtggtcgg

SEQ ID NO: 114239 - DNA, 608 bp, Homo sapiens
  misc_feature: GYAE6OF02H34AD.15.86.H09.1.454.CMB.1.raw
  modified_base (415)..(415): a, c, t, g, unknown or other
  misc_feature (415)..(415): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccttggtaaagccgtgggggtccctagagtctcctgtgtggcctctggattcacttttcagtaatggctggatgagttgggtccgccaggctccgagggaggggctggaggttgggtggtacgtttacaaaagtaaaatgagtggtagaagaaatagactacggtgacaccgtagaaggtagatacaccatctacaaganataattaacaaaacgtacgttagttattagactaaatagaacagacctaaggaaaccgagaacacgagacctctattactcgtaccactagacgttacggaagtagactatacggaacggtaaacggaggtaccttatacggtctttttagacttagtcggtccggggtacccgagggtacctaaggttcggg

SEQ ID NO: 114240 - DNA, 557 bp, Homo sapiens
  misc_feature: GYAE6OF02HQ8IS.15.86.H09.1.454.CMB.1.raw
  modified_base (460)..(460): a, c, t, g, unknown or other
  misc_feature (460)..(460): n is a, c, g, or t
  modified_base (501)..(501): a, c, t, g, unknown or other
  misc_feature (501)..(501): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccaggggaaggggctggagtgggttggacgtttcaaaagtaaaatgatggtgagaaaatagactacggtgcacccgtgaaaggaagattcacatctcaagagataattcaaaaacgcggtagtaatttgacaaatgaacagcctagaaaaccgnggaacacagcctactattactgtaccacagattcggaagtncatcgacgtaagggaggctatgtcttttgattatcgtgggcccagggacattcggg

SEQ ID NO: 114241 - DNA, 568 bp, Homo sapiens
  misc_feature: GYAE6OF02GZ5EQ.15.86.H09.1.454.CMB.1.raw
  modified_base (540)..(540): a, c, t, g, unknown or other
  misc_feature (540)..(540): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccaggggaaggggctggagtgggttggacgtttcaaaagtaaaatgatggtgaagaaatagactacggtgcacccgtgaaaggagattcaccatctacaagagataattacaaaacgcggtagtatttgcaaatgaacagacctaggaaaacccgaggaacacgagccgtactattactagtacccaagagtattcggaatgacagtacgagtaaggagtctatgacttttanattatcgtgggacccagggacaagtcgg

SEQ ID NO: 114242 - DNA, 567 bp, Homo sapiens
  misc_feature: GYAE6OF02GMFVB.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctgggagtgggttggacgtttcaaaagtaaaatgatggtgagaaatagactaggtgcaccgtgaaaggagattcaccatctcaagagataattacaaaaacgacggtagtatttaggacaaaatgaaacagacctagaaaaccgaggacacagccgtatattactgtaccacagattcggaatgcatcgacgtaaggaggtctagtcgcttttagattagtcggtcgggacccagggtacaagttcggg

SEQ ID NO: 114243 - DNA, 599 bp, Homo sapiens
  misc_feature: GYAE6OF02I1A62.15.86.H09.1.454.CMB.1.raw
  modified_base (545)..(545): a, c, t, g, unknown or other
  misc_feature (545)..(545): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggaaggggctggaggtgggttggacgtttacaaaagtaaaatgatggtagaagaaaatagactacggtgacaccggtagaaaggagattcaccatactacaagagataaattacaaaaacgtcggtagtaatttgactaaatagaaacagacctaagaaaaccgaggaaccacgacgccgtactaattactacgtaccacaagtacttacgggaagtcgacatcgacgtaaggnggtactagtgtacttttagattacgttcggtcgggacccagggtacagttcggg

SEQ ID NO: 114244 - DNA, 617 bp, Homo sapiens
  misc_feature: GYAE6OF02H38Y8.15.86.H09.1.454.CMB.1.raw
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (430)..(430): a, c, t, g, unknown or other
  misc_feature (430)..(430): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
  modified_base (513)..(513): a, c, t, g, unknown or other
  misc_feature (513)..(513): n is a, c, g, or t
  modified_base (530)..(530): a, c, t, g, unknown or other
  misc_feature (530)..(530): n is a, c, g, or t
tcagtctacgtagccacgaccggtgctcgattttagtgctatagactttggggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccttggaaacgccgtcgggggtccttagagtctctgtgtggcctntggnttcactttcagtaatggctggatgagttgggtccnccgaggctccgaggggaaggggctgggaggtgggttgggtacgtttaacgaaaaagttaaaaatgagtggtagaagaaaataggactacggtagccaccgtagaaaaggagatcacatcacaaganattaatacaaaaacgcggtagtattganaaatgaacngactaagaaaccgagaacacgacgacgtctattactacgtaaccanagaacttggaagtcganacgtacgtaacggtaaagggcgacgttagtagttcgttttagaatttacgtcggtaccggggtacccaggggtacctaaggttcggg

SEQ ID NO: 114245 - DNA, 609 bp, Homo sapiens
  misc_feature: GYAE6OF02JZ2NW.15.86.H09.1.454.CMB.1.raw
  modified_base (420)..(420): a, c, t, g, unknown or other
  misc_feature (420)..(420): n is a, c, g, or t
  modified_base (477)..(477): a, c, t, g, unknown or other
  misc_feature (477)..(477): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttgggtaaagccgtgggggtcccttagagtctcctgtgtggcctctggattcactttcagtaatggctggatgagttgggtccgccaggctccgagggaaggggcgtggaggtgggttggacgtttacgaaaaggtaaaagtgagtggtgaagtaaagtagacgtacggtgacgaccgtagaaaggaagatacactaatctanaagagataataacgaaacgacggtagtagttgacaaatagaacagactagaaaccgngacacgacgaccgtcgtaattaccgtacgtaccgacaacgtaacgttacggtaacgtgacctagtaccgaaggttaaggaggtctagtcgtatttaggattatcggtacggcccgtaaggacgtagtccggg

SEQ ID NO: 114246 - DNA, 565 bp, Homo sapiens
  misc_feature: GYAE6OF02IGP06.15.86.H09.1.454.CMB.1.raw
  modified_base (494)..(494): a, c, t, g, unknown or other
  misc_feature (494)..(494): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaggggctggagtgggttggacgtttcaaaagtaaaatgatggtagagaaaatagactacggtgcaccgtagaaaggaagattcaccatctcaagagataattacaaaaacgacggtagtaatttgacaaatgaacagcctagaaaccgaggaacacgagccgtactattacctagtaccanagtattcggaagtgcatacgagtaaaggnggctagtgtctttgattgtcgtgggcccgaggtacaagtcgg

SEQ ID NO: 114247 - DNA, 592 bp, Homo sapiens
  misc_feature: GYAE6OF02IJP52.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttaggagtctcctgtgtggcctctggattcactttcagtaatggctggatgagtggtcgccaggctccgagggaagggctggagtggtggacgtttcaaaagtaaaatgatggtagaagaaaatagaatacggtgacgacccgtagaaaggaagattacgaaccatctacaagacgataaatacaaaaacgacggtatagtttagactaaatgaaacagacctaagaaaaccgaggaacaacacgcgactatactagtaccacagtattagaacgtgctaatcgaacgttaaagggacgactagtagtacttttagaattatcggtacgggcccgtaagggacctaagtccggg

SEQ ID NO: 114248 - DNA, 638 bp, Homo sapiens
  misc_feature: GYAE6OF02ILP4G.15.86.H09.1.454.CMB.1.raw
  modified_base (343)..(343): a, c, t, g, unknown or other
  misc_feature (343)..(343): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgcaggctccgagggaggggctggagtgggtggacgtttanaaaagtaaatgatggtagaagaaaatagacgtacggtgacaccgtagaaaagagattacacatctacaagagaataatacgaaaaacgtacggtattaatttagactaaagtcgaaacagtaccctaaggaaaacccgaggaaccacgaacgtcccgtattaacgttactacgtaccaacgagtaacgttacggaagtgacagtaccggaacggtaaaggaggtactaagttcgttacgttttagaacttacgttccgggtacggggacccctaaggggtacctaaggttccggg

SEQ ID NO: 114249 - DNA, 637 bp, Homo sapiens
  misc_feature: GYAE6OF02IPFON.15.86.H09.1.454.CMB.1.raw
  modified_base (345)..(345): a, c, t, g, unknown or other
  misc_feature (345)..(345): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggtttccttgctgctatctaaaaggtgtccagtgtgaagtgcaggtggtggagtctgggggagccttggtaaagccgtgggggtcccttaggagtctcctgtgtggcctctggattcactttcagtaatggctggatgagttggtcgccgaggctccgaggagggctggagtggtgacgtttacaaaagtaaaagngagtggtagaagaaatagacgtacggtgacgtaccgtagaaaaggagtactacgaccagtctactaaagagtaacgttaaactacgtaaaaacggcggtttagtaactttaggaacttaaagtacgaaagtacgacgttaagaaaaccggagtaacacgaacgtccgttactaattaccgtacgtaacccanaaacgtattacggaagtacgcgtaagcgtaaccggtaaaggcgggacttagtgtaactttagagtacgtcggtacgggacccgtaggaccctagtccggg

SEQ ID NO: 114250 - DNA, 661 bp, Homo sapiens
  misc_feature: GYAE6OF02GL2ZJ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtgggggagccgttggtaaagccgtgggggtcccttagagtctcctgtgtggcctctggattctacttcagtaatggctggatgaggttgggtcccgccgaggcctccgaggggaggggcgtgggaggtgggttggtacgtttacaaaagtaaaatgagtggtagaagtaaaatagacgtacggtgacgaccgtagaaaggaagtattaccaacctatctacgaaagagtaattaaacttaaccgaaaaacggtacggttagttaagtttacgaactaaaagttacgaaacgacgtacccgtaaggaaaaacccggaggaaccaacgacgtacccgtacttaacttaccgtacgtaacccacgaagtacgttacggaagtcgactagtacggaacgtaaggagtactagtgtacttttagagttagtcggtacgggcccgaagggactagtcgg

SEQ ID NO: 114251 - DNA, 588 bp, Homo sapiens
  misc_feature: GYAE6OF02FVNZD.15.86.H09.1.454.CMB.1.raw
  modified_base (526)..(526): a, c, t, g, unknown or other
  misc_feature (526)..(526): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttacaaaagtaaaatgatggtagaagaaaatagactacggtgcaccgtagaaaggagattcaccatctacaagagataatacaaaaacgcggtagtatttgacaaatgaacagacctagaaaaccgagacacagccgtactattacagtaccacgagattacggaagtgacagtacggaacgtaaaggnggtactaagtcgtacttttagattacgttcggtacgggggacccaggggtacaaggttcggg

SEQ ID NO: 114252 - DNA, 643 bp, Homo sapiens
  misc_feature: GYAE6OF02GIC9D.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggctgggagtgggttggacgtttacaaaagtaaaatgatggtagaagaaaatagactacggtgcaccgtagaaaggaagattcacatctacaagagaataattacgaaaaacgtcggtagtatttgactaaatagaaacagacctaaggaaaaccgaggaacaacgagacccgttacttaattacctacgttaacccaagaaggtaacgtttacgggaaagtcgaccaagtaccggaacggtaaagggacggtacttaagttcggttacgtttttagaatttacgttccggtacgggggaccccaaggggtaccaaggttcggg

SEQ ID NO: 114253 - DNA, 573 bp, Homo sapiens
  misc_feature: GYAE6OF02HJ85J.15.86.H09.1.454.CMB.1.raw
  modified_base (407)..(407): a, c, t, g, unknown or other
  misc_feature (407)..(407): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctgggggtcccttagagtctcctgtgtggcctctggattcacttcagtaatggctggatgagttgggtccgccaggctccagggaaggggctggagtgggttggacgtttgaaagtaaaactgatggtagagaaatgactacggtgcaccggtgaaaggagattcgaccatctacgaagngtataatcaaaacgcggtatattgcaaatcgaacagccgtagaaaccgtggacacaggtcctatatactgtaccacagattcgggaatcgacagttcgacgttaaggcgtctacgtgtacgttttgaacttgttaccgtggggccctaagggtacctagttccggg

SEQ ID NO: 114254 - DNA, 593 bp, Homo sapiens
  misc_feature: GYAE6OF02GB2DO.15.86.H09.1.454.CMB.1.raw
  modified_base (339)..(339): a, c, t, g, unknown or other
  misc_feature (339)..(339): n is a, c, g, or t
  modified_base (538)..(538): a, c, t, g, unknown or other
  misc_feature (538)..(538): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggaagggctggagtgggtggacgtttnaaaagtaaaatgatggtagaagaaaatagactacggtgcaccgtagaaaggagattacacatctacaagagaataattacgaaaaacgtcggtagtaatttagacaaatgaaacagcctaagaaaacccgaggaacacagccgtactaattacagtacccatagtattacggaatcgacatacggacgtaaggacggtnttaattggtacttttgattacgtcgtacggggacccaaggggtaccaggttcggg

SEQ ID NO: 114255 - DNA, 569 bp, Homo sapiens
  misc_feature: GYAE6OF02IUN5K.15.86.H09.1.454.CMB.1.raw
  modified_base (501)..(501): a, c, t, g, unknown or other
  misc_feature (501)..(501): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaagggggctgggagtggggttggacggtttacaaaagtaaaatgatggtgagaaatagactacggtgcaccgtgaaaggagattcacatctacaagagaataattacaaaaacgtacggtagtatttgactaaatgaacagcctagaaaaccgaggaccacacgccgtatattactagtaccanagattcggaagtgacatcgagtaaggaggctaagtgtctttgatatcgtgggacccagggacagtcgg

SEQ ID NO: 114256 - DNA, 695 bp, Homo sapiens
  misc_feature: GYAE6OF02ISG2Y.15.86.H09.1.454.CMB.1.raw
  modified_base (412)..(412): a, c, t, g, unknown or other
  misc_feature (412)..(412): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctgggggtccttagagtctcctgtgtggcctctggattcacttcagtaatggctggatgagttgggtccgcaggctccgagggaaggggctgggaggtggggttggacgtttacaaaaggtaaaatgatggtgaagaaaatagactacggtgcaccgtagaaaggaagattcaccatctcaaganaataattacaaaaacgtacgtagtattagactaaatgaaacagacctaaggaaaaacccgaggaaccaacacgtacccgttacttaactttaaccttacggttaaacccaaccgtaaggttaacgtttaaccggggtaaaagttcggaacctaacgttaccggaaacgggtttaaaagggaacggggtaccttaaagttcgggttaacgttttttaggaaatttaacgtttccggttacgggggggacccccgtaagggggtaacccgtaaaggttccggggg

SEQ ID NO: 114257 - DNA, 654 bp, Homo sapiens
  misc_feature: GYAE6OF02IW9YE.15.86.H09.1.454.CMB.1.raw
  modified_base (570)..(570): a, c, t, g, unknown or other
  misc_feature (570)..(570): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctgggaggtgggttggacgtttcaaaagtaaaatgatggtagagaaatagactacggtgcacccgtagaaacggaagattacacatctacaagagtaataacttacaaaaacgtacggtagttagtttagactaaatagaacagacctaagaaaaccgaggaacacacgaccgtactaatttaacctacgttaacccaacgtaacgacgtttaccgggaaagtggactaacgtaccggaacgttaaagggngggtaaccttaagtacggttacctttttaggaatttacgtacggttaccgggggacccgtaacggggtacctaagggttccggg

SEQ ID NO: 114258 - DNA, 548 bp, Homo sapiens
  misc_feature: GYAE6OF02JKLXT.15.86.H09.1.454.CMB.1.raw
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
  modified_base (528)..(528): a, c, t, g, unknown or other
  misc_feature (528)..(528): n is a, c, g, or t
tcagtctacgtagccacgaccggtgctcgatttagtgctatagacttgggtttggggggagggaggagccccagccttgggatccccaagtgttttcattcagtgatcaggactgaacacagaggactcaccatggagttcgggcgtgagctgggttttccttgctgctatcttaaaggtgtccagtgtgaagtgcaggtgtggagtcgtggggagccgttggtaagccgtgggggtcccttagagtctctgtgtggcctctggattcgactttcagtatggctggatgagttgggtccgcgaggctcgagggagggctggagtggtgacgtttacaaagtaaatgagtggtagaagaaatagactaggtgacgtacgtagaaagtagatacacgatctagagatatagtacaaaacggtggtatagttgacaaatgaacngactagaaacgngacanagactntattactnaccanagtactgaatganatcgaagtaagcgtactagtcgatttagatagttcggngggacccagggtacagtcgg

SEQ ID NO: 114259 - DNA, 602 bp, Homo sapiens
  misc_feature: GYAE6OF02G3HTU.15.86.H09.1.454.CMB.1.raw
  modified_base (530)..(530): a, c, t, g, unknown or other
  misc_feature (530)..(530): n is a, c, g, or t
  modified_base (558)..(558): a, c, t, g, unknown or other
  misc_feature (558)..(558): n is a, c, g, or t
tcagtctacgtagccacgaccggtgctcgatttagtgctatagacttgggtttgggggggagaggagccccagtcttgggatccccaagtgttttcattcagtgatcaggactgaacacagaggactcaccatggagttcggggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctcgagggaaggggctggagtgggtggacgtttacaaaagtaaaagtgatggtagaagtaaaataggaactacggtgacacccggtagaaaaggaagattacaacctatactacaaaggacgaataaacgttacaaaaaacggtacggtagttaatttggacaaagtacgaaacagcctaagaaaaccggagaacacgacgccgtactaattacagttaccaanagattcggaatgacatcgacgtaaaggngactagtgtctttagattatcgtgggaccagggactaagtcggg

SEQ ID NO: 114260 - DNA, 617 bp, Homo sapiens
  misc_feature: GYAE6OF02IH0PM.15.86.H09.1.454.CMB.1.raw
  modified_base (186)..(186): a, c, t, g, unknown or other
  misc_feature (186)..(186): n is a, c, g, or t
tcagtctacgtagccacgaccggtgctcgatttagtgctatagacttgggtttgggggtccactgggcagtctcgaatagagctcttggaagtccctccaaccatggcctgggtctccttctacctactgcccttcattttctccacaggtctctgtgctctgcctgtgctgactcagcccccgtntgcgatctgccttgctgggagcctcgatcaagctcacctgccaccctaagtagtgagcatacgaactacaccatcgaatggtatcaacagagaccgagggaacgtcccccagtatataatgaaagttaagagtgatgcagaccacaccgaaggggacggactcccgatcgcttcgagtggctccagttcgtgggctggaccgctacctcaaccactcctaccaacccgttcacgttctacgaacgtagtacgaggaccttaggacgtataccgagtacggttagggagagtacgaccaacaacgtaaacttggaacgttcgggacctaaggttacgggtttagggggtgtttaccgggggacgggttaacgggaacccgtaaggtaccggttaccggaacccggttaccgttacgggtccgtaaacccggg

SEQ ID NO: 114261 - DNA, 566 bp, Homo sapiens
  misc_feature: GYAE6OF02IVB24.15.86.H09.1.454.CMB.1.raw
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (556)..(556): a, c, t, g, unknown or other
  misc_feature (556)..(556): n is a, c, g, or t
  modified_base (564)..(565): a, c, t, g, unknown or other
  misc_feature (564)..(565): n is a, c, g, or t
tcagtctacgtagccacgaccggtgctcgatttagtgctatagacttggggtttggggggaagaggaagactgacggtcccttagagtctcctgtgtggcctctggattcactttcagtaatggctggatgagttgggtccgccaggctccagggaaggggctggagtgggttggacgtttcaaaagtaaaaatgatggtgagaaaatagactacggtgcacccgtgaaaggaagattcaccatctcaagagataattacaaaaacgacggtgtatttgcaaaatgaacagcctagaaaaaccgaggacacagccgtctattactgtaccacagattcggaagtgcatcgacgtaaaaggaggctatgcttttgatatcgtggggcccagggacaagtggtcgtcgtctcttcagcctccaccaagggcccagtcgtccttcccctgccaccctccnccaagcncacctcgtcggggcacgacgccgccgtcgggctcgccgtggtacaaggactacttccgacttacgtagacgtggacgcgggctggcgaggcncagtacgnnc

SEQ ID NO: 114262 - DNA, 587 bp, Homo sapiens
  misc_feature: GYAE6OF02FVY0W.15.86.H09.1.454.CMB.1.raw
  modified_base (453)..(453): a, c, t, g, unknown or other
  misc_feature (453)..(453): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaggggctggagtgggttgacgtttcaaaagtaaatgatggtagagaaatagactaggtgcaccgtgaaaggagattcacatcacaagagataatacaaaacgtcgtagtatttgacaaatgaacagcctagaaaccgngacacgagccgtatatactgtaccacagtattacgggaatcgacgtactcggtacgtaaggacggacttaagtcggttacgttttagattacgttccggtacgggggaccctaaggggtacctaggttaccggg

SEQ ID NO: 114263 - DNA, 695 bp, Homo sapiens
  misc_feature: GYAE6OF02IE6N7.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttaggagtctcctgtgtggcctctggattcactttcagtaatggctggatgaggttgggtccgccgaggctccgagggaaggggctgggaggtgggttggtacgtttacgaaaagtaaaagtgtaagtggtagaagaaaagtagaacgtacggtgacgaacccggtagaaaacggaagtacgtaccaccgtaatctacgaagaagtattaaacgttaacgaaaaacgtacggtagttaagttacgactaaatacgaactacgaccgtaacggaaaaccgaggaacaacgacggaccgtacttaagttacctacgtacccacgtaagtacgttacggaacgttagacgtaagtacgaacgggttaaaggacggtacgttaagttcgttacgtttttacgaagtttacggtaccggttaccgggggacccctaaggggtaccgtaggttaccgggg

SEQ ID NO: 114264 - DNA, 593 bp, Homo sapiens
  misc_feature: GYAE6OF02GIIVK.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaggggcgtggagtgggttggacgtttacaaaagtaaatgatggtgaagaaatagactaggtgacaccggtagaaaggagattacaacctatctacaaagagaattaattacaaaaacgtacggtagtatttagactaaatgaacagcctagaaaccgagaacacagcctatacttacagtaccacagtacttacggaagttgacataccggacgtaagggaggtactatggtacttttagattagtaccggtcggggaccctagggtactagttcggg

SEQ ID NO: 114265 - DNA, 570 bp, Homo sapiens
  misc_feature: GYAE6OF02G9UON.15.86.H09.1.454.CMB.1.raw
  modified_base (403)..(403): a, c, t, g, unknown or other
  misc_feature (403)..(403): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctgggagtgggttggacgtttacaaaagtaaaatgatggtgagaaatgactacggtgcaccgtgaaaggagattcacatctanaagagataatacaaaacgcggtagtattgacaaatgaacagcctagaaaccgagacacagcctntattacncgtaccacagtattcggaaagtgactatcgacgtaaaggagggctaagtgtacttttgattacgttcgtacggggcccaaggggtacaagttcggg

SEQ ID NO: 114266 - DNA, 620 bp, Homo sapiens
  misc_feature: GYAE6OF02I6BPA.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctggggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgcaggctccgagggaaggggctggagtgggttggacgtttacaaaagtaaaatgatggtagagaaatagatacggtgcaccgtagaaaggaagattacacctatctacaagagaataatacaaaaacggacggtagttaatttgacaaatgaacagacctagaaaaccgaggaacacgagtaccgtactaacttaccgtactaaccgacaacggtatttacgggaaagttcgacaagtccgaacggtaaagggcgtaactacgttggtaccttttaggaacttacgtacggtcgggggaccctaaggggacctaagtccggg

SEQ ID NO: 114267 - DNA, 654 bp, Homo sapiens
  misc_feature: GYAE6OF02FE0LO.15.86.H09.1.454.CMB.1.raw
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcccttagagtctcctgtgtggcctctggattcacttttcagtaatggctggatggtagttgggtcccgccgaggcctccgaggggaagggctggagtgggttgacgtttacaaaagttaaaatgaagtggtagaagaaatagacgtacggtgaccgaccgtagaaaggagattcacatctanaaganataatacaaaagcgtgtattagacaaatgaaacagacctaagaaaacccgtaggaacacgtacgaccgttacttaatttaccaggttaacccaacgtaaggttaacgttaccgggaaagttcggacctaagtaccgggtaaggtaaacggacgggtaacttacgtcgtttacgtttttagaagtttacgtcgggtaccggggacccctaaggggaacctaaggttccggg

SEQ ID NO: 114268 - DNA, 835 bp, Homo sapiens
  misc_feature: GYAE6OF02JET3L.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgggctggttttcgtttcgtgtgtctatacttaaaggttaaggtcctacgtagtggtaagtagtcgaggtagggttgggtaggtcgtgggggtaggggaccgttcggttaaaggaccgtccggggggttcccgggttaccgtaggtcgtccttcgtggtgggccgtcctggtagttctactttactagtaagttaggtcgtggtagtagtaggttaggggttcccggtccccgacgggtacgtcccgtaacgggggaaagggggggaccggttggaggggttaggggtttggggtaaccggttttacgtaaaaaggtaaaaaaagttagtagtaggttggaacgtaaaaagtaaggtacgtaacggttaggacgaaccccggtaggtaaaagggaaagtacgttacgtaccaactaccttacgaacgaaaggagttaaatttaaccgtaaaaaccggaaacgggttgtttaagtttagtacgaaaagttagaaacgtaacgccgttaacgaaaaccggaaacggacaaaccgacggaccgttccgtaatttaaccgtcgttaacccgaaccagtaagttacggtacggtagtccaacgtacggacgttaaaggaaggccttaagttcgtgttttacgtaagtaagttccggttagggggaccccgtaagggaacgtaacttgggttcccgg

SEQ ID NO: 114269 - DNA, 573 bp, Homo sapiens
  misc_feature: GYAE6OF02GA9WG.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccaggggaaggggctgggagtggggttggtacgtttacaaaagtaaaatgatggtagaagaaaatagactacggtgcaccgtgaaaggagatcacatctacaagagataatacaaaacgacggtagtatttgacaaatagaacagacctagaaaaccgagaacacagccgtactattactgtaccacagtattcggaagtgacagtcgaacgtaaaggaggtctagtgtcttttagattagtcgtcggggcccagggtacagtcgg

SEQ ID NO: 114270 - DNA, 592 bp, Homo sapiens
  misc_feature: GYAE6OF02H8OPW.15.86.H09.1.454.CMB.1.raw
  modified_base (410)..(410): a, c, t, g, unknown or other
  misc_feature (410)..(410): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagcctggggggtcccttagagtctcctgtgtggcctctggattcactttcagtaatggctggatgagttgggtccgccaggctccgagggagggctgggagtgggttggacgtttacaaaagtaaaatgatggtagaagaaatagactacggtgcacccgtagaaaggaagatcacatcacaganataatacaaaacgcggtatattgactaaatgaacagacctaagaaaccgagaacacgagccgtatattactagtaccaacacgagtttacggaagtcgactacgtacggaacgtaaggaggtcttaagttagtcgtttttagagttacgtacggtcggggacccaggggtaccagttccggg

SEQ ID NO: 114271 - DNA, 613 bp, Homo sapiens
  misc_feature: GYAE6OF02IWJWF.15.86.H09.1.454.CMB.1.raw
  modified_base (298)..(298): a, c, t, g, unknown or other
  misc_feature (298)..(298): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcgtgggggtccttagagtctcctgtgtggcctctggattcactttcagtaatggctggatgagttgggtccncaggctccgagggaagggctggagtgggtgacgtttcgaaaagtaaaatgatggtagagaaatagactacggtgacgaccgtgaaaaggagtattacaactatcgtacaaagagtaattaaatacgaaaaacgtacggtatagtttgacaaagttagaacagacgtaagaaaaccgaggtacacgacgcctacttaattactagtaaccacgagtacttacggaaagttcgactaagtaccgaaggtaaacggacggtacctagtacgttactttagtatacgtcgtgggaccccaaggggtaccagttaccggg

SEQ ID NO: 114272 - DNA, 594 bp, Homo sapiens
  misc_feature: GYAE6OF02HQRWU.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggctgggagtgggttggacgtttcaaaagtaaaatgatggtgagaaaatagactaggtgcaccgtagaaaggaagatcaccatctacaagagataattacaaaaacgacggtagtatttgactaaatgaaacagaccgtagaaaaccgaggaacacgacgccgtactattactagtaccacagtacttacggaagtcgactatacggacgtaaaggaggactagtgtagttttagattacgttcggtacggggacccaagggactaagtcggg

SEQ ID NO: 114273 - DNA, 592 bp, Homo sapiens
  misc_feature: GYAE6OF02F3JYP.15.86.H09.1.454.CMB.1.raw
  modified_base (444)..(444): a, c, t, g, unknown or other
  misc_feature (444)..(444): n is a, c, g, or t
  modified_base (523)..(523): a, c, t, g, unknown or other
  misc_feature (523)..(523): n is a, c, g, or t
  modified_base (578)..(578): a, c, t, g, unknown or other
  misc_feature (578)..(578): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgatttttccggatttgcctggaaaaccagcctacccgcttaaaaccgggacaaccgtcgcccggccaacatagccttctccgtccccccttgcagtaacaccaagtacaggaatattaacctgtttcccatcgactacgcctttcgctcgccttaggggtcgactcaccctgccccgattaacgttggacaggaacccttggtccttccggcgagcgggcttttcacccgtcttttatcgttacttatcgtcagcattcgcacttctgatacctccagcatcgcctcacancacaccttcacaggcttacagaaccgcctcccctaacccaacaacgcaataacgcgtcgctcgccgcacgccttcggtnaccgtagttcggtttacgtccccgttttcacttcccttcccgccacttctcggancttacgtagtaccg

SEQ ID NO: 114274 - DNA, 520 bp, Homo sapiens
  misc_feature: GYAE6OF02G42CC.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagccccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctcccaacctccagtctgacgatgaggctgagtatcactgtaggagagagccacacaattgatggaccaaggtacgggttgggtgttcgggacggagggaccagctgaccgtcctaggtcacgg

SEQ ID NO: 114275 - DNA, 593 bp, Homo sapiens
  misc_feature: GYAE6OF02JGO71.15.86.H09.1.454.CMB.1.raw
  modified_base (377)..(377): a, c, t, g, unknown or other
  misc_feature (377)..(377): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttacaaaagtaaaatgatggtagagaaaatagactacggngcaccgtagaaaggagattcacatctacaagagataatacaaaaacgacggtagtatttgacaaatgaacagacctaggaaaaccgaggaaccacgagtaccgtactaattacctcgtaacccacgaagtacttacggaaagtggacagtacgacgtaaaggcggtactagtacgtcttttagacttagtcgtcggggacccagggactagttcgg

SEQ ID NO: 114276 - DNA, 570 bp, Homo sapiens
  misc_feature: GYAE6OF02G2XYY.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccagggaggggctggagtgggttggacgtttcaaaagtaaaatgatggtgagaaaatagactacggtgcaccgtgaaaggagattcacatctacaagagataatacaaaaacgcggtagtatttgactaaatgaacagacctagaaaaccgaggaccacgagaccgtactattactacgtaccacagattacggaagtgacatcgacgtaaggaggactagtcgtcttttagattacgtcgtacgggcccagggtacaagtcgg

SEQ ID NO: 114277 - DNA, 650 bp, Homo sapiens
  misc_feature: GYAE6OF02IZIOF.15.86.H09.1.454.CMB.1.raw
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtcccgcaggctccgaggggaaggggctggagtgggttggtacgtttacaaaagtaaaatgagtggtagaagaaatagactacggtgacaccgtagaaaggagatcaccatctacaagagaataacttacgaaaacgtacggttagtatttagactaaatgaaacacgacccttaagaaaacccggaggaaccaaccgacgacccgttactaactttacctacgtaacccaacgtacgtaacgtttaccgggaaagtcgtacctaacgttaccgaacggtaaaggtaggtcttaagtgttccttttagatttacgtcggttacggggaccccgtaggggtaacctagttcggg

SEQ ID NO: 114278 - DNA, 638 bp, Homo sapiens
  misc_feature: GYAE6OF02H1XRG.15.86.H09.1.454.CMB.1.raw
  modified_base (480)..(480): a, c, t, g, unknown or other
  misc_feature (480)..(480): n is a, c, g, or t
  modified_base (567)..(567): a, c, t, g, unknown or other
  misc_feature (567)..(567): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctgggaggtgggttgggacgtttacaaaagtaaaaatgaatggtagaagaaatagacgtacggtgcaccgtagaaaggaagattcaccatctacaagagaataactttacaaaaacgtacggtagttaatttagactaaaatacgaaacagacccgtanaaaacccggagacaacgagcccgtactaacttactagtacccaagtacgacgtttacggaagtagacaagtacgacgttaaaagggnggtactaattcggtactttttagaacttagtccggttacggggaccccgtaggggtaccaaggttccgggg

SEQ ID NO: 114279 - DNA, 569 bp, Homo sapiens
  misc_feature: GYAE6OF02IMFU8.15.86.H09.1.454.CMB.1.raw
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (458)..(458): a, c, t, g, unknown or other
  misc_feature (458)..(458): n is a, c, g, or t
  modified_base (479)..(479): a, c, t, g, unknown or other
  misc_feature (479)..(479): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctccgagggaggggctggagtgggttggacgtttacaaaagtaaaatgatggtagaagaaatgactacggtgacgaccgtaggaaagagatcacatcanaaganataatacaaaacgtgtntattgacaatgaacagacctagaaaccgngacacacgaccgtatattacncgtaccacgtagacttacggaatcgactagtacggacgtaaggngacttatgtcttttagattgtcgtcggggcccaagggactagtcgg

SEQ ID NO: 114280 - DNA, 616 bp, Homo sapiens
  misc_feature: GYAE6OF02H3P8K.15.86.H09.1.454.CMB.1.raw
  modified_base (526)..(526): a, c, t, g, unknown or other
  misc_feature (526)..(526): n is a, c, g, or t
tcagtctacgtagccacgaccggtgctcgatttagtgctatagacttgggtttggggggggagaggagccccagccttgggatccccaagtgtttttcattcagtgatcaggactgaacacagaggactcaccatggagttcgggctgagctgggtttttccttgctgctatcttaaaaggtgtccagtgtgaagtgcaggtggtggagtcgtgggggagccgttggtaaagccgtgggggtcccttagagtctctgtgtggcctctggattcaccttgagcacttattggatgacttgggtccgccaggctccgaggggaacggggctgggaggtgggtcggcccaaccaataacgaaaaaagatagggaaagtgaaccaacaaaccctataggtagaacttctggtgagtcgggccgattccaccgtctccgagacgacgacgaccaaagactcaactacatctgacaaatcgaaacaaccgtagaagacgaccgaggaccgacggctagtgtatttactgtgngagagagttgttacgtggtcggttacgggggcctaacggggtaacccgttcgggtacctacccggtcccttacccgtaccgacgtccccg

SEQ ID NO: 114281 - DNA, 558 bp, Homo sapiens
  misc_feature: GYAE6OF02IMVCK.15.86.H09.1.454.CMB.1.raw
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggaaggggctgggaggtgggttggacgtttacaaaagtaaaatgatggtagaagaaatagactacggtgcaccgtgaaacggagattcacatctacaaganaattaatacaaaacgtacggtntaattgacaaatgaacagctagaaacgagacacagcctatattctagaccactagattacgaagtgacagtcgacgtaaggaggctagtgtctttagatagtcgtagggcccagggactagtcgg

SEQ ID NO: 114282 - DNA, 714 bp, Homo sapiens
  misc_feature: GYAE6OF02J17VZ.15.86.H09.1.454.CMB.1.raw
tcagtctacgtagccacgaccggtgctcgatttagtgctatagacttgggtttggggggaggaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctggggagccttggtaaagccgtgggggtcccttagagtctcctgtgtggcctctggattcactttcagtaatggctggatgagttgggtccgccaggctccaggggaagggctggagtgggttggacgtttacaaaaggtaaaatgatggtagagaaatagactacggtgtacacccgtagaaacggaagacttacaccagtctacgaagagtataaagttacaaaaacggtaccggttagttaatttacggactaaaagtcgaaaaccgagtacccgtaacggaaaaacccggtacgggaacaaccgaggtacccgtacttaacgttaacctagttaacccgaacgtaaggtaaccgttttacgggaaacggttaggaccgtaacgttaccggtaaccgggtaaaggtaacgggacctttaaggtacggttaccttttttagggaactttaagttacccggtacgggggaacccccgtaagggggtaaccctaaggtttcccgggg

SEQ ID NO: 114283 - DNA, 550 bp, Homo sapiens
  misc_feature: GYAE6OF02HJ32P.15.86.H09.1.454.CMB.1.raw
  modified_base (185)..(185): a, c, t, g, unknown or other
  misc_feature (185)..(185): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctcgatcaagctcacctgcaccctaagtagtgagcatccgaacctacaccatcgaatggtatcaacagagaccagggaagtccccccagtatataatgaaagttaagagtgatggcagccacaccgaagggggacggatccccgatcgcttcatggctccagttctgggctgaccgctacctcaccatcctccaacctccagtctgacgatgaggctgagtactcacgtggtggagagagccacaactaattgagtcggaccaaggtacgggtttgggtcggttcggggaccggaaggggacccaaggccgtaggtacccggtaccgtacgggtcctaacccgg

SEQ ID NO: 114284 - DNA, 602 bp, Homo sapiens
  misc_feature: GYAE6OF02FSFVQ.15.86.H09.1.454.CMB.1.raw
  modified_base (408)..(408): a, c, t, g, unknown or other
  misc_feature (408)..(408): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggccgccaggctccgagggaaggggctggagtgggttggacgtttacaaaagtaaaatgatggtgaagaaatagactacggtgacaccgtagaaaggagattccacatctanaagagaataatacaaaaacgtcggtagtatttagactaaatgaaacagacctagaaaaccgagacacagtcgtatattactagtaccacagtacttacggaagtgacaacgtcgtaacgtaaacggaggtacgtatacggttcttttagattagttcccggtacggggaacccctaggggaacctaggttcggg

SEQ ID NO: 114285 - DNA, 646 bp, Homo sapiens
  misc_feature: GYAE6OF02JW8MX.15.86.H09.1.454.CMB.1.raw
  modified_base (338)..(338): a, c, t, g, unknown or other
  misc_feature (338)..(338): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctgggggagccttggtaaagcctgggggtcccttagagtctcctggtgtggcctctggattcactttcagtaatggctggatgtagtgggtccgccaggctccgagggaacgggctggagtgggtggacgttnaaagtaaatgatggtagaagtaaatagactacggtgacaccggtagaaaggaagattacacctatactanaagagataagttacaaaacgtcggtagtagttagactaaatcgaacgacgacgtaaggaaaacccgtagggtaaccagaacggtacccgttactaacgtttacgtacggtaacccaacgtaggtaacgtttaccgggaagttacggactacgtaccgaacggtaaacggcggtaacctagttacgtacgtttttaggacttaacgtcggtacgggacccgaagggtactagttacggg

SEQ ID NO: 114286 - DNA, 598 bp, Homo sapiens
  misc_feature: GYAE6OF02FPG2Z.15.86.H09.1.454.CMB.1.raw
  modified_base (517)..(517): a, c, t, g, unknown or other
  misc_feature (517)..(517): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaaccccttggtcttccggcgagcgggcttttcacccgtctttatcgttacttatgtcagcattcgcactttctgataccctcagcatgcctcacagcacaccttcacagctacagacgctcccctaccaacaccgcactaacgcgtcgctcgcccgcacgtccttcgggnccgtagttcgggtttaccgtcccccgttttacacttcccttccccgcctacttccgtcgacgtccttaacggtacgtaccg

SEQ ID NO: 114287 - DNA, 599 bp, Homo sapiens
  misc_feature: GYAE6OF02JE036.15.86.H09.1.454.CMB.1.raw
  modified_base (373)..(373): a, c, t, g, unknown or other
  misc_feature (373)..(373): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggaaggggctggaggtgggttggacgtttcaaaagtaaaatgatggtgaagaaatgactaggngacaccgtgaaaggagagtcacatcacaagagataatacaaaaacgcgtgtaatttgacaaatgaacagacctagaaaccgagacacagcctataacttacacgtaccacgagtagttacggaagttgacattaccggaacggttaaaggagggtaccttaagtacgttacgtttttagaagttacgttaccggtacgggggacccaggggtaccaaggttccggg

SEQ ID NO: 114288 - DNA, 587 bp, Homo sapiens
  misc_feature: GYAE6OF02GTF5K.15.86.H09.1.454.CMB.1.raw
  modified_base (502)..(502): a, c, t, g, unknown or other
  misc_feature (502)..(502): n is a, c, g, or t
  modified_base (535)..(535): a, c, t, g, unknown or other
  misc_feature (535)..(535): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggttggacgtttacaaaagtaaaatgagtggtagaagaaatagactacggtgcaccgtagaaaggagattacacatcacaagagaataatacaaaacgtacggtagttatttagacaaatagaacacgacctagaaaaccgaggacacacgtccgtactattactacgtaccanagtattacggaagtgacagtacgaaggtaaggnggtactagtcgtacgtttagattacgtcgtcgggacccagggactagttcgg

SEQ ID NO: 114289 - DNA, 645 bp, Homo sapiens
  misc_feature: GYAE6OF02I3MRU.15.86.H09.1.454.CMB.1.raw
  modified_base (413)..(413): a, c, t, g, unknown or other
  misc_feature (413)..(413): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccttggtaaagccgtgggggtcccttagagtctcctgtgtggcctctggattcactttcagtaatggctggatgagttgggccgcgaggctcgagggaaggggcgtggaggtgggttggacgtttacaaaagtaaaatgagtggtagaagaaatagacgtaggtgactaacccgtagaaaggagattcaccatcanaagagtaataataacaaaacgtcgtagttattacgaacaaatacgaaacacgaccgtaaagtaaaaccgagaaccaacgacggtacccgttacttaacgttaccgtactaaccgaacgtaagtaacgtttacgggaaatccgaactaagtaccgaacggtaaaggacggtcttaagttcgttagttttacgaattacggtcggtaccgggaccgaaggggtactaggttcgg

SEQ ID NO: 114290 - DNA, 655 bp, Homo sapiens
  misc_feature: GYAE6OF02GNFI2.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccgaggctccgagggaaggggcgtgggaggtgggttggacgtttacaaaaagtaaaatgagtggtagaagaaaatagacgtacggtgacgaccgtagaaaggagattacacatactacaaagagaataaattacaaaaaacggtacggttagttaatttagactaaaagttacgaaacagaccctaaggaaaacccggagaacacagaccgtataattactacgtaaccacgtaagacgtttaccggaaagttcgactaagtaccgaacgggtaaaggagggtctaagttcggtacgtttttagaattacgttcgggttaccggggaccctaaggggtacctaaggttccggg

SEQ ID NO: 114291 - DNA, 561 bp, Homo sapiens
  misc_feature: GYAE6OF02FOLJ0.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccagggaaggggctggagtgggttggacgtttcaaaagtaaaatgatggtgagaaaatagactacggtgcaccgtgaaaggagattcacatctacaagagataattacaaaaacgcggtagtatttgactaaatgaacagacctagaaaaccgagacacagccgtatattacagtaccacagattcggaagtgacagtcgacgtaaggaggctagtgtcttttgatagtcgtcggggcccagggacagtcggg

SEQ ID NO: 114292 - DNA, 647 bp, Homo sapiens
  misc_feature: GYAE6OF02FE9NQ.15.86.H09.1.454.CMB.1.raw
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (423)..(423): a, c, t, g, unknown or other
  misc_feature (423)..(423): n is a, c, g, or t
  modified_base (491)..(491): a, c, t, g, unknown or other
  misc_feature (491)..(491): n is a, c, g, or t
  modified_base (510)..(510): a, c, t, g, unknown or other
  misc_feature (510)..(510): n is a, c, g, or t
tcagtctacgtagccacgaccggtgctcgatttagtgctatagacttgggtttggggggggagaggagccccagccttgggatcccccaagtgtttttcattcagtgatcaggactgaacacagaggactcaccatggagttcgggctgagcgtggttttcgtgagtgctaatacttaaaaggtgtccagtgtgaagtgcaggtggtggagtctgggggagccttggtaaagccgtgggggtccctttagagtctcctgtgtggcctctggattcactttcagtaatggctggatgacgttgggtccgcaggctccgagggaagggctggagtgggttgacgtttanaaaagtaaangagtggtgaagaaaatagactaggtgcaccgtaggaaaaggtagattcgaaccatactacaagganaactaattacgaaaaaacgcgggttataatttgactaaaagtcgaaactgaccgtaggaaaaacccgnggaacaacgacgtaccttnttaactttaccaggttaacccaacgtaagtaacgtttaccgggaaattcgcgtaataccgggtaacgtaaagggacggtacttaattccgtaagttttagaactagttcggtacgggaccctagggactagttcggg

SEQ ID NO: 114293 - DNA, 555 bp, Homo sapiens
  misc_feature: GYAE6OF02F7HC0.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaagggctggagtgggttggacgtttacaaagtaaaatgatggtagagaaatgactacggtgcaccgtgaaaggagattcacatctacaagagataattacaaaaacgcggtagtatttgactaaagtgaacagcctagaaacgagacacgagccgtatattactgtaccacagattcgaagtgcatcgacgtaaggaggtctatgtcttttagattagtcgtcgggcccagggtacagtcgg

SEQ ID NO: 114294 - DNA, 653 bp, Homo sapiens
  misc_feature: GYAE6OF02JEFSH.15.86.H09.1.454.CMB.1.raw
tcagtctacgtagccacgaccggtgctcgatttagtgctatagacttgggtttggggggggaggaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttggtccgcaggctccgagggaggggctggagtgggttggacgtttcgaaaagtaaaatgatggtgaagaaatgactacggtgcgaacccgtagaaacggagattcacctatctacaaggagaataattacgaaaaaccgtaggtagttaatttcgactaaatgaaacacgtacctaggaaaaacccggaggaaccaacacgggtacccgtcgttaacttaacgtccgttaacccaacgtaaggtacgtttaccgggaaagttcgcgtaaacgtaccgacggtaaaagggcggaacgttattcggtacctttttagaagttacgttcggttaccgggcccgtaagggactagttacggg

SEQ ID NO: 114295 - DNA, 572 bp, Homo sapiens
  misc_feature: GYAE6OF02FN1Z8.15.86.H09.1.454.CMB.1.raw
  modified_base (349)..(349): a, c, t, g, unknown or other
  misc_feature (349)..(349): n is a, c, g, or t
  modified_base (459)..(459): a, c, t, g, unknown or other
  misc_feature (459)..(459): n is a, c, g, or t
  modified_base (486)..(486): a, c, t, g, unknown or other
  misc_feature (486)..(486): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccagggaaggggctggagtgggtggacgtttcaaaagtaaaangatggtgagaaatagactacggtgcaccgtgaaaggagattacacatctacaagagataattacaaaaacgcggtagtaatttgacaaatgaacagacctagaaaaccgngaacacagccgtctattactgtaccanagattcggaagtgcatacgacggtaaaggaggacttaagtgtacttttgaattatcggtacggggccctaggggactagttcgggg

SEQ ID NO: 114296 - DNA, 670 bp, Homo sapiens
  misc_feature: GYAE6OF02H5PKL.15.86.H09.1.454.CMB.1.raw
  modified_base (388)..(388): a, c, t, g, unknown or other
  misc_feature (388)..(388): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaggggctgggagtggggttggacgtttacgaaaaagttaaaatgaagtggtagaagaaaatagaacgtacggngcaaccgtgaaaaggaagatacacatctacaagagattaacttacaaaacggtacggtagttatttagactaaatgaaccagtacctaagaaaaccgaggtaaccacgagtacccgtacttaattaacctacggtaacccaacgtacgtaacgttcgggaaaagttcggactaagtaccggtaacggtaaacggggagtaccttaagtcggtttactttttaaggagttttacgttcgggttaccgggggaccccgtaaggggtaccctaaggttcccgggg

SEQ ID NO: 114297 - DNA, 625 bp, Homo sapiens
  misc_feature: GYAE6OF02IHF06.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagctgggggtccttagagtctcctgtgtggcctctggattcacttcagtaatggctggatgagttgggtccgccaggctccgagggagggctggagtgggttggacgtttacaaaagtaaaatgaatggtagagtaaaatagatacgtgacaccgtgaaacggagaattcacatctacaagagaataactaacaaaacgacggtagtaactttgacaaattgaacaagcctaagaaaacgaggacaacagccgtataacttaactacgtaccgacaagtagttaccggaaaggttcacgtaagttaccggaacgttaaacggggacggtaaccgttaagtcggtacctttttaggaattacgttacgccgggggtaccctaacggggtacaagttacgggg

SEQ ID NO: 114298 - DNA, 606 bp, Homo sapiens
  misc_feature: GYAE6OF02IBCQ9.15.86.H09.1.454.CMB.1.raw
  modified_base (455)..(455): a, c, t, g, unknown or other
  misc_feature (455)..(455): n is a, c, g, or t
  modified_base (542)..(542): a, c, t, g, unknown or other
  misc_feature (542)..(542): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctctgtgtggcctctggattcactttcagtaatggctggatgagttgggtccgccaggctccgagggaggggctggagtgggtggacgtttacaaaagtaaaatgagtggtagaagaaaatagacgtacggtgcaacccgtaggaaagaagattcaccatctacaagagataattacaaaaacgtcggtagtatttgacaaatgaaacngacctaagaaaaccgaggaacacgagtccgtactattaactagtaccacgaagtattacggaagtgactagtacgaaggtaaacggnggtactaagtcgtacgtttttagattagtcggttacggggaccccagggtaaccagttaccggg

SEQ ID NO: 114299 - DNA, 582 bp, Homo sapiens
  misc_feature: GYAE6OF02F46K9.15.86.H09.1.454.CMB.1.raw
  modified_base (470)..(470): a, c, t, g, unknown or other
  misc_feature (470)..(470): n is a, c, g, or t
  modified_base (501)..(501): a, c, t, g, unknown or other
  misc_feature (501)..(501): n is a, c, g, or t
  modified_base (533)..(533): a, c, t, g, unknown or other
  misc_feature (533)..(533): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggaggggctgggagtgggttggacgtttacaaaagtaaaatgatggtagaagaaatagactacggtgacaccgtagaaaggaagattcacatctacaagagaataattacgaaaaacgtcggtagtatttgaactaaatgaacagacctagaaaaccgngaacacgacgcctactacttacagtaaccanagtattacggaatgacagtacggacgtaaggnggtactagtgtcttttagattgtcggtcgggaccctagggactagtcgg

SEQ ID NO: 114300 - DNA, 617 bp, Homo sapiens
  misc_feature: GYAE6OF02F99F6.15.86.H09.1.454.CMB.1.raw
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
  modified_base (418)..(418): a, c, t, g, unknown or other
  misc_feature (418)..(418): n is a, c, g, or t
  modified_base (556)..(556): a, c, t, g, unknown or other
  misc_feature (556)..(556): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgagggaggggctggagtgggtggacgtttacaaaagtaaaangatggtagaagtaaaatagacgtacggngcaccgtagaaaaggagattcgactatctacaaganaataataacaaaaacggtgtgtaattagactaaagtagaacagacctaagaaacccgaggaacactacgccctagtaacttacgtacgtaccaacgtagtaacttacggaaagtcgactagtaccgaggttaaacggnggtaccttagtcggttacttttagagttacgtcggtacgggcccaggggtacaggttcggg

SEQ ID NO: 114301 - DNA, 623 bp, Homo sapiens
  misc_feature: GYAE6OF02G6H05.15.86.H09.1.454.CMB.1.raw
  modified_base (418)..(418): a, c, t, g, unknown or other
  misc_feature (418)..(418): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccgaggctccgagggaaggggctggaggtgggttggacgtttacaaaagtaaaatgatgggtagagaaaatagactaggtgacaccgtagaaaggagattcacatctacaaganaataattacaaaaacgcggttagtaatttgactaaatagaaacacgacctaagaaaaccgaggaaccagacgtccgtactaactttaaccagtaccaacaggtaacttcgggaaagttcggacaagtaccggtaagtaaagggacgtactaagttcggtcttttagattacgtccggtgggggaccccaaggggactagttcggg

SEQ ID NO: 114302 - DNA, 597 bp, Homo sapiens
  misc_feature: GYAE6OF02FY50G.15.86.H09.1.454.CMB.1.raw
  modified_base (545)..(545): a, c, t, g, unknown or other
  misc_feature (545)..(545): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggctggagtgggttggacgtttacaaaagtaaaatggaatgggtagaagaaaatagactacggtgcaccgtgaaaggagattacacatctacaaagagaataaatttacaaaaacggacggttagttaatttagacaaaatgaaacagcctaagaaaaccgaggaacacgagccgtactattactagtaaccacagattacggaatgcagtaccgagtaaaggnggtactagtgtcttttagattacgtcgtggggacccagggacctagttcggg

SEQ ID NO: 114303 - DNA, 601 bp, Homo sapiens
  misc_feature: GYAE6OF02GTAS1.15.86.H09.1.454.CMB.1.raw
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
tcagtctacgtagccacgaccggtgctcgatttagtgctatagacttgggtttgggggggggagaggagccccagccttgggatcccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaagccgtgggggtcccttagagtctcctgtgtggcctctggattcactttcagtaatggctggatgagttgggtccgccgaggctccgaggggaaggggcgtgggaggttggggttaggtacgtttacgaaaaagttaaaatgagtaggtagaagaaaatagactacggtgacaccgtagaaaggaagattcaacatacnaaganataatacaaaacgcgtatattnacaaatnaacagacctagaaaccgngacacncgcctatattacagtaccacgagtattacgggaatgactagtaccgaacgtaaaggcggtatagttggttacttttagattagtccggtcggggacccaagggtacctaggttcgg

SEQ ID NO: 114304 - DNA, 615 bp, Homo sapiens
  misc_feature: GYAE6OF02GUKOI.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagcctggggggtcccttagagtctcctgtgtggcctctggattcactttcagtaatggctggatgagttgggtccgcaggctccgaggggaaggggctgggagtgggttggacgtttacgaaaagtaaaatgagtggtagaagaaaatagacgtacggtgacaccgtagaaaggaagattcacatctacaagagaattaatacgaaaaacgtacggtagttaatttaggactaaagtcgaaacaggaccctaaggaaaaccgaggacaacgagcccgttataactttaccgtacgtaacccacaagtatttacggaagtgacatacggacgtaagggagtctattgtcttttagattacgtcgtcggggacccaagggtacaagtcgg

SEQ ID NO: 114305 - DNA, 600 bp, Homo sapiens
  misc_feature: GYAE6OF02HALVR.15.86.H09.1.454.CMB.1.raw
  modified_base (419)..(419): a, c, t, g, unknown or other
  misc_feature (419)..(419): n is a, c, g, or t
  modified_base (462)..(462): a, c, t, g, unknown or other
  misc_feature (462)..(462): n is a, c, g, or t
  modified_base (474)..(474): a, c, t, g, unknown or other
  misc_feature (474)..(474): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagcttggtaaagccgtgggggtcccttagagtctcctgtgtggcctcgtggattcactttcagttaatggtactggatgagttgggtccgccaggctccgagggagggctggagtgggttggacgtttacaaaagtaaaatgaatggtagaagaaaatagacgtacggtgacaccggtagaaaacggaagacttacacatctanaagagataatacaaaacgcggtatattgaacaaatagaacganactagaaaacgnggaacacgagtccgtactaattactagtaccagagtacttacggaagtgacgtactacgacgtaggaggaacggcttagtgttaccgtttagacttacgtcgtacggggaccctagggactaacgg

SEQ ID NO: 114306 - DNA, 692 bp, Homo sapiens
  misc_feature: GYAE6OF02J28CG.15.86.H09.1.454.CMB.1.raw
  modified_base (243)..(243): a, c, t, g, unknown or other
  misc_feature (243)..(243): n is a, c, g, or t
  modified_base (632)..(632): a, c, t, g, unknown or other
  misc_feature (632)..(632): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaagccgtgggggtcccttagngtctctgtgtggcctctggtattctactttcagtaatggctggatggtaggttcgggtcccgccgagggcctaccggagggggaacggggcgtgggaggttggggttaggtacgttttaacgaaaaaggttaaaatggaagtgggtagaaagaaaagtaggaacgtacggtcgaccgaaccggtaggaaaaggacgtacttaccacctataccgtacaagaagtaataaacgttaacgaaaacggtcggttagttaattacgaactaaagtacgaaacagacctaaggaaaaccggagaacacgacgtaccttaccttaattaaccgtcgtaaacctaacgaaggtaacgtttacgggaattcgaacgtacgtacggtacggtaaaggngtacttaagtcgttactttagatttacggtcggacgggaccctaaggggactaggttcgg

SEQ ID NO: 114307 - DNA, 621 bp, Homo sapiens
  misc_feature: GYAE6OF02GTPJO.15.86.H09.1.454.CMB.1.raw
  modified_base (571)..(571): a, c, t, g, unknown or other
  misc_feature (571)..(571): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatcttaaaaggtgtccagtgtgaagtgcgaggtggtggagtcgtggggagccgttggtaaagccgtgggggtccttagagtctcctgtgtgcctctggattcactttcagtaatggctggatgagttgggtccgccaggctccgaggggaagggctggagttgggttggacgtttacaaaagtaaaatgagtggtagaagaaaatagaacgtacggtgaccgaaccgtagaaacggaagattcaacctatacacaaagagtaataataacgaaaaacgtacggttattaactttggaactaaatacgaaacgacgaccgtaaggaaaaccgaggaacaacgacgtccgtacttacttacgtactaaccactacgtagttacgaatcgacagtacgagtaaggngtactatgtctttagattacgtcggtacgggcccaagggtacaggttcgg

SEQ ID NO: 114308 - DNA, 577 bp, Homo sapiens
  misc_feature: GYAE6OF02FPMKN.15.86.H09.1.454.CMB.1.raw
  modified_base (489)..(489): a, c, t, g, unknown or other
  misc_feature (489)..(489): n is a, c, g, or t
  modified_base (503)..(503): a, c, t, g, unknown or other
  misc_feature (503)..(503): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgccaggctccgagggaaggggctggagtgggttggacgtttcgaaaagtaaaatgatggtgaagaaaatagactaggtgcaccgtgaaaggagatcaacatctacaagagaataatacaaaaacgacggtagtatttgacaaatgaaacagcctagaaaaccgagacacagcctatattactagtaccanagacttacgaagtnacaatcgaacgtaaggacggtctaagtagtcttttagactagtcggttcggggacccaaggggtactaggtcgg

SEQ ID NO: 114309 - DNA, 575 bp, Homo sapiens
  misc_feature: GYAE6OF02GEEA7.15.86.H09.1.454.CMB.1.raw
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (536)..(536): a, c, t, g, unknown or other
  misc_feature (536)..(536): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttgacgtttcaaaagtaaaaatgaatggtgagaaaatagactacggtgcaccgtgaaaggaanagttcacatctnaaagagaataatttacaaaaaacgtacggtagtaatttgactaaaaatggaaacagacctaggaaaaaccgaggacaacagccgtactaattactgtaccacagaattcgggaaatggacatcgagtaaaggnggactatggacttttgatatctgggcccaggacaatcgg

SEQ ID NO: 114310 - DNA, 569 bp, Homo sapiens
  misc_feature: GYAE6OF02HGBGK.15.86.H09.1.454.CMB.1.raw
  modified_base (479)..(479): a, c, t, g, unknown or other
  misc_feature (479)..(479): n is a, c, g, or t
  modified_base (543)..(543): a, c, t, g, unknown or other
  misc_feature (543)..(543): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggagggctggagtgggtggacgtttacaaagtaaaatgatggtgaagaaaatagactacggtgcaccgtagaaaggaagattcacatctacaagagataatacaaaacgtacggtagtatttgactaaatgaaacagacctaggaaaaccgaggacacagaccgtntaattactagtaccaacagacttacgaagtacatacgaagtaaggcgtactatgtactttgatntcgtcgggacccagggacagtggtcg

SEQ ID NO: 114311 - DNA, 636 bp, Homo sapiens
  misc_feature: GYAE6OF02HEJGN.15.86.H09.1.454.CMB.1.raw
  modified_base (449)..(449): a, c, t, g, unknown or other
  misc_feature (449)..(449): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaggggctggagtgggttggacgtttacgaaaagtaaaatgatggtgagaaatagactacggtgcaccgtagaaaggaagattcaccatctacagagtataatacaaaacgcggtatatttgactaaatcgaanagacctaggaaaaccgaggaacacgacgccgtacttaacttacgtacgtaaccacaagtaacgtttaccgggaaagtcgacagtaacgggtaacgtaaaagggcgggtaacttagttcggttacgtttttaggtacttacgttccgggttacggggacccctaagggggtacctaaggttaccgggg

SEQ ID NO: 114312 - DNA, 606 bp, Homo sapiens
  misc_feature: GYAE6OF02IK3JE.15.86.H09.1.454.CMB.1.raw
  modified_base (484)..(484): a, c, t, g, unknown or other
  misc_feature (484)..(484): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatggagttgggtccgccaggctccgaggggaggggctgggaggtggggttggtacgtttacaaaaagtaaaatgagtggtagaagaaaatagacgtacggtgacaccgtagaaaggagattacacatctacaagagataatacgaaaaacgtacggtagttaatttagactaaatcgaacagacctaagaaaaccgngaacacacgcctactattactacgtaccacagtacgttacggaagtcgacagtacgacgtaaaggngtacttagtgttactttagaattacgtcggtacggggaccctagggaccagtcggg

SEQ ID NO: 114313 - DNA, 719 bp, Homo sapiens
  misc_feature: GYAE6OF02JZXFL.15.86.H09.1.454.CMB.1.raw
  modified_base (197)..(197): a, c, t, g, unknown or other
  misc_feature (197)..(197): n is a, c, g, or t
  modified_base (326)..(326): a, c, t, g, unknown or other
  misc_feature (326)..(326): n is a, c, g, or t
  modified_base (374)..(374): a, c, t, g, unknown or other
  misc_feature (374)..(374): n is a, c, g, or t
tcagtctacgtagccacgaccggtgctcgatttagtgctatagacttgggtttgggggggaggagggagccccagccttgggatccccaagtgttttcattcagtgatcaggactgaacacagaggactcaccatggagttcgggctgagctgggttttccttgctgctatcttaaaaggtgtccagtgtgaagtgnaggtggtggagtcgtgggggagtccttagggtaaagccgtggggggtcccttaggagtctcctgtgtggcctactggattcactttcagtaatggctggatgagttggtccgcaggctcagggacgggngtggagtgggttggacgtttacgaaaagtaaaatgatggtgaagaaanagactaggtgacaccgtagaaacggagtattacactaagtctacgaaacgtagaattaacttaacgaaaaacggtaccggttagttaacgtttagactaaaagtacgaaacgtaacgtaccgtaaggaaaaccggaaagggaccaaacggaccgaaccggttcttaaacgttacgttacgaacccaacgtaacgtaagtttaccggaaaggtacgacgtaacgttaacggaacgggtaaacggtacgggtactaaccggtttatacccggttttttaagacgtttaacggtacccggtttaacggggggaacccccctagggggtaaccgtaacgtttacggggg

SEQ ID NO: 114314 - DNA, 651 bp, Homo sapiens
  misc_feature: GYAE6OF02H8QKS.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggcctccgaggggaggggctgggaggtgggttggacgtttacaaaagtaaaatgagtggtagaagaaatagacgtacggtgaccgaccgtagaaaggaagtacttacacctatcacaaagagtaattaaacgttaacgaaaaacggtcggttagttaatttagaactaaaagtgaaacacggtaccctaaaggaaaacccgaaggaaccaaccgacgaccgttacttaatttaccgtacgtaacccaacgagtaacgtttacgggaaagtcgactagtacgaacggttaaagggagtctagtgttactttgaattctcggtaccgggaccgagggtactagtcgg

SEQ ID NO: 114315 - DNA, 661 bp, Homo sapiens
  misc_feature: GYAE6OF02I4TRG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttaagtaatggctggatgtagttgggtccgccaggctccgagggaaggggctgggaggtgggttggacgttacaaaagtaaaatgagtggagaagaaaatagactacggtgaccaccggtaggaaaggaagacttacaccatctacgaagagtaacttaataacgaaaaacggtcggtagttaagtttagacaaagttgaaacaggtaccctaaggaaaacccggaggaccaaccgacgcccgttattaacttaccgtagttaacccacgaagtactttacgggaagttgaccaagttacgaacggtaaggacggtacttaagtgttaccttttaggaacttagttccggtacgggacccgaagggtaacctacggtcggttaccg

SEQ ID NO: 114316 - DNA, 590 bp, Homo sapiens
  misc_feature: GYAE6OF02GEUG1.15.86.H09.1.454.CMB.1.raw
  modified_base (452)..(452): a, c, t, g, unknown or other
  misc_feature (452)..(452): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtccctgagactctcctgtgcagcctcaggattcgcctttcgcatctatgccatgacctgggtccgccaggctccagggaaggggctggagtggatctcagctattagtggaggtggtagtggtgaaacgacatatacgtcagcgtccgtgaggcgctcgaccatctccagacgacgaacttaccaaacaaccaacactttactacgtttacctaaanagtaaccaacgaccttcgaccgaggtccgaacggacaccggaccgtattacgaacttggtagcgacggaatacgtacgaaccgaacggcccgggtacgggtacgccccgggttacgaccgtaacggtcggggacccgg

SEQ ID NO: 114317 - DNA, 655 bp, Homo sapiens
  misc_feature: GYAE6OF02H4RJ4.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttggtccgcgaggctccgagggaggggctggaggtggttggacgtttacaaaagtaaaatgatggtagaagaaatagacgtacggtgacgaccgtagaaaggaagattacacatactacaaagagaactaactaaccgaaaaacggtcggttagttaatttagaactaaagtacgaaacacgtaccgtaagaaaacccggaggaacaacgagacccgtacttaattacctacgtacccagagtagttacggaaagtcgactacgtacggaacggtaaagggacggtacgttagttgttactttttgaatttaacgttccgggttacggggaccccgaaggggtaaccctaaggttccggg

SEQ ID NO: 114318 - DNA, 534 bp, Homo sapiens
  misc_feature: GYAE6OF02FQZ8C.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtactataatgaaagttaagagtgatggcagccacaccgaagggggacgggatccccgatcgcttcatgggctccagttcgtggggctgacccgctaccctcaccatcctcccaacctccacgtctgacgatgaggctgagtactcactgtggagagagccacacaattgatggacaaggtacgggttgggtggttcgggacggacgggaccgaggcgtggaccgtccgtaggtcgaccgg

SEQ ID NO: 114319 - DNA, 599 bp, Homo sapiens
  misc_feature: GYAE6OF02ITA0F.15.86.H09.1.454.CMB.1.raw
  modified_base (221)..(221): a, c, t, g, unknown or other
  misc_feature (221)..(221): n is a, c, g, or t
  modified_base (468)..(468): a, c, t, g, unknown or other
  misc_feature (468)..(468): n is a, c, g, or t
tcagtctacgtagccacgaccggtgctcgatttagtgctatagacttgggtttgggggggaggagggaggccccagccttgggatccccaagtgttttcattcagtgatcaggactgaacacagaggactcaccatggagttcggggctgagctgggttttccttgctgctatcttaaaaggtgtccagtgtgaagtgcaggtggtggagtctgggggganccttgggtaaagccgtggggggtcccttagagtctcctgtgtggcctctggattcactttcagtatggctggatgagttgggtcgccagggctccagggaagggcgtggagtgggttggcgtttcaaaagtaaaatgatggtgaagaaatagacaaggtgacacccgtgaaaggaagattacacagtactcaagagataattacaaaacgacgtagtattagacaaatgaacagactagaaaaccgngaacacagcctactaagttacctgtaccacaagtaacttcggaaatagctaagtccggaacgttaaaggacggattaatgtaaccgttttagattaagtcgtacggggtacccgagggtacaagttacggg

SEQ ID NO: 114320 - DNA, 550 bp, Homo sapiens
  misc_feature: GYAE6OF02GFKN6.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatggtgagaaatagactacggtgcaccgtgaaaggagattcacatctcaagagataattcaaaaacgacggtagtatttagactaaatagaacagcctagaaaaccgagacacagcctactattactgtaccacagattcggaatgcatcgacgtaaggagctaatgtactttgatatcgtgggcccaagggacaagtcgg

SEQ ID NO: 114321 - DNA, 587 bp, Homo sapiens
  misc_feature: GYAE6OF02IVRG9.15.86.H09.1.454.CMB.1.raw
  modified_base (406)..(406): a, c, t, g, unknown or other
  misc_feature (406)..(406): n is a, c, g, or t
  modified_base (499)..(499): a, c, t, g, unknown or other
  misc_feature (499)..(499): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagccgtgggggtcccttagagtctcctgtgtggcctctggattcacttcagtaatggctggatgagttgggtccgcaggctccgagggaaggggctggaggtgggttggacgtttacgaaaagtaaaagtgatggtagaagaaaatagactaggtgcaccgtgaaaggagatcaacatctanaagagaataatacaaaaagcggtatatttagacaaagtagaactagacctagaaaaccgaggaacacagcccgtataacttactagtaccaanagtaattcgaaagtnacgaatcgacgtaaaggaggctaagtgtactttagaattagtcggtacgggtcccgaagggtacaagttcggg

SEQ ID NO: 114322 - DNA, 652 bp, Homo sapiens
  misc_feature: GYAE6OF02IBSGT.15.86.H09.1.454.CMB.1.raw
  modified_base (262)..(262): a, c, t, g, unknown or other
  misc_feature (262)..(262): n is a, c, g, or t
  modified_base (394)..(394): a, c, t, g, unknown or other
  misc_feature (394)..(394): n is a, c, g, or t
  modified_base (602)..(602): a, c, t, g, unknown or other
  misc_feature (602)..(602): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaagccgtgggggtcccttagagtctcctgtgtggcctntggattcactttcagtaatggctggatgagttgggtccgccgaggctccgagggaacggggctgggaggtgggttggacggttttacaaaaaggttaaaatgaatgggtagaagaaaagtagacttaacggngaccgaacccggtaggaaaaggaagtaattccgaacctatctacgaaagagaacttaattaacaaaaacgggtcggttagttaatttagactaaatgaaacacggacctaaggaaaacccgaggaacaacgacgaccgttactacgttaacctgtaacccaacgtaagtacgttacgggaagtcgactagtaccgaacggtaaagggngtactattgtcttttagattcgtacggtcgggacccagggtacagttcgg

SEQ ID NO: 114323 - DNA, 559 bp, Homo sapiens
  misc_feature: GYAE6OF02F4YEG.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggttttcgtgcgtgctatctaaaggtgtccagtgtgaagtgcaggtggtggagtctgggggagccttggtaagcctgggggtcccttagagtctcctgtgtggcctctggattcactttcagtaatggctggatgagttgggtccgcaggctccagggaaggggctgggagtggggttggacgtttacaaaagtaaaatgatggtagagaaatagactaggtgcaccgtagaaaggaagattacaccatctacaagagataattacgaaaacgacggtagtatttgacaaatagaacagacctagaaaaccgagacacacgcctactattactacgtaccacatattacgaatgacatacgagtaaggagactagtgtctttgatagtcgtgggccagggtacagtcgg

SEQ ID NO: 114324 - DNA, 547 bp, Homo sapiens
  misc_feature: GYAE6OF02H2A74.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctcacaggtctctgtgctctgcctgtgctgactcagcccccgtctgcatctgccttgctgggagcctgatcaagctcacctgcaccctaagtagtgagcatccgaacctacacccatcgaaatggtatcaacagagaccagggaacgtccccccagtactataatgaaagttaagagtgatggcagccacaccgaagggggacgggactccccgatcgcttcagtgggctcagttcgtggggtctgacccgctacctcgaccatcctacccaacctccacgtctgacgtatgaggctagagtatcacgtgtaggagagagccacacaattgagtggaccaagggtacggttgggttcggttcgggacggacggaccgagcgtcgtaccggtcgtaggtcctaaccgg

SEQ ID NO: 114325 - DNA, 571 bp, Homo sapiens
  misc_feature: GYAE6OF02GAHXW.15.86.H09.1.454.CMB.1.raw
  modified_base (344)..(344): a, c, t, g, unknown or other
  misc_feature (344)..(344): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggctggagtggggttggacgtttanaaaagtaaaatgatggtagagaaaatagactacggtgcaccgtgaaaggagatcacatcacaagagataatacaaaacgnggtntatttgacaaatnaacagcctaagaaaccgagaacacagcctatattactgtaccacgagtagttacgaatgacagtccgacgtaaggacggtctaagtcgtacttttgattagtcggtcggggacccagggacaagttcggg

SEQ ID NO: 114326 - DNA, 626 bp, Homo sapiens
  misc_feature: GYAE6OF02GC7UM.15.86.H09.1.454.CMB.1.raw
  modified_base (245)..(245): a, c, t, g, unknown or other
  misc_feature (245)..(245): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcccttagngtctcctgtgtggcctctggattcactttcagtaatggctggatgagttgggtcccgcgaggctccgaggggaaggggcgtgggaggtgggttggtacgtttacgaaaagtaaaatgagtaggtagaagaaaatagacgtacggtgcaccgtagaaaggaagatcacatctacaagagataatacaaaacgtacggtagtatttagacaaagtagaaacagaccctaaggaaaaccgaggaacacgaacgccgtacttacttactcgtaccacgaagacttacgggaagtcgactatacggaacgttaaagggacggtactaattcggtactttttaggaattacgtcggtaccggggaccccaggggtacaggttccggg

SEQ ID NO: 114327 - DNA, 589 bp, Homo sapiens
  misc_feature: GYAE6OF02F2QAJ.15.86.H09.1.454.CMB.1.raw
  modified_base (491)..(491): a, c, t, g, unknown or other
  misc_feature (491)..(491): n is a, c, g, or t
  modified_base (506)..(506): a, c, t, g, unknown or other
  misc_feature (506)..(506): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtatggctggatgagttgggtccgccaggctccgaggggaaggggcgtgggaggtggggttggacgtttacgaaaagtaaaatgatggtagaagaaatagacgtacggtgacaccgtagaaaggaagatacacatctacaagagaataatacaaaacgtcggtagttatttagacaaatgaaacagacctaagaaaccgagaacacacgacctntaattacagtaccanagtagttacgaagtcgacataccggagtaaggagtctaagtgtcttttgattagtccggtagggcccgagggtactagtcggg

SEQ ID NO: 114328 - DNA, 628 bp, Homo sapiens
  misc_feature: GYAE6OF02HSSA2.15.86.H09.1.454.CMB.1.raw
  modified_base (284)..(284): a, c, t, g, unknown or other
  misc_feature (284)..(284): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagcgtgggttttccgttgacgtgctatacgtaaaaggtgtccagtgtgaagtgcagggtggtggagtcgtgggggagccttgggtaaagccgtgggggtccttagagtctcctgtgtggcctctggattcactttnagtaatggctggatgagttgggtcgccaggctccgagggagggctgggagtgggtgtacgtttacaaaagtaaaatgagtggtagaagaaaagtacgagtacggtgaccgaccggtaggaaaggaagattacaacagtctacaaggaagtataaacgttaacaaaaacggtacggtagttaatttagactaaaataggaaacagactaagaaacgagaacacacgcgtacttacgttactacgtacctacattacgtcgaagttcgactacgttaacgacgggtaaaggaggcttagtacgttctttagacttgtcggacgggtacccgagggactaggtcggg

SEQ ID NO: 114329 - DNA, 701 bp, Homo sapiens
  misc_feature: GYAE6OF02IPYP7.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtggtggcctcgtggattctactttcagtaatggcgtggatgagttggtcgcgaggctcgagggagggcgtggacggtgggtaggtacgtttaacgaaagtaaaagtgtagtaggtagaagtaaaagtaagtacgtaacggtgaccgtaacccggtaaggaaaggtaagaacttacgaacctacgttctacgaaagaagtaacttaaacgttaaaccgaaaaaacggtcggtagttaactttggaactaaaagtacggtaaacaggtaccctaaaggtaaaacccgagaaacctacgaacgtcctacgttacttaaccgtacgtaacccaagacgtaacgttggtaaacgtcgaacgaacgtaccggtaagtaaacgggacgtacggttagtcgttaacgttttacgagttacgtccggtacgggtaccgaacgtacggattccggg

SEQ ID NO: 114330 - DNA, 580 bp, Homo sapiens
  misc_feature: GYAE6OF02JMI8J.15.86.H09.1.454.CMB.1.raw
  modified_base (426)..(426): a, c, t, g, unknown or other
  misc_feature (426)..(426): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (503)..(503): a, c, t, g, unknown or other
  misc_feature (503)..(503): n is a, c, g, or t
  modified_base (538)..(538): a, c, t, g, unknown or other
  misc_feature (538)..(538): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctcgtggattcactttcagtaatggctggatgaggttgggtccgcgaggctccgaggggaaggggcgtggaggtgggttggtacgtttacgaaaaaggtaaaatgagtggtagaagaaaatagacgtaggtgacaccgtagaaagagatacacatctacaaganaataatacaaaacgtcgtataattaganaaatnaacagcctaaggaaaaccgaggaacacgacgcgtactagttacngtaaccacagtacttagatgacatacgagtaaggngactagtgtattagatacgtcggcggaccaagggacagtcgg

SEQ ID NO: 114331 - DNA, 633 bp, Homo sapiens
  misc_feature: GYAE6OF02GSVWE.15.86.H09.1.454.CMB.1.raw
  modified_base (324)..(324): a, c, t, g, unknown or other
  misc_feature (324)..(324): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagtccgttggtaagccgtgggggtcccttagagtctcctgtgtggcctctggattcactttcagtatggctggatgagttgggccgcaggctccgagggagggcgtggngtgggttgacgttacaaagtaaaatgagtggtagaagaaagtagacgtacggtgaccgaccgtagaaaggagtacttacactatctacgaagataattaagtacaaaacgtcgtagtagtttagactaaatgaacacgaccgtaagaaaccgaggacaacgacgtccgtacctaattaccgtagtaccaacgacgtaacgttaccggtaaggtcgaacgtacgtaccgtaacggtaaagggacggtacttagtacgttcgtttagattacgtcgggttaccgggacccgtaggggacctaggttccggg

SEQ ID NO: 114332 - DNA, 626 bp, Homo sapiens
  misc_feature: GYAE6OF02IQ4EC.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggctgggagtggggttggacgtttcaaaagtaaaatgatggtagaagaaaatagagtacggtgcaccgtagaaaggaagattcaccatctacaagagaataattacaaaaacggcgggttagtaattttagactaaaagtacgaaacacgacctaagaaaaacccggaggaaccaacgacgccgtacttattactagtacccacagtacgttacggaagtcgacagtaccggacgtaaagggacggtctagtggttcttttaggatttagtcggttacggggcccctaaggggtacagttcggg

SEQ ID NO: 114333 - DNA, 699 bp, Homo sapiens
  misc_feature: GYAE6OF02JYI1B.15.86.H09.1.454.CMB.1.raw
  modified_base (631)..(631): a, c, t, g, unknown or other
  misc_feature (631)..(631): n is a, c, g, or t
tcagtctacgtagccacgaccggtgctcgatttagtgctatagacttgggtttggggggaggaggagccccaaccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgaggttgggtccgaccgtaggcctccgagggtaaggggctgggaggtgggttggacgtttacaaaaggtaaatgaatggtagaagtaaaacgtagaacgtacggtagccgtaacccggtgaaaaaggaacgtacgttacaaccgtaatcgtaacgaaagtagtaacttaaagttaaccgaaaaaacggtacgggttagttaaattttacggaaacctaaagttacgaaaacgtcgacccgtaaggaaaacccgtaggaactacgacgggcctagttactacgtagtaacccgacgtaagtacttaacggaacgtagctaagtaccgaacggtaaacggnggaccttaagttcgttatttaacgagtaactcggttacggggaccctaggggaacttacgtgggtccg

SEQ ID NO: 114334 - DNA, 618 bp, Homo sapiens
  misc_feature: GYAE6OF02HO17P.15.86.H09.1.454.CMB.1.raw
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggttttccttgctgctatcttaaaaggtgtccagtgtgaagtgcaggtggtggagtcgtgggggagccttggtaaagccgtgggggtcccttaggagtctcctgtgtggcctcgtggattcactttcagtaatggctggatgagttgggtccgcaggctccgagggagggctggaggtgggtggacgtttanaaaagtaaatgatggagaagaaaagtagactacggtcacgaccgtagaaaggaanatccacatcacaagagtataatacaaaacggtcgtagtattgacaaagtgaacagactagaaaaccgtaggaacacacgacctactattactacgttaccacgtagtagttaccggaagttcgacgtacgtaccggtaacggtaacggtaggtcttaaggttcgttacgttttagagttacgtacggtacggggtaccccgtaagggtaccgaagttcggg

SEQ ID NO: 114335 - DNA, 614 bp, Homo sapiens
  misc_feature: GYAE6OF02IYGLB.15.86.H09.1.454.CMB.1.raw
  modified_base (491)..(491): a, c, t, g, unknown or other
  misc_feature (491)..(491): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtcccgcaggctccagggaaggggctggagtgggttggacgtttacgaaaagtaaaatgatggtgaagaaaatagactacggtgacaccgtagaaaggaagattacacatctacaagagtaataattacaaaaacgtcggtagtaatttgactaaagtgaaacagcctagaaaaccgaggaacacgacgtaccgtntaacttactacgtaacccaataggaattcggaaagtcgacacgtacggacgtaaaggacggtcttaagtggtacttttgaattacgttacggtacggggaccccaaggggtaccaagttcggg

SEQ ID NO: 114336 - DNA, 550 bp, Homo sapiens
  misc_feature: GYAE6OF02FFZO9.15.86.H09.1.454.CMB.1.raw
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (455)..(455): a, c, t, g, unknown or other
  misc_feature (455)..(455): n is a, c, g, or t
  modified_base (473)..(473): a, c, t, g, unknown or other
  misc_feature (473)..(473): n is a, c, g, or t
  modified_base (504)..(504): a, c, t, g, unknown or other
  misc_feature (504)..(504): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaagggctggagtgggtgacgtttcaaaagtaaaangatggtgagaaatgactacggtncaccgtgaaaggagattcaccatctacaagagataatacaaaaacgcggtgtatttgacaaatgaacagcctagaaaaccgngacacagcctatattacngtaccatagattcgaatgcatcgagaaaggngactatgtcttttagattatcggtacgggcccagggtacagttcgg

SEQ ID NO: 114337 - DNA, 592 bp, Homo sapiens
  misc_feature: GYAE6OF02HF41P.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggagggctggagtgggttggacgtttacaaaagtaaaatgatggtagaagaaaatagactaggtgacaccgtagaaaggaagattacacatctacaagagataatacaaaaacgtcggtatatttagactaaatagaacagacctaagaaaaccgaggaacaacgagacccgtactaattaccgtagtaacccatagtacttacggaagtgacagtacggacgtaaaggcggtactagtgtacttttgattagtcgtacggggaccctagggacagtcggg

SEQ ID NO: 114338 - DNA, 590 bp, Homo sapiens
  misc_feature: GYAE6OF02HKPYL.15.86.H09.1.454.CMB.1.raw
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (488)..(488): a, c, t, g, unknown or other
  misc_feature (488)..(488): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggccgccaggctccgaggggaagggctgggagtggggttggacgtttacaaaagtaaaatgatggtagaagaaatagactacggtgacgaccgtagaaagganatcacatcanaaganataatacgaaaacgcggtatattgactaaatgaacagcctaagaaaccgagacacagcctatatactagaccanagtacttcgaagtgactagtacgaacggtaaggacggtactagtcggtactttttaggaattcgtacggtacggggtaccccgaagggtacctaagttcggg

SEQ ID NO: 114339 - DNA, 562 bp, Homo sapiens
  misc_feature: GYAE6OF02JEE1W.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaggggctggagtgggttggacgtttcaaaagtaaaatgatggtgagaaatagactacggtgcaccgtgaaaggagacttcacatctcaagagataattacaaaaacgacggtagttatttagcaaatgaacagctagaaacgagacacagccgtactattactacgtaccacagtacttacggaatgacagtacgagtaaggaggctatcgtcttttagattatcgtgggacccgaggacagttcgg

SEQ ID NO: 114340 - DNA, 583 bp, Homo sapiens
  misc_feature: GYAE6OF02IF8Z7.15.86.H09.1.454.CMB.1.raw
  modified_base (413)..(413): a, c, t, g, unknown or other
  misc_feature (413)..(413): n is a, c, g, or t
  modified_base (502)..(502): a, c, t, g, unknown or other
  misc_feature (502)..(502): n is a, c, g, or t
  modified_base (556)..(556): a, c, t, g, unknown or other
  misc_feature (556)..(556): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctctgtgtggcctctggattcactttcagtaatggctggatgagttgggtccgccaggctccgagggaaggggctgggaggtgggttggacgtttacgaaaagtaaaatgatggtgaagaaaagtagactacggtgacaccgtagaaagaagattacgacatctanaagagataattacaaaaacgtacgtgttaattgctaaaatgaaacacgactaaggaaaaccgagacacagccgtatattacacgtacanagattacgaatgcctatacggacgttaaagggagtctaatgtacttttgaattnacggtcgggacccagggtacagttcgg

SEQ ID NO: 114341 - DNA, 583 bp, Homo sapiens
  misc_feature: GYAE6OF02GABBC.15.86.H09.1.454.CMB.1.raw
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgaggggaaggggctgggagtgggttggacgtttacaaaagtaaaatgatggtagagaaaatgactacggtncaccgtgaaagganattcacatctacaaagagaataattacaaaaacgacggtagttatttagacaaatgaacagacctaaggaaaaccgaggacacacgaccgtcttaattactgtaaccacagtattaggaatgacataccgacggtaaggaggctagtgttctttgattagtcgtcggggacccagggactaagtcggg

SEQ ID NO: 114342 - DNA, 610 bp, Homo sapiens
  misc_feature: GYAE6OF02FYJ99.15.86.H09.1.454.CMB.1.raw
  modified_base (152)..(152): a, c, t, g, unknown or other
  misc_feature (152)..(152): n is a, c, g, or t
  modified_base (465)..(465): a, c, t, g, unknown or other
  misc_feature (465)..(465): n is a, c, g, or t
  modified_base (480)..(480): a, c, t, g, unknown or other
  misc_feature (480)..(480): n is a, c, g, or t
  modified_base (547)..(547): a, c, t, g, unknown or other
  misc_feature (547)..(547): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagcngggttttccttgctgctatcttaaaggtgtccagtgtgaagtgcaggtggtggagtctggggggagccttggtaaagcctggggggtcccttagagtctcctgtgtggcctctggattcactttcagtaatggctggatgagttgggtccgccaggctccaggggaacggggctgggagtgggttggacgtttacaaaagtaaaatgatgggtagagaaatagactaggtgcaccggtagaaggaagagttacaaccgtatctagaagtagataattacaaaaacgtacggtagtaagtttgacaaatagaanagcctagaaaaccgnggtaacacagtccgtatattacagtaccaactagacttcggaaagtcgacagtcggacgtaaagggnggactaagtcggtacttttaggattacgtcgttacggggacccacggggtacgtagttccggg

SEQ ID NO: 114343 - DNA, 682 bp, Homo sapiens
  misc_feature: GYAE6OF02H6UJ3.15.86.H09.1.454.CMB.1.raw
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagctgggttttctttgctgctatcttaaaaggtgtccagtgtgaagtgcaggtggtggagtcgtgggggagccgttggtaaagccgtgggggtccttagagtctcctgtgtggcctcgtggattcactttcagtaatggctggatggaggttgggtccgccgaggctccgaggggaggggcgtggaggtgggtggtacgtttacaaaagtaaaatgagtaggtagaagaaaatagaacgtacggtgacgaccggtagaaaaggaagattacacctatactacaagaagtaattaattaacgaaaaacggtacggttagttaagtttacgaataaagtagaaacagaccgtaacgaaaaccgagaaccaacgacgtacccgttaacttacttaaccgtacgtacccaacgtacgtaagttaccgggaagtcgacctaacgtacggaacggtaaagggtacgtacgttaagttacgttcgtttttaagagttacgttaccggtaccggggtacccgaagggtaccgtaggttaccggg

SEQ ID NO: 114344 - DNA, 573 bp, Homo sapiens
  misc_feature: GYAE6OF02GLZ4Y.15.86.H09.1.454.CMB.1.raw
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggaggggctggagtgggtggacgtttacaaaagtaaaatgatggtagagaaaatagactacggtgacaccgtagaaaggaagattcacatctacaagagataatacaaaacgngtagtattganaaatagaacagcctagaaaaccgaggacacagccgtactattacacgtaccacagtagttcggaagtgcagtacgacgtaaggaggtctaagttgtacttttgattagtcggtggggcccgagggtacctaagtcggg

SEQ ID NO: 114345 - DNA, 625 bp, Homo sapiens
  misc_feature: GYAE6OF02FZEW4.15.86.H09.1.454.CMB.1.raw
  modified_base (391)..(391): a, c, t, g, unknown or other
  misc_feature (391)..(391): n is a, c, g, or t
tcagtctacgtagccacgaccggtgctcgatttagtgctatagacttgggtttgggggggggagagggagccccagaccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaagccgtggggggtcccttagagtctcctgtgtggcctctggattcactttcagtaatggctggatgagttgggtccgccaggctccgaggggaggggcgtgggaggtggggttggacgtttacgaaaaagtaaaatgagtgggtgaagaaaatagactaggngcgaccgtagaaaggaagatcacatcacaagagaataattacgaaaaacgtcggtagtaatttagataaatagaacacgaccgtaacgaaaaccgagaccgacacgaccgtactattactcgtaaccactaagtacttacggaaggtcgacagtaccggaacggtaaacggaggtaactagtcgttacgtttgaattagtaccggtcggggacccgtagggactacggttcggg

SEQ ID NO: 114346 - DNA, 627 bp, Homo sapiens
  misc_feature: GYAE6OF02HN2W5.15.86.H09.1.454.CMB.1.raw
  modified_base (384)..(384): a, c, t, g, unknown or other
  misc_feature (384)..(384): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcccttagagtctcctgtgtggcctctggattcactttcagtaatggctggatgagttgggccgccaggctccgaggggaagggctggaggtgggttggacgtttacgaaaagtaaaatgaatggtagaagaaaatagaactacggtnacaaccgtaggaaaaggagataccacatcacaagagataatacaaaaacgcgtagtattgactaaatagaaacagacctaaggaaaaccgaggaacacgacgtccgtactattaactacgtaaccacgagtacttacggaagtcgactaagtacggaacgtaagggacggtacgttagtcgttacgttttagaactttacgtcggtaccggggtaaccccgaagggtacctaaggttaccggg

SEQ ID NO: 114347 - DNA, 575 bp, Homo sapiens
  misc_feature: GYAE6OF02JFMWJ.15.86.H09.1.454.CMB.1.raw
  modified_base (465)..(465): a, c, t, g, unknown or other
  misc_feature (465)..(465): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggttggacgtttcaaaagtaaaatgatggtgaagaaaatagactacggtgcaccgtgaaaggagattcacatctacaagagataatacaaaaacgcggtagtatttagacaaagtgaacagacctagaaaaccgngaacacagccgtactattactgtaccacagtattacggaagtgacatacgacgtaaaggaggacttatgtcttttagattagtcgtacgggacccagggtactagtcggg

SEQ ID NO: 114348 - DNA, 559 bp, Homo sapiens
  misc_feature: GYAE6OF02GMK9Y.15.86.H09.1.454.CMB.1.raw
  modified_base (373)..(373): a, c, t, g, unknown or other
  misc_feature (373)..(373): n is a, c, g, or t
  modified_base (466)..(466): a, c, t, g, unknown or other
  misc_feature (466)..(466): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggtggacgtttcaaaagtaaaatgatggtgagaaatagactacggtncaccgtgaaaggagattcacatctacaagagataatacaaaacgcggtagtatttagacaaatgaacagcctagaaaccgagacacagccgtntattactagtaccacagtacttacggaagtgacagtaccgacgtaaggagacgtatgtactttgatatcggtagggccgagggtacagttcgg

SEQ ID NO: 114349 - DNA, 632 bp, Homo sapiens
  misc_feature: GYAE6OF02IGYR3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggttttcctgacgtgctatcgttaaaggtgtccagtgtgaagtgcaggtggtggagtctgggggagccttggtaaagcctgggggtcccttagagtctcctgtgtggcctctggattcacttttcagtaatggctggatgagttgggtccgccaggctccgagggagggctgggagtgggttggacgtttacaaaagtaaaatgatggtagaagaaatagactacggtgcaccgtagaaacggagtattcacatctacaagagataattacaaaaaggtacggtgttaatttgactaaatacgaacagtaccgtaagaaaacccgaggaaccacgaacgtccgtacttaattacctagtacccaagtacgtaagttacggaaagttcgacgtagtcgaacggtaaaggacggtactaagttgttacgttttagaagttacgtacggttacggggacccctaagggtacctaaggttccggg

SEQ ID NO: 114350 - DNA, 601 bp, Homo sapiens
  misc_feature: GYAE6OF02G1LKL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctgggggtcccttagagtctcctgtgtggcctctggattcactttcagtaatggctggatgagttgggtccgcgaggctccgagggaaggggctggaggtgggttggacgtttacgaaaagtaaaatgatggtagaagaaaatagactaggtgacaccgtagaaaggagattcacatctacaagagaataatacaaaaacgcggtagtatttgacaaatgaacagcctaagaaaaccgaggaaccacgacgaccgtctattactacgtaaccacgagtagttacggaagtcgacagtcggaacgttaaggacggtactagtgtacgttttagattacgtcggtaggggaccccgtaagggacctaaggttcggg

SEQ ID NO: 114351 - DNA, 609 bp, Homo sapiens
  misc_feature: GYAE6OF02IZ87F.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtgcctctggatcactttcagtaatgctggatgagttggtccgcaggctccgagggagggcgtggagtgggtggacgtttacaaaagtaaaatgatggtagaagaaatgactacggtgcaccgtagaaagagattacactatctacaagagataaatacaaaaacgtaggtagtatttagacaaatagaacagacctaagaaaaccgaggaaccaagacgaccgtacttacttactacgtaaccacgtagtacgttaggaagtgaactagtacggaacggtaagggaaggacttagtacgtacgttttagattacgttcggtacggggtaccccgaagggtacctaaggtcgg

SEQ ID NO: 114352 - DNA, 585 bp, Homo sapiens
  misc_feature: GYAE6OF02FUZCF.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttcaaaagtaaaatgatggtagagaaaatagactaggtgcaccgtgaaaggagattcaccatctacaagagaataattacaaaaacgacggtaatatttagacaaatgaaacagacctagaaaaccgaggaaccacagcctatattacacgtaccacagattacggaagtgacagtacgacgtaaaggaggtctaagtgtacttttagaattacgtcggtacggggacccgtagggtacaagttcggg

SEQ ID NO: 114353 - DNA, 608 bp, Homo sapiens
  misc_feature: GYAE6OF02GGR5G.15.86.H09.1.454.CMB.1.raw
  modified_base (419)..(419): a, c, t, g, unknown or other
  misc_feature (419)..(419): n is a, c, g, or t
  modified_base (497)..(497): a, c, t, g, unknown or other
  misc_feature (497)..(497): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgaggggaaggggctgggaggtgggttggacgtttacaaaagtaaaatgatggtagaagaaaatagactacggtgaccaccgtagaaaggagattcacatctacaaganataatacaaaacgagtatattgacaaatagaacagacctagaaaccgagacacacgccgtactattacctagtaccanagtagttacggaagtgacatacggaacgtaaagggaggtcttaagttcggttacgtttttaggaatttacgttccggtacggggtaccccgaggggtacctaaggttcggg

SEQ ID NO: 114354 - DNA, 603 bp, Homo sapiens
  misc_feature: GYAE6OF02IQDDG.15.86.H09.1.454.CMB.1.raw
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (473)..(473): a, c, t, g, unknown or other
  misc_feature (473)..(473): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttagggtaaacgccgtgggggtcccttagagtctcctgtgtcggcctcgtggacttcgacttcagtaatggctggatggagttcgggtccgccgagggctccggaggggaacgggggcgtggggtaggtggggttggaacggtttacaaaagttaaaatgagtggtagaagaaatagacgtacggtgcaccgtgaaagagatcacatctnaaganataatacaaaacgtcggtattatttagacaaatagaanacgactagaaaaccgaggacacacgtcctactattacctagtaccacagtagttcgaagtcgacatacggaagttaagggagcgttagtgtcgtttagacttagtcgacgggaccgaggacgtagtcggg

SEQ ID NO: 114355 - DNA, 576 bp, Homo sapiens
  misc_feature: GYAE6OF02G34ZM.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaaggggctgggagtgggttggacgtttcaaaagtaaaatgatggtagagaaaatagactacggtgcaccgtagaaaggagattcacatctacaagagataattacaaaaacgtaggtatatttagactaaatgaacagacctagaaaaccgagaacacacgccgtactattactcgtaccacagtattcggaagtcgacatacgagtaaggagtcttagtgtcttttagattagtcgtagggacccagggacctagtcggg

SEQ ID NO: 114356 - DNA, 627 bp, Homo sapiens
  misc_feature: GYAE6OF02IN6S6.15.86.H09.1.454.CMB.1.raw
  modified_base (471)..(471): a, c, t, g, unknown or other
  misc_feature (471)..(471): n is a, c, g, or t
tcagtctacgtagccacgaccggtgctcgatttagtgctatagacttgggtttgggggggggagaggagccccagccttggggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaagggggctgggaggtgggttgggtacgtttacgaaaagtaaaagtgatggtagaagaaaatagactacggtgacacccgtaggaaagaagtattacaccagtctcaaagagaataattacaaaaacgtacggtagttaatttgactaaatanaacagtaccgtagaaaaccgaggaacacgacgtacctacgtattactacgtacctacagtacttacgggaatagactataccggagtaaaggacggtactagttgtacttttagacgttactcggtacggggacccgaacgggtacaaggtccggg

SEQ ID NO: 114357 - DNA, 581 bp, Homo sapiens
  misc_feature: GYAE6OF02GO022.15.86.H09.1.454.CMB.1.raw
  modified_base (377)..(377): a, c, t, g, unknown or other
  misc_feature (377)..(377): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgcaggctccgagggagggcgtggagtgggtggacgtttacaaaagtaaaatgatggtagaagaaatagactaggncaccgtgaaaggagatacacatcacaagagtaataattacgaaaacgcggtagtatttagataaagtgaaacgacgacctaagaaaaccgacgaacacgacgccgtactattacgtacgtacacgagtacttaggagtgacagtacgagtaaggaggactatagtctttagattacgtcggtacgggaccgaggtacagtccgg

SEQ ID NO: 114358 - DNA, 586 bp, Homo sapiens
  misc_feature: GYAE6OF02HDAVG.15.86.H09.1.454.CMB.1.raw
  modified_base (491)..(491): a, c, t, g, unknown or other
  misc_feature (491)..(491): n is a, c, g, or t
  modified_base (519)..(519): a, c, t, g, unknown or other
  misc_feature (519)..(519): n is a, c, g, or t
  modified_base (535)..(535): a, c, t, g, unknown or other
  misc_feature (535)..(535): n is a, c, g, or t
  modified_base (548)..(548): a, c, t, g, unknown or other
  misc_feature (548)..(548): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagtttgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaaggggctggagtgggttggacgtttacgaaaagtaaaatgagtggtagaagtaaaatagacgtacggtgaccacccgtagaaacggaagtatcaaccatctacaagagtaataagttacaaaaacgcggttagtaatttgactaaatgaacagacctagaaaccgagacacagcctntatactgtaccacagtattacgaagtcncagtacgacgtaaggnggtactagtcgtntttagatcgtcggtacgggccgaagggactagttcggg

SEQ ID NO: 114359 - DNA, 607 bp, Homo sapiens
  misc_feature: GYAE6OF02GMR3H.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccgaggcctccaggggaaggggctggagtggggttggacgtttacgaaaagtaaaatgaatggtgaagaaaatagactacggtgacaccgtagaaaggaagattcaccatctacaagagtaataattacgaaaaacgcggttagtaatttgacaaatgaacagcctagaaaaccgaggacacgacgccgtactattactagtaaccacgaagtagttacggaatgactagtcgaacgtaaaggcggtacttatcgttacgttttaggacttagtcgtacggggacccaagggtaccaagttcggg

SEQ ID NO: 114360 - DNA, 552 bp, Homo sapiens
  misc_feature: GYAE6OF02FJRXX.15.86.H09.1.454.CMB.1.raw
  modified_base (487)..(487): a, c, t, g, unknown or other
  misc_feature (487)..(487): n is a, c, g, or t
  modified_base (513)..(513): a, c, t, g, unknown or other
  misc_feature (513)..(513): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccaggggaggggctggagtgggttggacgtttcaaaagtaaaatgatggtgagaaatgactacggtgcaccgtgaaaggagattcacatctacaagagataattacaaaaacgacggtagtatttgacaaatgaacagacctagaaaaccgaggacacagccgtactattactgtaccanagattcgaatgcatacgacgtaaggngctatgtcttttgattatcgtgggcccagggacagtcgg

SEQ ID NO: 114361 - DNA, 709 bp, Homo sapiens
  misc_feature: GYAE6OF02GIODW.15.86.H09.1.454.CMB.1.raw
  modified_base (374)..(374): a, c, t, g, unknown or other
  misc_feature (374)..(374): n is a, c, g, or t
  modified_base (414)..(414): a, c, t, g, unknown or other
  misc_feature (414)..(414): n is a, c, g, or t
  modified_base (653)..(653): a, c, t, g, unknown or other
  misc_feature (653)..(653): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtcgtgggggagccttggtaaagccgtgggggtcccttagagtctctgtgtggcctcgtggattcactttcagtaatggctggatgagttcggccgcgaggctccgagggagggctggagtggtgacgtttacaaaagtaaatgagtggtagaagaaatagactacggtnaccgtaccgtaggaaaggagtattaccgaactaatcctanaaacgtagtaaacttaacttaaccgaaaaaacggtcggttaacgttaagtttacgtaacgtaaaagttacgaaaccgacgtaacccgttaaaggtaaaaacccggagggtaaaccaaccggacgtaacccgttacttaacgttaacttaccgtaacccgaacgtaacggttaagttaccgggaaagttcgacctaaggtaccggtaacgggtaaacggaggtaacctaagttacggttntttttacgaagttacgtcggtaccggggtaacccgaacgggtacctaagttccggg

SEQ ID NO: 114362 - DNA, 560 bp, Homo sapiens
  misc_feature: GYAE6OF02G7UNK.15.86.H09.1.454.CMB.1.raw
  modified_base (462)..(462): a, c, t, g, unknown or other
  misc_feature (462)..(462): n is a, c, g, or t
  modified_base (519)..(519): a, c, t, g, unknown or other
  misc_feature (519)..(519): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttcaaaagtaaaatgatggtgaagaaaatagactacggtgcaccgtagaaaggaagattcactatctacaagagataatacaaaacgcggtagttattgacaaatgaacagacctagaaaaccgngacacagcctatattactcgtaccacagtacttcggaatcgacagtcgacgtaaggngctatgtctttgattgtcgtgggacccagggactagtcggg

SEQ ID NO: 114363 - DNA, 580 bp, Homo sapiens
  misc_feature: GYAE6OF02GY7RE.15.86.H09.1.454.CMB.1.raw
  modified_base (409)..(409): a, c, t, g, unknown or other
  misc_feature (409)..(409): n is a, c, g, or t
  modified_base (466)..(466): a, c, t, g, unknown or other
  misc_feature (466)..(466): n is a, c, g, or t
  modified_base (506)..(506): a, c, t, g, unknown or other
  misc_feature (506)..(506): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgaggggaaggggctggagtgggttggacgtttacaaaagtaaaatgatggtagagaaatagacgtacgtgacaccgtagaaaggagattacaccatctanaagagataatacgaaaacgtagtagtattgactaaatgaacagacctagaaaaccgngacacgagacctatattactcgaccacagtattacgagtnacatcgaacgtaaggacggattagtgtcttttagacttagtccggttagggccccgtaagggacctaagtcggg

SEQ ID NO: 114364 - DNA, 689 bp, Homo sapiens
  misc_feature: GYAE6OF02GHWGN.15.86.H09.1.454.CMB.1.raw
  modified_base (375)..(375): a, c, t, g, unknown or other
  misc_feature (375)..(375): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtctgggggagccttgggtaaagcctggggggtcccttagagtctcctgtgtggcctctggattcactttcagtaatggctggatggagttgggtccgcaggctccgagggagggcgtggagtgggttgacgttacaaaagtaaatgatggtagaagaaaatagactacgganaccgaccgtagaaaacggagacttacaaccgatacctacgaaagagaattaactttacgaaaaacggtacggttagttattttacgactaaagtacggaactagacccgttaaggaaaaacccgtagggaaacccaacgaacggtacccgttacgtaaactttaccgtaacgttacccaaagtaacggttaacttcggggtaaattcggaactagttacggaaccgttaaaggaacgttaacgtaattacggttactttttaagacgtttaacgtccggtacggggacccctaaggggaccttaagttcccggg

SEQ ID NO: 114365 - DNA, 674 bp, Homo sapiens
  misc_feature: GYAE6OF02IZNS6.15.86.H09.1.454.CMB.1.raw
  modified_base (622)..(622): a, c, t, g, unknown or other
  misc_feature (622)..(622): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttggccgccaggctccgagggggaggggcgtggaggtggggttggacgtttacgaaaaagtaaaatgagtggtagaagaaaatagacgtacggtgcacccgtagaaaggaagattacaccgatctacaaagagtaataagttacaaaaacgtacggtagttattttagactaaagtagtaaacgacgtaccgtaacggtaaaaaccgaggaaaccgtaacgaccgtacccggttacttaacgtttaaccgtacgtaacccaacgtaaggtacgttaacgggtaagtcggtactaagtacgtaacggtaaaggacggtcgttaattacggttnttttagtaagttacgtcggttacggggacccggtaaggtacgtagttccggg

SEQ ID NO: 114366 - DNA, 613 bp, Homo sapiens
  misc_feature: GYAE6OF02JD41G.15.86.H09.1.454.CMB.1.raw
  modified_base (287)..(287): a, c, t, g, unknown or other
  misc_feature (287)..(287): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggntgagttgggtccgcaggctccgagggaggggctggagtgggttggtacgtttacaaaagtaaaatgatggtagaagaaatagactacggtgctaccgtgaaaggagattcacatcacaagagataatacaaaagcgtagtattgacaaagtnaacagcctagaaaccgngaacaacncgccgtctacttactacaccgaacagtacgttacggaaggtacgacgtacgtaaccgacggtaaaaggcgggacttaagttggtacccttttttaggaatttacggttccggtaccggggacccgtaacggggtacctaaggttccggg

SEQ ID NO: 114367 - DNA, 783 bp, Homo sapiens
  misc_feature: GYAE6OF02I0OOM.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttcctgctgctatcgttaaaaggtgtccagtgtgaagtgcaggtggtggagtcgtgggggagccgttaggtaaacgccggtcggggggttcccttaggacggttccttccgtggttgtcgggtccctcgtggtattctactttcaagtaagtggcgtggagtggtaggttcgggtccgccgaggtcctccggaagggaaggggcgtgggaggttgggttggtacggtttaacgaaaagtaaaagtgagtggtagaagaaataggaacgtacggtagccgtaaccgtaggaaaagggtaagacttaccgaactatactacgaaagagtaattaacgtaaacgaaaaacggtggttaagttaacgtttaggaactaaagttacggaaactacggtacctaaacggaaaaaccgcggaaaccaacggtaccgtacccggttacttaacgttaaaccgttaccgtaaccctaaaggtacgtaacggtttaccgggtaaagtaccgtacgaaacgttaaccgggaacgggttaaaccgggaggtaccgtttaagttcggttaaccgtttttaggaaccgtttacggtccgggtttaaccggggaccccggaacgggttaactaacggtttcggg

SEQ ID NO: 114368 - DNA, 610 bp, Homo sapiens
  misc_feature: GYAE6OF02GPUGX.15.86.H09.1.454.CMB.1.raw
  modified_base (414)..(414): a, c, t, g, unknown or other
  misc_feature (414)..(414): n is a, c, g, or t
  modified_base (451)..(451): a, c, t, g, unknown or other
  misc_feature (451)..(451): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagccgtggggggtcccttagagtctcctgtgtggcctctggattcactttcagtaatggctggatgagttgggtccgccaggctccgagggaaggggctgggagtggggttggacgtttcaaaagtaaaatgatggtagaagaaatagactacggtgcaccgtgaaaggagattcacatctacaaganataatacaaaacgacggtgttatttgacaaatcgaanacgaccgtaggaaaaccgaggaacaacgacgacccgttactaattacctacgtaaccaactagtaacgtttacggaaagtcgacagtacgacgtaaagggaggtcttaagtgtcttttagattagttcggtcggggacccgtagggtactaggttcggg

SEQ ID NO: 114369 - DNA, 655 bp, Homo sapiens
  misc_feature: GYAE6OF02F35ZF.15.86.H09.1.454.CMB.1.raw
  modified_base (398)..(398): a, c, t, g, unknown or other
  misc_feature (398)..(398): n is a, c, g, or t
  modified_base (577)..(577): a, c, t, g, unknown or other
  misc_feature (577)..(577): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgtagttgggtccgccaggcctccgagggaggggctgggagtgggttggacgtttacaaaagtaaaatgagtggtagaagaaatagactacggtgcaccgtagaaagganatcacatctacaagagaataattacgaaaacgtcggtagttaattgacaaattacgaaacgtacgacctaaggaaaaccgtacggaaccaacgacggtacccgtacttaactttacgacgtaacccaccgtaagtattacgggaaagtcgactacgtacggtacggtaaaggacgggtnttaacggtcgttacgtttttaacgagtttaacgtcgggttaccgggggacccctaagggggttacctaaggtttcggg

SEQ ID NO: 114370 - DNA, 604 bp, Homo sapiens
  misc_feature: GYAE6OF02JCT85.15.86.H09.1.454.CMB.1.raw
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctgggaggtgggttggacgtttacaaaagtaaaatgatggtgaagaaatagactaggtgactaccgtagaaaggagattcaactatctacaagagtaataattacaaaacgtacggtatattgacaaatgaacngacctagaaaccgngaacacgacgccgtataattactagtaccgagaggtacttacgggaagtacgactagtaccggtacgtaaagggacggtacttaagtgtccgttttagacttacgttcgtccgggaccgtagggactagttcggg

SEQ ID NO: 114371 - DNA, 594 bp, Homo sapiens
  misc_feature: GYAE6OF02GPYFS.15.86.H09.1.454.CMB.1.raw
  modified_base (420)..(420): a, c, t, g, unknown or other
  misc_feature (420)..(420): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtgatggagtctgggggagccttggtaaagcctggggggtcccttagagtctcctgtgtggcctctggattcacttttcagtaatggctggatgagttgggtccgccaggctccgaggggaaggggctggaggtgggttggacggtttacgaaagtaaaatgatggtagaagaaaatagactacggtgacaccgtagaaaggaagattacacatcacaaganataattacaaaacgcggtagtatttgactaaatgaacagacctagaaaaccgaggacacgagccgtactaattactgtaaccatagagttacggaaatgacagtacgaacgtaaggnggtacttagtcgttattttagattacgttcggtacggggacccgtagggactaacgg

SEQ ID NO: 114372 - DNA, 686 bp, Homo sapiens
  misc_feature: GYAE6OF02JVCEB.15.86.H09.1.454.CMB.1.raw
tcagtctacgtagccacgaccggtgctcgatttagtgctatagacttgggtttggggggggtaggagggaggccccgagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttgggtaaagccgtggggggtcccttaggagtctcctgtggtggccttctgggattcacttttcagtaactggctggatgagttgggtccgcaggctccgagggaacgggctgggagtgggttggacgtttacgaaaaggtaaaactggatgggtagaagaaaactaggtactacggtgaccgaccgttagaaagggaagacttacaaccgatacacgtaaggaagtataacttaacgaaaaacggtacggtacgttaatttacgaacgtaaaagtacgtaacaaacggtacctaaggaaaaacccggtcgaaacgaccgtagtacccgtagttaactacgtacgtaacccaacggataacgtttacgggaacgttgacacgtaacgtacggtaaaaggtcggacttaacgtgtccgtttagattaacgtcggtacggggaccctaaggggactaagtcggg

SEQ ID NO: 114373 - DNA, 695 bp, Homo sapiens
  misc_feature: GYAE6OF02JTH6X.15.86.H09.1.454.CMB.1.raw
  modified_base (670)..(670): a, c, t, g, unknown or other
  misc_feature (670)..(670): n is a, c, g, or t
tcagtctacgtagccacgaccggtgctcgatttagtgctatagacttggtttgggggggtaggagggaggccccgagccttgggagtccccaacgtgttttcattcagtgatcaggactgaacacagaggactcaccatggagttcgggctgagctgggtttccttgctgctatcttaaaggtagtccagtgtgaagtgcgaggtggtggagtcgtgggggagccgtttgggtaaagccgtaggggggtcccctttaggacgttccgtccgtgtggtcggccttcgtgggattcgactttcagtaatggctggatggagttgggtccccgaggctcaggggagggctggaggtggtggactttacgaaaagtaaatgaagttggtacgaagaaaatagtacgtacggttagaccgaccggtagaaaagggaagtacttacaaccgatttccgcaaaggataactaagtttaacgaaaaacgtacggtaagtttaacttagggactaaagttagaaacgtacgtaccgtaaacggaaaaccgaacgggaactaaccgaacggtacccgtaacgtttaacttaaaccgtaccgttaaccgaaacctaaggtaattaaccgggaaagtcgactagaccgtagaaaggtcgacgtaatgtacctttgaattcgnggtccgggtaccgaggtactatcgg

SEQ ID NO: 114374 - DNA, 584 bp, Homo sapiens
  misc_feature: GYAE6OF02H15UW.15.86.H09.1.454.CMB.1.raw
  modified_base (242)..(242): a, c, t, g, unknown or other
  misc_feature (242)..(242): n is a, c, g, or t
  modified_base (395)..(395): a, c, t, g, unknown or other
  misc_feature (395)..(395): n is a, c, g, or t
  modified_base (457)..(457): a, c, t, g, unknown or other
  misc_feature (457)..(457): n is a, c, g, or t
tcagtctacgtagccacgaccggtgctcgatttagtgctatagacttgggtttgggggtccactggggcagtctcgaatagagctcttggaagtccctccaaccatggcctgggtctccttctacctactgccccttcattttctccacaggtctctgtgctctgcctgtgctgactcagccccccgtctgcatctgccttgctgggagcctgatcaagctcacctgcaacctaagtagtgngcatcgaacctacaccatcgaatcggtatccaacgagaacgacgagggaaccgtacccccaagtactagtaatagtaaaagttagaggtgatggacagccaacgaaccgaagggggacggactccccgatcgtcttcagtggactcgagttcnggggcctgaccgctacctcaccatcctaccaacctcgagtctacgacgattgagtcagtatnacgtactggtaggagagacggaccaacgtaactaattaggacttagggccgtaaaggtcgggttgggtcggttaccggacgggaacgggaacacgcgttaccggaccgtacccgtaggtacaaccgg

SEQ ID NO: 114375 - DNA, 627 bp, Homo sapiens
  misc_feature: GYAE6OF02F2F9W.15.86.H09.1.454.CMB.1.raw
  modified_base (181)..(181): a, c, t, g, unknown or other
  misc_feature (181)..(181): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (453)..(453): a, c, t, g, unknown or other
  misc_feature (453)..(453): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
  modified_base (533)..(533): a, c, t, g, unknown or other
  misc_feature (533)..(533): n is a, c, g, or t
  modified_base (548)..(548): a, c, t, g, unknown or other
  misc_feature (548)..(548): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacccgacttaaaccgggacaaccgtcgcccgccaacatacgccttctccgtcccccttgcagtaacaccaagtacagaatattaacctcgttcccatcgactacgtcctttcggcctcgtccgttaggggtccactccaccctcgccccgtattaacgtggaccacggtacccttggtcctccggcgagcggtcttttcacccgtntttactcgttacttntcgtnagctattcgctacttctgactacctccagctatcgcctcacncgcaacctaccttcacgagtacttaccacgaccncctacccctaacccaacaaccncaacgtaacgcgtaccgctcgccncgacgtccgttcggntcctaggtttcggttaccgtccccgtttctacgttcccttcccgaccttacttcgtacgacgtccgtacgtacgtacgg

SEQ ID NO: 114376 - DNA, 558 bp, Homo sapiens
  misc_feature: GYAE6OF02FZRN7.15.86.H09.1.454.CMB.1.raw
  modified_base (486)..(486): a, c, t, g, unknown or other
  misc_feature (486)..(486): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccagggaaggggctggagtgggttggacgtttcaaaagtaaaatgatggtgagaaaatagactacggtgcaccgtgaaaggagattcacatctacaagagataattcaaaaacgcggtagtatttgacaaatgaaacagcctagaaaaccgaggacacagccgtactattactgtaccanagattacggaatgacagtcgacgtaaggaggtctagtgtcttttgattatcgtggggcccagggacagtcgg

SEQ ID NO: 114377 - DNA, 607 bp, Homo sapiens
  misc_feature: GYAE6OF02ISCED.15.86.H09.1.454.CMB.1.raw
  modified_base (516)..(516): a, c, t, g, unknown or other
  misc_feature (516)..(516): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccttagagtctcctgtgtggcctctggattcactttcagtaatggctggatggaggttgggtccgccgaggctccgaggggaaggggcgtgggaggtggggttggacgtttacgaaaagtaaaatgagtaggtagaagaaaatagacgtacgtgacaccgtagaaaggagatacacatctacaagagataatacaaaacgtaggtagtattagacaaagtagaacacgacctagaaaaccggtagaacacgacgaccgtactaattactacgtaccanagtacgttacggaagtgacagtacgagtaaaggagtactagtcgtacgtttagtatacgttcggtcgggacccgtacgggtacgtagtcgg

SEQ ID NO: 114378 - DNA, 590 bp, Homo sapiens
  misc_feature: GYAE6OF02F0ZLZ.15.86.H09.1.454.CMB.1.raw
  modified_base (414)..(414): a, c, t, g, unknown or other
  misc_feature (414)..(414): n is a, c, g, or t
  modified_base (501)..(501): a, c, t, g, unknown or other
  misc_feature (501)..(501): n is a, c, g, or t
  modified_base (534)..(534): a, c, t, g, unknown or other
  misc_feature (534)..(534): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtccttagagtctcctgtgtggcctctggattcactttcagtaatggctggatgagttgggtccgccaggctccgaggggaaggggcgtggagtgggttggacgtttacaaaaggtaaaaatgaagtggtagaagaaaatagactaggtgcaccgtgaaaggagattcacatctacaaganaataatacaaaaagacggtagtaatttgacaaagtgaaacagcctagaaaaccgaggacacacgccgtactaattactgtaacccanagtattacgggaatgacatcgaacgtaaagggnggtactaatggtacttttgaattagtcgtcggggtacccaggggacctaagtcggg

SEQ ID NO: 114379 - DNA, 654 bp, Homo sapiens
  misc_feature: GYAE6OF02I2VLX.15.86.H09.1.454.CMB.1.raw
  modified_base (442)..(442): a, c, t, g, unknown or other
  misc_feature (442)..(442): n is a, c, g, or t
  modified_base (501)..(501): a, c, t, g, unknown or other
  misc_feature (501)..(501): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttgggggggggtaggagggaggccccagccttgggatcccaagtgttttcattcagtgatcaggactgaacacagaggactcaccatggagttcggggctgagctgggttttccttgctgctatcttaaaaggtgtccagtgtgagtgcaggtggtggagtctgggggagccgttggtaaagcgtgggggtccttaggagtctctgtgtggcctcgtggattcacttttcagtaatggctggatgtagttgggtccgtccgagggctccgaggggaagggggctgggaggtggggttggacggtttcgaaaaaggttaaaagtgaagtggtagaaggaaaagtgaacgtacggtagcgtaacccggtaggaaaagggaagagttacaactntctacaagcgaattaagtacgaaaaacgagggtattaagtttacgactaaaatgaaacnggacctaaggaaaccgagacaacagacctattaatatacgtaacccaanaggttattacgggaaagtcgacgaacttggaaacggtaggaaggcttaacgtgttaccttttagataacgttcggtaccggggctaagggacctaggttacggg

SEQ ID NO: 114380 - DNA, 649 bp, Homo sapiens
  misc_feature: GYAE6OF02GG45J.15.86.H09.1.454.CMB.1.raw
  modified_base (442)..(442): a, c, t, g, unknown or other
  misc_feature (442)..(442): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatggagttgggtccgccaggcctccgagggaagggggcgtgggaggtggggttggtacggtttaacaaaaaggttaaaaatgaagtgggtagaagaaaatagaactacggtgaccgtaaccggtagaaaaggaagattcaaccaatctacgaaganaataaacttaacgaaaaacgtacggtagttaagtttgaactaaatagaacacgacctaaggaaaaccgaggaacaacacgtaccgtacttaacttaccgtagtacccaagtacgtaacgttacggaagtcgactaacgtaccggaacgtaagggacgtacgtataggttctttagattagtcggtacgggacccagggactagtcgg

SEQ ID NO: 114381 - DNA, 695 bp, Homo sapiens
  misc_feature: GYAE6OF02JYFVW.15.86.H09.1.454.CMB.1.raw
  modified_base (218)..(218): a, c, t, g, unknown or other
  misc_feature (218)..(218): n is a, c, g, or t
tcagtctacgtagccacgaccggtgctcgatttagtgctatagacttgggtttgggggggaggagggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggganccgttggaaagcctgggggtccttagagtctcctgtgtgctctggattcactttcagtaatggctggatgagttcgggtcgccaggctccgaggggaagggctgggagtggggttggacgtttacgaaaagtaaaagtgagtcggtagagaaaatagacgtacggtcggactaccggtaggaaacggtaagatttacaccgaattcgaacaagaagtataactttaacgaaaaacgtacggtaagtttaacgttagaataaagtacgaaaacaacgtacaacggtaaaaccgaaggaaccgtaacgagtacccggtactaacgttaccggttacaaacccgaacgtaacgtaattaccgggtaaacgtagaccgtaattaaccggacgttaaagggacggaacgtttaagttagtaacgtttttgaacgtttacgtaccggttacgggtacccgaaggggtaccgtaagtttcgggg

SEQ ID NO: 114382 - DNA, 657 bp, Homo sapiens
  misc_feature: GYAE6OF02HA49A.15.86.H09.1.454.CMB.1.raw
  modified_base (342)..(342): a, c, t, g, unknown or other
  misc_feature (342)..(342): n is a, c, g, or t
  modified_base (497)..(497): a, c, t, g, unknown or other
  misc_feature (497)..(497): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagttaatggctggatgagttgggtccgcgaggctccgagggagggctggagtgggttgacgtttanaaaagtaaatgagtggtagaagaaaatagacgtacggtgaccaccggtagaaaaggaagtacttacaacctatcctacgaaagagtaattaacgtaacaaaaacggtggttattaatttgaactaaatcggaaacacgtacctaaggaaaaccgnggaaccacgacgcctactattactacgtaaccacagtaacgttacggaaagttcgacgtacgtacggtaacggtaaagggacggtaccttaagttacggttacgtttttaggaatttacgtccggttacggggaccccgtaagggtacctaggttccggg

SEQ ID NO: 114383 - DNA, 600 bp, Homo sapiens
  misc_feature: GYAE6OF02GR3H4.15.86.H09.1.454.CMB.1.raw
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagttaatggctggatgagttgggtccgccaggctccgagggaggggctggagtgggttggacgtttacaaaagtaaaatgatggtgagaaatgactaggngcaccgtgaaaggagattcacatctanaagagataattacaaaacgtcggtagtatttgactaaatgaacagacctaggaaaccgagaccacgacgaccgtctattactacgtacccagacgtagttacggaagtgacagtaccggacgtaaggaggtccttaagtcggtactttttaggattacgtcggttacggggaccccgtaagggtacctaaggttccggg

SEQ ID NO: 114384 - DNA, 609 bp, Homo sapiens
  misc_feature: GYAE6OF02GQRWV.15.86.H09.1.454.CMB.1.raw
  modified_base (205)..(205): a, c, t, g, unknown or other
  misc_feature (205)..(205): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggancctcgatcaagctcacctgcaccctaagtagtgagcatcgaacctacaccatcgaatggtatcaacagagaccagggaacgtcccccagtatataatagaaagttaagagtagatggcagaccaacgaccgaagggggacggacgtcccgatcgcttcagtcggctccgagttcgtcgggctgaccgctacctcacctactcctacccaacctccacgtctacgacgtagtacggagactgacgtatacacgtggtagagtacgacgaccgaactaacgtaagttacgacgttacggaccgtaaacgggtacggggtttacggggttgggttaccggggacggggtaacgggaccgtaacggtccgtaccggtaacccggttccgtacgggtccgtaacccggg

SEQ ID NO: 114385 - DNA, 657 bp, Homo sapiens
  misc_feature: GYAE6OF02GEUME.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccttggtaaagccgtgggggtcccttagagtctcctgtgtggcctctggattcactttcagtaatggctggatgtaggttgggtccgccgaggctaccgaggggaaggggcgtgggaggtgggttggtacgtttacgaaaaagttaaaatgaagtggtagaagaaaatagaacgtacggtagaccgaaccggtaggaaaaggtaagacttacaacctagtacctacgaaagagaattaaattaacaaaaacggtacggttagtagtttagaactaaagtacgaaacacgacctaagaaaacccgagaacacacgccgtactaacttacgtacgtaaccacgagtagttacggaagtcgacgtacgtacggaacgtaaggaggtactagttcggtctttttagattacgtcggtcggggacccgtagggtaccgtagttcgg

SEQ ID NO: 114386 - DNA, 619 bp, Homo sapiens
  misc_feature: GYAE6OF02FJZKZ.15.86.H09.1.454.CMB.1.raw
  modified_base (564)..(564): a, c, t, g, unknown or other
  misc_feature (564)..(564): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccgaggctccgaggggaaggggctggaggttgggttggtacgtttacaaaaagtaaaagtgagtggtagaagaaaatagactacggtgcgaccgtagaaaggaagatcaccatctacaagagataatacaaaaacgcggtatatttgactaaatgaaacagacctaaggaaaaccgaggaaccaccgagacccgttactaactttaccgtacgtaaccgaactaagtacgttacgggaagtgacagtacgacggtaaacggnggtactagttcgtacttttagattacgtcggtacgggcccaagggactagtcggg

SEQ ID NO: 114387 - DNA, 617 bp, Homo sapiens
  misc_feature: GYAE6OF02HNMV3.15.86.H09.1.454.CMB.1.raw
  modified_base (180)..(180): a, c, t, g, unknown or other
  misc_feature (180)..(180): n is a, c, g, or t
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (452)..(452): a, c, t, g, unknown or other
  misc_feature (452)..(452): n is a, c, g, or t
  modified_base (490)..(490): a, c, t, g, unknown or other
  misc_feature (490)..(490): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcggtcggtttcgtgacgtgctatacgtaaagngtcagtgtgaagtgcaggtggtggagtcgtggggagtccgttggtaaagccgtgggggtcccttagngtctcctgtgtggcctcgtggtatctactttcagtaanggtctggatgagttggtccgccaggctcgagggagggcgtggaggtggtggacgtttagaaaagtaaaatgaatggtagaagaaatacgatacggngactaccgagaaagganacttacacatactacgaagagattaatacgaaaaacgtcggtattagttacganaagtaagacagtaacgaggaaaaccgtggaacacgtancccgtatattacgacgaccatagtaccgttgaaacggttnacgtagtaacggtaacgtaaggtacggtaacgttacgtagttcgtttagagttcgtacgggtacccggacgtaaggtacgtagtcgg

SEQ ID NO: 114388 - DNA, 575 bp, Homo sapiens
  misc_feature: GYAE6OF02GCI4C.15.86.H09.1.454.CMB.1.raw
  modified_base (379)..(379): a, c, t, g, unknown or other
  misc_feature (379)..(379): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccagggaaggggctggagtgggttggacgtttacaaaagtaaaatgatggtgaagaaaatagactacggtncacccgtagaaaggagatcacatctcaagagataattacaaaaacgacggtagtaatttgacaaatgaacagcctagaaaaccgaggacacagccgtactattacctgtaccacagattcggaaagttcgacagtcgacgtaaaggnggactagtgtcttttagatacgtcgtaggggcccagggaccaagttcgg

SEQ ID NO: 114389 - DNA, 671 bp, Homo sapiens
  misc_feature: GYAE6OF02GZ6O0.15.86.H09.1.454.CMB.1.raw
  modified_base (389)..(389): a, c, t, g, unknown or other
  misc_feature (389)..(389): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagccgtgggggtcccttagagtctcctgtgtggcctctggattcactttcagtaatggctggatgagttgggtcccgccaggcctccgaggggaagggggctgggaggtggggttggacgtttacaaaagttaaaagtgatggtagaagaaaatagacttacggtnacaccgtagaaaggagattacacatactacaagagtaataacttacgaaaaacgtcggtagttaatttagactaaatgaaacagacctaaggaaaacccgaggaaccaacgacgtacctacttaacttaacgtacgttaaccaaccaagttaacgttcgggtaaagtcgactacgtaccggaaccggttaaaggaacggttacgtaacgttaggttactttttacggaatttacggttcggtaccgggggtaccccgtaaggggtaacctaaggttaccggg

SEQ ID NO: 114390 - DNA, 667 bp, Homo sapiens
  misc_feature: GYAE6OF02IYMS1.15.86.H09.1.454.CMB.1.raw
  modified_base (329)..(329): a, c, t, g, unknown or other
  misc_feature (329)..(329): n is a, c, g, or t
  modified_base (460)..(460): a, c, t, g, unknown or other
  misc_feature (460)..(460): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctcgtggattcactttcagtaatggctggatgagttgggtcccgcaggctccgaggggaaggggctggnggtgggttggacgtttacgaaaagtaaatgagtggtagaagaaatagactacggtgacaccgtagaaaggagattacacctatactacaagagaataattaacgaaaacgtacggtagttattgactaaancgaaacacgccgtaaggaaaaccgacggaacacgaacggtcccgtaattaacgttaccgttactaacccgaaccgtagtaaccgtttacgggaaagttcgaaccgtaacgtaccggaaccggttaaagggaccggtacttagtgttaccgttttagaaccgtttaggttccggtaccggggaacccgacggggtactaaggtccggg

SEQ ID NO: 114391 - DNA, 612 bp, Homo sapiens
  misc_feature: GYAE6OF02F8QUE.15.86.H09.1.454.CMB.1.raw
  modified_base (414)..(414): a, c, t, g, unknown or other
  misc_feature (414)..(414): n is a, c, g, or t
  modified_base (510)..(510): a, c, t, g, unknown or other
  misc_feature (510)..(510): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggccgcaggctccagggaagggctggagtgggttggacgtttacaaaagtaaaatgatggtagaagaaaatagacgtacggtgccacccggtagaaaaggaagattcaaccatctanaaagagtaataattacaaaaacgtcggtataatttgacaaatcgaaacacgacctagaaaaccgaggaacacgacgccgtatattacgcgtaccanagtacttacggaagtcgactagtaccgaggtaaaggcggtactaagttgtactttttagaattacgtcggtacggggaccctaggggtacctaaggttcggg

SEQ ID NO: 114392 - DNA, 668 bp, Homo sapiens
  misc_feature: GYAE6OF02H317M.15.86.H09.1.454.CMB.1.raw
  modified_base (307)..(307): a, c, t, g, unknown or other
  misc_feature (307)..(307): n is a, c, g, or t
  modified_base (383)..(383): a, c, t, g, unknown or other
  misc_feature (383)..(383): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgagtgcaggtggtggagtcgtgggggagccgttaggtaaacgccgtggggggtcccttagagtctcctgtgtcggcctctggattcactttcagtaatggctggatgagttgggtccncgaggctcgagggagggctggaggtggtggacgtttacaaaagtaaaatgatggtagaagaaaatagacgtacggngaccgaccgtaggaaaggtaagtacttaccgaacctatactacgaaagaagtaattaaagttaaccgaaaaacgggtcggttagttaagtttcgaactaaaagtagaaacctacggtacctaaaggaaaacccggaggaacaacgacggtccgtaacttaagttactacggtaaccagtaagacgttacggaagtacgactacgttaccggaaggtaacggaggtcttaagttggttacttttagaattacgtcggtacgggacccgaagggtaacaggttcggg

SEQ ID NO: 114393 - DNA, 625 bp, Homo sapiens
  misc_feature: GYAE6OF02HJ195.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagcctgggggtcccttagagtctcctgtgtggcctctggattcactttcagtaatggctggatgagttgggtccgccaggctccagggaaggggctggagtggtggacgtttacaaaagtaaaatgatggtagagaaatagactacggtgacaccgtagaaaggaagattcaccatctacgaagagataaattacgaaaaacgacgggttagttatttacgactaaatacgaaacagacccgtaagaaaaccgaggaacaacgacgccgtacttaacgttaccttacgtaccaacgtaggtacgttacgggaaagttcgactacgtacggaacgtaaaggacggtactagtcgttactttagattacgtcggacgggtacccgagggtactaaggttcgg

SEQ ID NO: 114394 - DNA, 631 bp, Homo sapiens
  misc_feature: GYAE6OF02IV8N7.15.86.H09.1.454.CMB.1.raw
  modified_base (332)..(332): a, c, t, g, unknown or other
  misc_feature (332)..(332): n is a, c, g, or t
  modified_base (569)..(569): a, c, t, g, unknown or other
  misc_feature (569)..(569): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgagttgggtccgccgaggctccaggggaaggggctgggnggtgggttggtacgtttacaaaagtaaaatgatggtagaagaaatagactaggtgacgaccgagaaagagattcgacatctacaagagactaattacgaaaaacgtacggtagtagtttagactaaagtagaacacgacctaaggaaaaccgaggaacaacacgaccgtactacttaaccttagtaacccaacgtacgacgtttacggaagtgacagtacggacggtaaggacggtnttaacgttgttactttacgattacgtccggttaggggaccccgagggtaccgtagttacggg

SEQ ID NO: 114395 - DNA, 555 bp, Homo sapiens
  misc_feature: GYAE6OF02IZAEY.15.86.H09.1.454.CMB.1.raw
  modified_base (453)..(453): a, c, t, g, unknown or other
  misc_feature (453)..(453): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtctgcatctgccttgctgggagcctcgatcaagctcacctgccaccctaagtagtgagcatccgaacctacaccatcgaatggtactcaacagagaccgagggaacgtccccccagtactataatagaaaagttaagagtgatggcagccacaccgaaggggacggactcccgatcgctcgagtcggctccgagttcgtgggctcgaccgcctacctccacctactcctacccaacctccacgtctagaccgagtgacgctagagtacncctagtggtaggagacgcgccacacaatgagtcgacgaacggtacggttgggtcggttcgggacggacggacacggcgtacgaccgtcgtacggtcgaccgg

SEQ ID NO: 114396 - DNA, 664 bp, Homo sapiens
  misc_feature: GYAE6OF02ILP0X.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggttttcctgctgctatcttaaaaggtgtccagtgtgaagtgcaggtggtggagtctgggggagccttggtaaagccgtggggggtcccttaggagtctcctgtgtggcctctggattcactttcagtaatggctggatggagttgggtccgccaggctccagggaggggctgggagtgggtggacgtttacaaaagtaaaatgatggtagaagaaaatagactacggtgacctaccgtagaaaggagatacaccatcctacaagagtataatacgaaaacgtcggtattattgactaaagtcgaaacacgacctaaggaaaacccggtaacgaacaacctacggtacccgtacttaagttaaccttacgtaaccaacgtaacgtacgttaacggaacgtagaacctacgtaccggaaggttaaacgggagggtaccttagttacgttacgtttttaggaactttacggttccgggttacggggaccccgtaagggtaccgtaaagttcgggg

SEQ ID NO: 114397 - DNA, 609 bp, Homo sapiens
  misc_feature: GYAE6OF02F1P3A.15.86.H09.1.454.CMB.1.raw
  modified_base (493)..(493): a, c, t, g, unknown or other
  misc_feature (493)..(493): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatggagttgggtccgccaggcctccgaggggaaggggcgtgggaggtgggttggtacgtttacgaaaaagtaaaatgatggtagaagaaatagactacggtgaccgacccgtagaaaaggaagtacttacaaccatctacaaagagaataattacaaaaacgcggtagtaatttgacaaatagaaacagaccctaaggaaaacccgnggaacacgacgcccgtattacttactgtaccacgagtacgttaggaatgacagtacgaacgtaaggagtactatcgtcttttagattatcggtccgggaccagggtacaggttcgg
